United States Patent 12,180,497 (RESISTANCE GENES ASSOCIATED WITH DISEASE RESISTANCE IN SOYBEANS) - sequence listing, part 3

SEQ ID NO: 2 - DNA, 2442980 bp, Glycine canescens
gtgctctgattgataaactggatatctttataaatattagttgaatgaattcaactacaactattataatggcttctgtattatttattctaatttatcttggcttctgtattatttattctaatttatcttgataaaactaggagcatcttgattgataatgttggaattctgcttgatatgctctgtatttaaatctgttggggttcccttttgtattcttcttggccatcagtttgtcattataacacaaaagaaaatccacatttactagtttctagttgtggtgtttagtagattttccatgaggaatatagatacaagatatatcttagattgatagaaatttagcagccgctaagcttctttcttttggatatgaaacaatacagcatgtaggacccctgaaatgttattggcattattaaccaaacttcttgtgatagtggattctattggataattttggagagttattaaacttgcattcggtatctttgtaggtttacatatggcacagaagctcaggggagctaatagaagcattggctggtcattcaggatctgttaattgtgtgagctggaatccagaaaatccccacatgttagcctcagccagtgatgaccgaacaattagggtatggggcctgaattgtctgcacaacaagtaccaaaatgttcacagcaatggcatccattactgcaatgggggaacttagtatgacaaactcattccaattgatttctcttttttcttatcattgcaattgtgtaaatacgattactattatcacaagtggaccattcatgtcaaacatgcatgtgacttttcatatatatctcataataaatccgtgttccattaatgtcaaactgcgatgggagactgtcttgttttaacaagtatcactgccatacgagggtttgctagaataccttggtgaggatttctagacattggatggtggataaattcaactcaattgtttttgacagaaagaactccttatgattgagtttgggttctctgtttcccgagattcaaatttgcgtttggggttgtatagtaaatacctagcctcaaattggccattgttaatattagagttaggattttattctcatactctcatttctcgtaataattgaaaatacaaattattataatgattaagtttgattcattataaatgaaaaagaaatgttgaaagatttttattttcttaaacaaatccacccaaattaatttcaattacttgaaacttgacataagttttagatttgcggtgttctattagacaaaaagtaaaaagttaagagtaaatgtttttatctaatgtaactattagggtcgtgctcgaaaatatatttaactagtttaaaatgagcatatgaagggaaaaagtaaaagcaattttattattcaaatatgagcatgtgaagtgaaaaagtaaaataatttattattcaaatacgattgactctcattaaaaaaaaatgcgacatgaaaaaacacacgtctattattgatttaaaataaaataaattataaatataattaatttaaaagttttgttaaccagtgttctaataattaaggaataaaaaagtttttaatgtaaaaatgataggaaaacacaacaaaattatgaagagcgcaattttatgttgtccaataaaaaaattatagtcttaattttttatctagcgttcttaaaatattaattaattatttgttttaatttaaaaatagatagatatcctcttatgtttacactttacataagagtctattttagaaaagttagagaattaaatgtaaggatacatgtaaacacgaaaggattaaaattattggactcctaatcaagtgattaaacataaatgattgatatactaaagttaagattgaattatttaagtaatatttaagttcaattcttgatgaaaataactattgatcaaattttagttatcgttggatcaaattttgaattagtcaatatttctttttcttttcttttcttagtgaacaaaggattaataaaaaaaaaacattaacccctcatcagagaaagtttgaaagatttttgtgcatttgaatgaactagggatggttatagctttccatgaacatgtcataacaattttttttggtaaacgaaggaaaagaaacaacaaaaagaaaattacactaaggaaaagcagaagcaaaacagatgctaataagaatccgtgtatttaaattaaaaataacaaacatctaagatactataggatttttttttcttactttaagtgaaaatataaaagtactaatactaaaaaattaaaattaaggcgaaaagagaaaaatttaaaaatgaaaaataaccacttgacatgtatgaaagttaacaactaattattttattttaatatcagatatttagtaaatgagcagtgtctttcaaacacttaactcgtttattccaataaaaaaaattaaaatagttgctaaaagaacaaatacacattttttatttataaatacatataaacaagaaggcatttacctagctttcaaaaagaaaaaaaaaggcatttacctaatatggaaaacaaaaacagataaaatggaacagcggagaaagatacgatatacacgatgacggaaggaaagcacaagtactagctagggcataactttttgtttggatgacggaaggtttttagtgtttttcttccaaagttaaatattgatccctggtgatttttttataatcatattgtcaagtaatatcgagaattttgccaattattaattttcatcaaagaaattaacttgatggagttcttccattctaattaaaattcgaatcgagaacttattaaaaaaatcagaatctaatattacttaaattaataatttgttgattgctaaattaaatattaatattaatctaaggagataatttattttcgataatcttatttcattcacccgaacctggttgaaatgcaaagccttataataatataagtgtataaggtttaaaaatttaacatttaacagagcaaagacaaaagtagaatagcagtagctgcagctgcgcttgttgcatcaagttacccactggggatttgttcaatggaaacgacgacgaagacgaacaacatagggaagaagaaaggagaaccacttttccgtcaaaaccccaaagttgatgaagtcaccaggattcgcatttcccagattctagaacacttccgagcttccaatgatgaaggtatttttcccccccttttttcttcaccatttcatgcacaaaaaacacaactttctcgtcggacgtattatgatttttgcataactatatccattcatgaaatctgggttttgattatttatttatttatttgctgcagtgtacaagtttgatcctggtttgtccaaccaagagcgtgcttgggtgcatcaaatggccctcagaatggggtttagatctagaagttatgggtgagtgttaagggcagcgcatgtaaatttgccacttttagttaaatctgtaagaattattattgtcaaaattcttaaatggaatagttggagatggaatgaatgctttagatttgtgttattgttcatattggacctgtgttttgtgtaggccagggaaggaaaggagagtgtgtgttgaaaaaatgaaaaagaaggttgacacggataacgggtttggaagtcttcctcctttcacattttctggagaggcaaagtgggtgttgggtgatttgtttgctcattatccacccggtgatggaaactcgtgggagatgatcggagaaaatagtgacgacactactactgagggaacaaaacagaggccggatgatattttcagccggccctctatgtccaaagctgaaattgctaggagattggaagctcttgcttctagaatgaacaatgtctctaacttgaaacaggtcctccttctttctctctcctttcaactccagacatgtatgagttttgttggtgaacctacatatatgaattttgttgcttagtgtttgcttcaaaataagggaactgaatattatttcactagcaataaaatggtgcaatggctagtatatatatatagacgaacaaattaggttgtgtcccatcctaatggctgatttattgtcacaaaatgttggagttacatattttatttggagttcatcaagtacaatttcaaccatgataactcacaaaccctttgtccatggatcagaattttgcccctgcactcaaccttgcaactatatttttctttttttgcttctccatgtgaccaaactaccattcaagaacatgcaataccatgaggtggacctttttttatcaatagtggatcctacgtaatctgcatttgtgcacacctccatggacaactttcccacttgtatgattaataggccactcttgaactattcttcaaatactatagaatttcattcattctctataaatgtttctcatgaagatccatagttatcaatcatgtatagcgacatgtagtgcttgtttgctgtgtgtatggcaaatcatttgtctgtgcaaagaatgaaagcaatttgttaatcctgctatatatcagaatgatgttttcttattattcctcttctgccatatatatagaatttgcaaaagaatagtcttgttattgaattatttgtctgatttccattctcgcagatcattgaagggagatctaagcttccaattgcgtctttcaaggattcaattacatcaactgttgaatctcaccaggttaatttaaaattgactttggatatgcatctacttggtagcttgggtgctgatggttgcacatgcactataatttagcttatatgattcacattgatatgctaaatatatcaaataacatggttgagtaagattttagttttagtgcatttcaacatgacaattaaattgaatttgcagattaaatttttgcatgtgttttggtcttaatatttctttcacgtgtttcaaagcaggttgttctcatatctggtgagactggttgtggaaagactacgcaggttacgaattctttgttttgtctttattatggtgcagctacatttacatataatttgtttgtgactgtttcaagatgatcattattaggttgtatgttgatatttttataattggtccatttagtatgtatgcttgtgatatgactctgcacccgtatttaatttttgtattaatgcacttgctctttttacccttaatataaaataattgactcaagctttgatgattgtggacactgataattttttgatgctttgtgattttgggtttcacccatctgtattttcatcattgtatatggaccaaggtcttttagtaatctttctatgctgcaaaacatttatctttctcttttttttaattgtcctgtttaactttatattaaacatgattcaggtcccacaatttattttggatcatatgtggggtaagggagaggtatgtaaaatactttgcactcagcctcggcggatctctgcaacttcaggtgtgtaactctttcggacttgaatttcaatgttccttttttagtcttaattgaaatgtgtttctttcaatgttccttttttagttttaatgtcaatttgtttccttcttccgtttttatgtttagtttccgagagaatcgctagtgagagaggagagactattggagaaaatgtgggatataaggtaattttgtttatgtatctttggtgtagtaatggtactctgatcctttatttgaatttattttgtatagaaatatttatttgaacattgagcattgttatcataatcagactagttttttgcattcgtgtgttacactctcataacacaccatgtttttattgataccgaggaggaaatctataatatatcattagtaatattgcttcaatctacaaatatcttttctattttcccatatcactttctttcttacatagaattatgactttttgcccttcaacattcaatatcctatgttgattatgcaagtcccttcctaagcactggtttccttgcttcttatagtagcatattgctagttttcctagtggtttacatctcatgaacatatgattctgtggcttacattttaaacaaaaaatccagatacggttagaaagcagaggtggaaggcaatcgtcaattgtgctatgtaccactggagtggtattaagggcgcttgtttccaaaggttatcattcgtcaaagatagggcgtgtgaaggatgatatttctggcatcactcacataattatggtacttgtaaattatttttttatctttagctagagcataaactatggtacttaatatttggtaaatactgcttctataccttatttttttgtgttatttggatggttaaaaaattggttatattaggtatgactggtaagttctcagataaagtggttaattgaaaattcaaattgactaggaaaatctgttagaatccgagacattattttttgaaattgttgtaaaattaggagctgtttggtttcagaaaatattttttgttttttacttttaattacaaaattggcacttgttttactttgtttcctattttcaaaagtttgtataggaatctgtgaaaacagaaaataataattggttttcagacgggtctctcctgcaataggtatttgtaatactttgaggggaagtatactttgaaactttcatatagattattatcttagacactttgttgtgttaagtgacaagtgaattcaaatgtcttcatatatcccctcttcatgaatcttggcatatgaggcatttcctgcatatactttccttggaaagtatgccttggcattacgaagcatatcctgtgcatcctttcctcggaaactatgcattgcaaactaaggtgacattcattttttgttcaggatgaaattcatgaaagggatcgatactcagacttcatgttggcaatcatcaggtataccattgaaaggaacctattggcctttactctatagtgtggtatagttaaatacaaatgtataagtgcttgttgcataagtgaggagaacattgtgctgtaggttaagcttgttcgagatattttgcacctattagctttttgggtagagttgagtcgttccttgatgagtgcaaatgccttttttttaaccacaagtatgtggcaataacttcctgttatatttaatcctccctcccaaagaagaaagattatacataagattactggcataagaggtttgtctggtttttggactaatatctctaatttttggtaatttatatgcagagacatgctccctttatatcctcacctacgtctggtcagttcaaacttattacttatatctttttgtctctatttctctgtctcctgttaagtgcttatttaatttataattatgttatttcccatttttaaccttctggtgctctaatattacagatattaatgagtgctaccattgatgctgctagattttctcaatactttgggggctgtccaatcatctgtgttccgggcttcacttatccggtacctatatagtcgtagattgtaaattaaccaatactttgtcacatgttacttactacaattgtctatccaacctttcttcaggtcaaaactttctatttggaggatgttctttctattgtaaaatccaggcatgataatcatcttgatagtaccacatttagtattccaaaaaacacttgtgagctaagagaagaagagaagctttccattgatgaagctattagtttggcttggtctaatgatcagtgggacctgctgttagaattggtttcttcggaaggaaccccagaactatttaattaccaacattctttaactggtcttactccgttaatggtgtttgctggaaaaggtagagtgggtgatatgtgcatgctcttatcttgtggggcagattgctgtttaagggacaaagatggaatgactgcattggagatcactgaaagggaaaaccaaccagaagcagccgaaatattgaagaagcacatgtataatgatttttccaactccatggaagagaagaagttacttgataaatacctggcaacagtcaaccctgaacttgttgatgatgttttgatagagcagctgataagaaaaatatgtattgattcaacagatggagggatccttgtttttcttccaggctgggatgatataaatagaacacgtgagagattgcttgcatcatcttttttcaagaattcctcaatgtttatgctcatatctctgcattcaatggttccaagcatggaacaaaagaaggtttttaggcgcccacctcatggttgtcgcaaaattgtactatcaaccaatattgctgaaacagccatcaccattgatgatatagtgtatgtcatagacaccggacgaatgaaggaaaaaagttacgatgcttataacaatgtgtcaactcttcagtcatcttggatttcaaaagcaagtgctaagcagcgagagggacgtgctggccgttgtcaacctggaatatgctatcatctatattcaagaactcgagcagcttccttgccagattttcagattccggaaattaggagaatgcctattgaggagctttgtctgcaggtattcgatcttccctgattggtgactcagactcttggtgctttttatatactcagtgttaaaatagtaaaaaggttctctggtatcccattagagtgtcaatattaaaagttagaaaatggcagaagttagtaactttgcaatgctatattcaaacttataatttttcatgatctaatttgtgcgatgctgtgtaatgtggttggttattggtttgtgcaaaggaaacaactttcttgtcaggttttgggaagagcaaaggtccttgtgggggattacaagcagggtttcaatggactgattctatatgataatgaaacaagacaataattttcccctcatgttagatttggttcttactctctctcttgtgacaggtaaagttgcatgatccaagttgcaaagtagaagaatttctacgcaagacattagatcctccagattttgagtccatacgcaatgcaattatagttcttcaagatattggggcattttcaaatgatgaaaaactcacccaactaggggagaagcttggttcacttcctgttcacccattaatatgcaggatgcttttttttgctatattgatgaactgccttgatccagctttaactcttgcctgcgcatctgattatagagatccatttacacttccaatgttacctgaagaaaagaagagagcttcagctgccaaatatgagcttgcttctttatatgggggttgtagtgatcagtttgccgtattggctgcatttgaatgctggaataatgcaaagaatatgggtctagaagcacggttttgttctcagtattttgtgtcttcaagcaccatgaatatgttatcaggcatgcgcaggcaactccaagcagaactaattcgacttgggtttattcatgaagacgtttcaggttacagtgtgaatacacatgaccctggtgtgctccatgcagttttggtagcaggtttgtatccaagggttgggagatttcttacaaataaaagtggaaatagggttattgttgaaacaacaagtggagataaagttcgcctgcacaatcattccataaattttaagttgtcattcaagaaaaatttagataacactttaattgtgtatgatgagattactcgcggtgatgggggtatgaacctaaggaactgcacagttgttggaccacttccacttttgctgctttcaacagagattgctgttgccctagcagaagaaaataatgagggggatgaggatgatgcaggaggtagtgaagatgaagctggaagtgaagatgggatggagtttgatgctgagtccagtggaggtcgtgaggataagttgatgtcttctcctgatagtatggttaaagtaatcatggaccgttggctttattttcgttcaacagcaattgatgttgctcagatatactgcttgagagagagattatcagcagcgattttatacaaagtaaataaccaaattttacttgtttagtttttcttgtacttttcacttttgtgatttatccatgtcattcctgttatgacacattggtttacatttttaggtaacacatccaaggaatacacttcctcccatcatggcggcatctgtgcatgctatagcttgtattctgtcttgtgatgggtgcattggtgtgccagcaatgttagaaggtgtggacacactaaccagtatggtcaatgcaacaactttaggcaagccagcaacaggtactaggcgttttggtaagagaccaaaaggatcccttgcagagcttttaaatcacgatgggcgccagacctctgggccttattttaaagcataggaagttcaacaagtgggatcaaccccaaacctgatcctgctttctcacgataatggtcgaaacggaaggttgatgattgtatgttcagttttgaaagaagcttatatagaatacaaatcctaacagtgaaagtgaaacttgcgttcagcttatatagagaacaaatcctgacagtgaaaaattcagtcagaagattgcctttttgttccttgtgcaaacaatgccgtctttttcttggtcggcagatgcgtttgtgccacaactttcaggtgtgtgcgcagtgagatgagatgatggattctggacattagttccctcgcttgtacaaccacatagtaaaatctttgtaaattctagtgtgaacgttttaatatgaagagtagaatgtagaatagttaatgaaatcttttatattataaaatcaaaagaggaatgaaatctctgttacaggctttgagttgatcatgatataatatttagagcgtcagcgataaacatgagattgatgagcatctttcttcatgtaacaagtcaagatttttattatggaaaaattgccctgctagtcagcttgacaaacctaaaatctaaatttatatactttccacattggaactttggaaatgtcagtttttgaacaacgtatcgtgttaatgtctccacaaaaaataagcaaatatgaaaatgatggtcaatagcatccctggatatttgatcacagctgttacgtctttcaattagcctcaaaacagagtttgatatccccactgtgttgaggatatccaatcttttcctatgagcactctgcaccaagattataaatcaaacaaggttatatcagcaacaacacagaaagtgatatcagtacactgctaattattaccagaattattatttaaaaaaatgatctgttatatgtggaatgcactgaactgagaattttaagacagaatagtggtaagaattatttcagttaaaacaaaactggagaaagtgatgagttaagatgtctataatggaacagaccaaaatagaataaaaagaacatcagagagacaggaagctgagatatcataccagcaccattacattgtcattttataaatgcccagatgctgaaacctaactatttaggcaattaccatataaattttcaggaaaaaagaaaccattaaagtataaattttatttcttaactcattgaaacactttttaaagacaacaccgcaaggttcataaagtataaagcaatatttcaatgcagtaattctaacaatacaacaaattatataagttgaaatttggaatatttaattattaatattaactgttaattttttttatataatgaatgataaattgtattatttaatagtatagttttttaatttacacaaccatttaatcataaatatttataaattaaattaaaaataatttttgttggattgataacataaaaactttttttacatgatacctgcctagttattaaaaaaaagtaaattttattttttaattattggtcaagtattagtaaaagtaaaaccaattaattgaaaaaaaaaacagatgcatacacattcgtatttaaaagaacataagacaaacaagcaacataaaacaaacaaagatgaatgatcaaaccaacaccaactcccccattggcatgcagtgttcttgaagctgaagaaagttccagaacacaaatcaacgacgtgcttgatatcggtgcaagatgttattgtcttgtttagggttttaaatcgatataaacaaaaatagtttattgccatgaatatcaaaacacgagtcaacaagaagcttaatttacataaaatgaaaccttcttaccccaaacaaaaatagaagacgcggatagtttgaaactattcataaggacctaatactctacctaatcattcctgaataccatatcagttggtgtgaaaaatacttgataagagtgaagagtgcaattttaataatatcatttaggatcactacacatgcgcgactactttatattgttttggtaaactactctaatatatatggaaccatagcttgtggagttatccctctttacgttccctaaactaagggccttgaattaaaagttaattaacattgctggattgaaagcgatgctagaaatctatgcaatgccgaagtacatgtattatagtcaaaacattaattgtttatgatgacccatttatgttagatctcagaccacatgttacccattttccattctaacattcacacgctatatgtcagagaagatggcaataggtatgaaatgactttatcctgtgattatttattcaattttacaatatttttcctatacgtaagaataaaaattatgtattatatttataataattcatatattatgtatcaattaaattatattttcttgatatatttagtgataaatagatgcacttagggttgtacggggacaatttccccccaaaacaacttttattttacttaaacatctttaattaaaaaataatttgctcccataaagaaacataagacaattgtttttaaaatgaaggtaaaaagttataacaaaaaaaaaataaaaataatacattgttaagtgtagaaaatagttcttgagaggcattttaaattcttttgtcacgagattatgtattttgtaaaaaattataatattttttgaaaaattaattattaactatttttttgttttcactaaacaaatcctccgctggatgtactcaatcttgccataaatattcatctaaaatctatgcctacattataaactaaatctttaatttaaagagtaacattttcattcttttaattaaatatttttaataatttcatttttcttttatttggacatacatttcatattactctgatgattagttaaaaattattctctaccccatattaaactactctatacatgaccttcttagtagtcctttactttcaatttattctcttttatcatcatctctattctctaaattaaatatattaatattttaaaaattgtccatagttataaataatcttatatgaaaatttaaatggtatattataaatgaaaatataatttatatatttaaagatatttatttattaatttttatatattaaaattatctcttcattatataatttttaattatatcaaaattatatatcatgtataatacactgattaaagtactactttataaaatattgtaaattccttcaattttttttttgtaaatcgtcactttttaagttgtttttcttttattgtttattagttgaataagaagcactgtgcctctatctttatttaaaaaaaagaaaaaacaaaaaaaagtagttaaaaaaagtagtagtaatggtttttttaggagaaattgtagcagttacatttatgaaaaaataaaaacagttaaatatattaaaggataatttataaataagaaatatgtacatcaaagggataattgtgttgatatatatatatatatatatatatatatatatatatatatattcattctaaagaagtaaatttctcataaataaatttttatgaaataatttgacataaatgattaatgtgttaaaattaaggttgaattatttgaatagtacttgactttgatttttaacaaaaataattattaattatatttttttacattttgatcgaattttgaatggttattttccttgataaattagaagttaagataacaaatttctcataaataggaaaataaaatttctaccccgaagtcctttcaataaataagaagattacttaataaccaatttaagcatattaattgattatattaaattccaattaatgagaagttggatacggctcttaatcttttggataagaaaacaaaattttagatgaggataattcctttgcaaaacttaatgtgtatatccctgaaattgaaactgtagaaacctcatgtagatgactatagatttaattagaaactcgaaagaatatagtattgcatagtttggtttaaaaaaatatttaaagaaatgctgtctcaccgatgtcagtatactcggcataatttttcttgtaaaattgtgattaattagttgatgtaaaattgaaaagataagaaaagtttttatatatttattttaagttttgcaaaattattttcaggagtgtgaacttgaaaatatagcatgatttacaacttttattttatgtccaaaccttcataacatgattttcaaatttttactagctagcaattaattgtaatattaatggttctgcaatttattcacgacagtacaaattaaacgaaatattcatggaactgaagtagtttaatgaggaagttgaaaaatggtagctcatggtagctagggaccgatcgatatcatgaattcgcggaaatggagccataagaaacacaaaatcaaataatggctatcagatttaagaattaagattccatttgactgaacagcaatgaaagtccgtggtagtacataattacatatcaattatcaacattgtcgtttaacaaaattcatagactatctttgttactttctcaaccgaaaacgaaaggagcgacatcattattctattggtccattcgtgttgattgtttagctgattttcgtttggatatgaacttataaaaaccatgatatatattcctagctagaacattaagagtctgttccgtaaagtagaaaaaaaattaattaaaataatttttttgaattaaagtataacctaaaaatataggtttgatcatattttattatttatttcacttcttcattctctttctttgaaatcgagcgaacctgaggaacataagtggtgtgaatgaagaaagcgtattgttgcatgcactatttctaagatttgacgtgcatgggattgttgaactgggaccacctgagtttaatcaaaagggctgttatgttcaaagcatcatgggaatataaaaccacgtgatggtgatctatgacggtccatattatgccatggacggagattcagaggaacgtgtggtcccatatatcgtaaaccttttaaggaaattcttaattgcagttctagattctcttttcatgatgtttgaattttgaggaaagagtagtgttgataagcacggcataacgaagacagagatgggtccaaaagtaggcaccgtcgatctattattgacatgaaattggttggccacagagaattgaagatttaattggaagacatttttcctccctctattaacaactataagttatttataacttcttttttggcaaaatcatttaaaattttattgacaatgtgtagcataatacataattagtgtacatgttttttgtttttgttttgggcggatggtaatcaaacactattaagtataaattaaactctatttttacgaacatattgcattattaaatatcttaattaaaatgttatgtcggtcgatcatgaaacatgacattgacacgacttggccaatcatatagaccacctaacattgggacaacgtaagccgtgaacaacagccatagcctttgtgtttgttttaacactataaattaacatttaatgcatgaattaatattgtgattgtttttcttttcttgtgcatacttttttttggtatgtttgttataaaagtagaaagaaaatgaaaggaagaggaaattcatccatgcaagtttggcagtttagtaatatattgaagaatttgtgatgatacaataggttattccccccttttgattattttgatggagagacaagttaaggaaagcaaggtacgtaattcccacgccaagcagcatcacatatttccatttggggaataaaatgatgtaccttttcatttgagatgtgtttttgtgtattataagtggatgcaaaaaacataaaaaggtacgtgggagaaaaataattatgattaatgtatgtggtatatatgacatatatatctcaatttttagatgctcaaataatattactcttctcgccttttcattgttttttaataaaatcaaacaaaggaggataaaaataatctcttataacatgaatttgtgtctacgaaaataaagcattttttcgaatttctattaattaaatttaaataatgatgtgttttttttaatattatgtggcacgtgttttaaaaaattgatctatattaaatcaaatcaatgtttttttttttgctttaattaactattcaatcaaataaaagttacttttatcattttataattggtacttaacttttttaaacaacattaagtagaataacattttataaatttttaataaaataatatcgtattaattaaaatatattttaagttttttcaaaacttaaaattaaaagaatgtaaatagatgagtcgatactatataaaagttaaaaagaaacttattaaggtttaaatttgaaaaagaaatcttagcataaaagaaaattaatatgaatatcctataattaatttatgttgaaaaataaatacagtactgaattagatttataatatagggacgggttatttttaaatctcattttatcataattaacattgtcttaattcagataataagatctacatatgcttaactttcttattttacataattgatttttgtttttcaactcatgttttgaaaactacaataaagaaatgtgaaaggaacaattgctgtcggtgaatgccaatattttcggatcaataatgctatgaaaagaaacgtattaacgagtttgtacccaccaaaaaaagaaatgaacctaccaaaaaatattaacaaatatttaaagatactaaaatttataaataaataatttttattaaaattatgatagaattacattaaaaatgaccactaggatatgtagttgagacctttttagtttaattttaacagattgttattaatgtacattttttataaattttaaattaattattataaaattaataatttttatttatatgataattcctaattagattgttagtatattatatttaaattcatattttttataaaaaattatttttaactttttaatcaatgctttgaaaatatttagttagtacttttcttctattaaataggaactgtgtgaaacgcgtcattggacgaatctaacaaatatcatctttttaaaacacattccatcttttgtatactgtcaattttaaatggaatgatcgattggagaacaaaagcgattttttttctttgaaaaatagacaaaaagaatttatgtgcaatatacgcttcagcttttaagaatccattatttaattcaatttcttgaaaagtcattggccttggacttttggaggttgctgcagcattcatattgaaatgttgtatataggtgagaccagtcttattattcgcgttgaggttcactatagctatacataattacatatcacatatgtaacagtgtgaagcacagaaaaatgattaaaagcagtgtaagaaaatacaacaaatctgaacttccacgcctgcggtggacacctgaacttcatcaacactttgttgaagctattgaaagtttaggtggaaaacaaagtaagtttaatttccttcatgtaaacaaatatataagatatttataattctagctagggtttatagcaaattatatgtatagtatattaagcatatcccaaaatcagttaatgaaagcatatgttattggatacaaaagtccgtttgatcgaaggaagccagtaatgttgatgatttcgatcaaattctttcattttgatttcttctgatccaaccttagaattgtccttgactccttaactttaatgctttgttgactgacaattttttgcatgtctgagtttcatttctagatttctttgagtttgcttgtttatcttctaattcttattgcataccacaatatctgagaagagaaaaattaacgtgtttgcaatataatttataatagcacatatctatgacatgtatatagcagaaaattattggttcataatatatatccatagatgaagcatacgttcgtttcctctcttctcttctctagccttgtgtgtgtgtttgaaatatcaaatcaaattaaggtgggaaggaaaggaactgtttgtgaattgggatgcttaattaagctgcaaatgtataaatccagcaaaatggttttgcagaggcaactccaaagcgaattttgcagcagatgcgtgtgaaaggattgagaatcgctcacatcaaaagccatcttcaggtatgcatgtaagcatatatatatatatatatatatatatatatatatatatatatatcttactcgtgtggtccaaatcttattattattttttgtgaatggaaactcagcatgatcatctgaggaggaagatttaattaatatacgtatagtagctaatttagcaccaatttctttcatcacttaacagtactagtaaaatagttctaaaacgtgcagagattattatgtaattaaaatatgatttaaatacattttcttttcttttcaatgtagtaatttttttttattgtaaaattatttttgtacttttaatccttataaattatattcattttattttagtccttaaaactctttagatatataacattttgaagaataaaaaagtattatctaaaatgtcatgaagataaaaaataaaacaaacataatcttaaaaattaaaaattaaaaaataattttataaaactaaaactaaaaaatactaaattataaagattaaaaaatatttaagtcttaaaaatatttctgatatgataataggatagtattgtcatagaaagtccgtatagatttattaattctccgtttttagtcctaaggtcacatctctcttccatctatattaaatgggaaaataaataacaaagacctagctaatacattggtaattagtaattattgcttaaaagcaaaacaacaaagcagatagagccttctttcaaaaagatcataattgatggagaacatgataataagtcactgcacagtgaactatatagtagtatataacaatacaaacatctatatacaattaactatctaggttagttacatatttttttattcataaaaattaaaaacagtaaaaaaattataataatttgtgatcttgtttaattaaccaagaatatttaggtacacatgctccacgaagagggaagatttaaagaaaaagaagatttttgtttcattgagtaacaatatcaaagcagccaaatatgcagctctatacagctgtcaaattaattcaattctctctctcatcttgacaacaatgcaaaaacgcatgcacaatgtgtgttccaatattcaaatcatacttggttttaatcatcatcatcatcatcatcatcatcatcatcatcatcatcatcatcatcatcatcaagaagcaacctagataagctcagagccattaggctggctactcatattttgtggtttttatacagtatcctgttaattattttagaagtaagaaattaagtagatccagagtaaagtcagaaattaaagcagaaatttgttttaagaatatttttttatacccaaatactgagatcaaacacaagaccactgctggggaattataatgttatttacgtgcgtgtgtatatatatatacacacattatttatttcctttcttctattaattaatttttgaattagtatatataattcatgattgagttttcctacatccatccaaagagaaattttgcgttttattagatgtacagaaacaggaaaggacatgccattattgcaccagtggatcagttgctggtaggaaaggcaaacgatttcaaaatatgctctatttctccaaccgaaaggtaacccattactgatttttcaaaggatattgggttaagatgtctttgattagctatggataaaagaactaaaaaaaatatgtatcccattatctgaaaaaaagattgtttctagattcgaattcataatcaacaagttatcaagacataactttatagttacagttgtgtttgattaattatgaatataatcaaaatattttttttaggatttggacaatattttcttattctgaactacttttcaatttttttgtctaatatggtattcaagtctcatggttggatcactatctatttcaacaagcttcattaatgattatgtatatggtctgacactactcaaattttattaattcctttttcttttgttatatatataccggttaagttataataactgttttaggcatgagagaagtatagttagatatctcacaataattaaaaaagtggttaatatacttctcataaaacttaagcaaataatgctccattgattgatggaattagcttttgaaaatgaattaggttatatatactatttttttataacttcagccattataaaaaaatgtcatttgaatatgttacatcatgaagtactacattttactattatcactttatgaatcagttattttatcacatttttatttaccttttgcatactcttttaatatgctcatcaaatcgataggaagctgggaacaacttttaatatttttttaatatatatatatatatatatatatatatatatatatataagaactgctttatgactatgaaattatgtaaacaggattctgaagcgggaagaaactgattatgatctaaaccaggtactattttaaactaatattgatatcacttggcgtctccccaatttgttttgcgacttttcattgatcatcttatgttgtaaaagcatgaaacgcaatgtttcaaattaaaacctatgttcttgtcttgatgacaatttagtaattgaattgatgcttctagtcgctgaaatatctctgcaaaaatatacacatactttaaacttttttttttgtcggtattaaaagttgaatattaaacattcccgcacacataaacacttcgtcacaagtcaatttttttattaattagacttctattattaatggttttataattaaattacacatttttttagcatacgaactctcggaaagaagaaaatgtccatgtagtttatattccatgcgttgcacttacaaaatttcaaattaagaacttagcttacttcaaattaattgttagatggggcaggtggaatggtttttgcttggcacataaaattttagtcccaattaacgtagaaaataaagactaactttaatttatatgttttttttgcaacaaaatgcttttttatatgtttatttgagacataagaaagtaaatattgaatatagcgttttaaatttaacatatcaaagcggaaaatacgctttgtatacaaatattgcatgatctaactaataattacattctttattcttgattaaataaacgaatttgaatacagcgtattaaatttaacatttttattataaagaaaaaaaagaagaagagagaagaatataaatgttcattacatgttattcacagatatattttttgttcaaaatatatatattctggaaccttgcaggaatcagagtcaagtggactcttgcttagtgatgatgtgtcaaatgaagaagaaaattttgctgatctatctttctccttcagcacgcctctaatgtccattatgcaaagtgagaatagcaaagagataatgcgtttttcgtcatcaactgcagctgctaatcattccgttgattctatttctacgccgtcttttgcaaacaattacataaacttagacctaacaatctgaatatgcgtattaattctttttatttacttacacgtgcgtaacactagttttaattacatgttaactttttaggcaaggacttacaattaatagttagttaattagtgtactttattacagtgttaggcttgttaggcgtaataaaaggttctctttctttttccgtaacaataatgatacaagaatttaaaccatgcttattaattaatggaaattaaaatctaacggtgatgatcgatcaagttgagttggagcaactttctacttatgattgatcacttgcatatagtttaatgaaaatatcatattaattatgcatcttttcagattcaatcacattatatgcatctttactgtaaacaactcagcaccatcatgatcatatgaataacctttcacacatgtcttattcttaaagaaaacagcataattcttttctaggagttatcacacgcagattgtggtgaatttcaatcctagacaacacatttgaaattaatgatactttgaccaagtatcaattgtagcaactcctttacctttttaccttatcaataaagcctccgtctgcaattttaattataatttcttttaactaattatccagatctctaaatcaattatatgccttcatggaaggtcatgtgatgagtataatcaccatcaatcataactccgtgcttattattggctagctatagaacaaccaattccacaagcaaaggattttctttttgttgtgctatggggttagaatattagttgataaagtggaacgttgtattctcttgttcaataatttcctaaaatagaatcaagataaacttccatcgatcgatctagctataataacccacatacacatgataatgttattctcattttataaaatatcagaaattgtaaaagcttaaaatcattttgaacagattataaatttgtgataagtacatcttccatggaaaagaaagttaattagttagcaagctggacgaagtccagtcgtctccacactctccagtactttatctggtttgtgattatacttaaacgataaatgttattatctatatatgtatagtcatattggacttgagcatatggtctctacaatttacattgtaaatacatatataatttttaatttagcctataaatataaatataatttttattagacatacaatttttttattaaacttatgatttttatatataaaaaaatactttaattattatatcaaaattaattattacaaaatttattatgtaaacttatacgtgtattaaatatacattaaaaattttaatattatatgtatcaacattaattgatttttagcataattgacctattatgtcagttggttggagtgtcacgttaatcatatgtttgaagcatgtaataaaacaaagatatttttaaaaatgcattgtattggaatgatgtattagtttttgttgagtgtataaagtttttccaaaaaaaaaaaaaggctacatatggtctttgtagcctcttttcaacccaaatctgatatccccaatgttgatcttatatctttgtagagccatagcaaccaaaaactcggttaatagtgatctttgatgatacctcccataccaatgaaaccagttgaaaggcaaagtgattatttttatgtctaacatttcaaaaatattctagcttgtatatatgttggacacgtgcaggaaaaaaaaagggtataacgatcctttggattgcatactgtttgaacttgtctccatttaatcaatgttaaattgttcaaccatacatttataacatgattcaacccatcacatttaactagtaatttcagcgtgtgaatggtacaagataataatcaaaattaatactaaataaatattttttaatatataaattatattttaaatttataataaattatttaaatttaaatttaaatataaattatattacattattgacaatttctaaaaaattaatttaggaatgaaaataaaagaaaatagattgaaaatgataaatagttaagaaattaagtatgcaaataaaaataaaagaaaggaagtttaagataatggagagaaatttttgagtaattatagagataataagtgaaatacacttttttaattgtgtatttttatttataatataaaaataaactatgtaagtcacaacgttataatgctagctatctaaaccactaaggcccgtatattgaaacttaaaaaataaatagtaattttaaaattctgtataaagtagtttatttttaaaatcttgatgtaacattttaaaaaaataattataaaatatattttattgattataattttttgaaaagaaaaactttgacaaacatattaaaattttatataagtaatttcttttcaaattaaaagcaattttttcatgaaaaaaaactgacccatgcagatataaaataaaacttataaaagtatgtaattcataattgaaataattgtttaaatcaggcgtattaactccgaaagccattccttcaaatgaaatttcatttatcaagatacatttcataaaatcaggtgtaaacttcatttaaaaaaaaaacattttattgctccttagaaaaacaatcgaacgtcttcctgctcctaaatcctaattatgctagatattatagttatccattagtcctctataagctaaacttcactcacctttaaaaagtaatcttttttgataaaatcgatggattaggattaaatttttttccttaagagggagaaagaggccaagtgtacttatttggatagttattatccatcaatgcatggtacacttgctagttgctaccacatataatacttcatttcctcggcaaaccagaaattaaataccgtggtgtccatgatcttgttatatatcacatgaagattgaccaaaaattcccgaatcatatgataatttctcctgccaaacaaatggaacgaaatactttaaaattaaactaataaatgtacattaataggaagaaaaaaaaaaaggcagaatgaacatctttgtacaagttcggatccacagggaatccaaacactttcaatggtttctgttctgttacatctttcactacacatcattgacccgtatatcatttttctaaaataatatcactgagcagaattttcactgcctcttcgccaacgtcttccgcaaccctttgataatttttgaaaaccaaatcaagttcataactgatagcgccagcggcacaacaataactaacacttgtccaaacgcgtgcatctgctcaatctgttgaatgaataattgaacaatgacgtgagatcctaagctttataaagtagactttgcttgaccagaaattagaaagaaataaaccatttttaagattcccatgcaagactaaagtctaaaacatttattacaaaatgaagacattacacattctccttgactatgcacgtaaaatgcaacagtcgttattaacaactctcatacctcacaataaaccactccctatccctatcacatccaggtgtatttttaacaatcttctgagatgaatatttcatgactaactagttgacatgatagatctactatgacaacattcgtctaagcaaacaaggagtcaaattgtaaatttattggaacaagttctaccaattcagtcttattatgtagaggtaatgctatgtaagtatatacatgcgtaaatggacagagactaccacactaaggaagagtttggttgtgtggaatggaagggaaggggagaattgagaagaaatatttaaaattaaagtagtgtagaaaaggtgtgggacccacacaaaattttaaaaatttcttcacaatttgaacataaccaaaccaagggaattgctgatccatgcacccaaacacacatacatgcaagttcaaaaagtgatcttgttggcaacaaatacatccaatagaagggcaacaaaacattattagccatcttaaaaggccaaaaattcaatattaagatctgcttgctgcaaagcaccacataccagacaattcttaaattcagtcagtagttattacctggtcaaagtgcaggtagacatggtaacacatgtaaacaaacaaaagtattctggcaacctgcaggaagaccatttcagttagcatgtccaagatggcacggatgagattgctatatacttaatatgatatgcaattcacaatgattccacaaataacaccataaatgagtgacaatatatttcaaactgcaatgacttaacccaccagccaagcaatgaatatcacaaccccattgatgagataagcttttgacttcttcattccagctgcatcaagataccttcacaaacacagtatgtgcattagtaaataaattacatgacatatatagtgcacatttaggtgcaagattaccatctcaagttgatcccaggagttgttgtctcagagatcaggaccatgtatgtgtatagctgaccctccccgctcaacattgaaaacgctactgctactaaagaaagcaaatgatgaatcacctgaatcaatgttaatatgaagtcatgttaaattcatatttacaaccaaatagggtgaaaaaggaaggaaaccaaactcttgccataatcaagtggaatatcttaaaattgattaagagagttcagatgatcaaggttagattggtttaaactatgcaagtcaaaagatatgatccttacatactcatatccaccaagagaaggaaaaaaccaaaatatcatcccaaggtcagcgatgaagtaaccgacagacacctgtcacattaaaaattaaaacataatacaaatttcatgaccagataaaaacaaaaatgtgttgcagctcataatatgatgatcgataaacgtaagatatatactttttgttatcattggatgtatcagtaaaatcaagggaataacaagtccaaatttgttgtaaatcatgactagcaacatatagaagaggtactaaaaggaaattagcagaagatatagatactaagaaaaatgagaagagtgatttagttaatataagatgtcaataatatttgttaacatgctcagacaatatggctacacacacataaagaaatgatgataaattggtaacatttcagtctaacttattcaatctagggtccaaccaatgccaattgcattaatcacacactctggatcaacatatggttcacgctaataaaaaattgtcatttatgtactttaattatcaaatagattacattactctaggaagtatgcaggtctgaagagcaattgcagaacgctttaaagttaaaaaagtggacaatgtaaaacatacgggaatctatttatcttgcttttctttcttaagcaaatctttcagaagaaaaaacaaattatgaaaatcaagcagcaagttaaaggcagctgaaggcaaatagcatttcatcactagtatcctactgatcaagtcttgggtgtttgcattgatcattatacaaaaaaccttcctagtagtggcttcttctaagaaacattcgtaataccttaaatctccatgctggattccattcatggactacaaaagacaatcctctacttcatggaagttaacattacctacttgcttatcgtatatacttactcatcaacaattttcataaaatatttttttcttttaccctggcagcctatgatttcatctaggtctgtcttgctttcataacaaggcatgggtgttctccaaatttaacttccagtatatctagggattcagactcaacttacaatatctccatcataaaaatgtcaaaccatgaaaagcccaccaaaatctccaaaataatcttatgtatattatctcgtactttttggaactccactacatcatggcattcacgacaatatcagaaaatatatatggcaaaaagtcagtgatcaagatgatgctaataatatctaaccccacttggcagagtcatagattaaaataaaaatgaactccatgattcatcccttcattctattggttaggtgactagatttattgacatgtcctccgcagtgaagtgagacaattatttgtgattattcattattgtttatcataatggtgacctgcagagataaatcacaaagaggaagaaaagggaaacaaattgtaaagggtccacatcattcttacccccagagcaaaggtagatgatgaagagcttcgaaatgtaataagttctgacgactggttgtcagaatatagatttgagcaaaacaccaagtacaacgatatagttgttatgaaaatagaatgaattgttgacatagaactgcacaaataataggaaaaaaattgtaaacatattatcttgtcagaaacaaattaagaaacattccaccaaatgaaaacatcccctcaccgattattccactcaacacgttggattctagtgaggctggaatagctcttaaagtgaacagtgctaaaaagctgagtaagatcatagacctggaaaaacaggaaatatttagagataattgtaaaataaaaataataaatagcagtaatcttaaaagctcctaagtcaggtgaaatactttagaaaatagaatgaggataaaatttaatacaacataccatcttgcaagcaaaaataccaccaataatagaagtatatggaatcagagggtctgctaacaaatattccttcacgaacaaattagcccggttctggtaggatttgaatttcatcatttctttagaagctaacattgcaataccaccccttaaatgagaaatcctttgaagattttacaacctttctgcctttacacttgtctcctgttatatgaataaatacaagtttgaagacaagatattcaaaaactaaaagccaaagatgaatccttatttggtttctctatgacaatgacttatgagttaaggataacaataattatcaaagaagttacattaattgagggaaagagacttaacatattaagtatatgtctattgtgtgccaaagagacaaggacatcagataattaatcaaaactttcttatggagaagccagaatgttcatatataaggaaagaagaaatacaaggaatttggaggatagggtatcctccttgcagaaaaggatagtccacatcctaaattaaatagatctgctaatatttctcattcaaagcaatcttatgccaaatcatctctaaaaaggtaagaacatccaacagaaaattcaaatattcagcatccaacaaagacaccaaaaagtttgttcgcatacaagtcgaattgccataacactcttcctctttactccatccaaaacctctgaaatcaattaacaagacaagaaatgcttcatatcctgtgcacatacatacccaagtttcacccaaaggtcgattccaacttccaaatgttgctatccagcaatgttaataacaactaacaacactaccgcagatccaccaaccaaaccaacatatgctaaattcaattattaatacttacagggaataaattatcaatccgtagagggtaagagaaaaatgatataccaattcgctttagacctaaatatcagtaataaaaaatttatccattaatatcaagcctaaccagttaccactccagaaaatcaaataagttactactaagattaatgtgaagctgacaaaagacagtaaaaaataataaaaaaatgggggaaaatcttaaatcatttaagaattgaagttcaccaaatgcaattcaaatagggctctaattttccacaccaaaccagcacccaaccaagttcatataatcgcaaccacttgacttgatcaagtgggattgaaatccttgcggatcttcaaagcaccaactatttgtacttctcccacacagagaactcattggcgtaagttcagggacagcaacaaacaaaaaaattacaccaaacttcaagagtaaaatctcttcacgaactaaaaaaaaaaaaaaaaaatacgaatcgttaaagctttagcagcagtcgagacaaaaaggaaggaagtgaagtaccgaggaagggcgaataggcgtgagtttggcgaagggaagaatgcgatcggttgggtggtgagtgcgtttgtaaggaaatttggagttgaaagtggtgaaggtggtgggatcatgctgcatgagttatgttgattgaagaaatgggaaggggaaatttgaacactgaaaaccctaacatgtttggattggattgggattgggattggaagaggtgaggctaaggaggaagatggcagataggaagaaatatggttggcaccccgcgtcttttatacactttctcaattcttcttcctttttttttttttttaaaataaataaaaaatgaaaaagaaaaatagttccactcccactcgtagctaactcagtattcaatcgctttcatcaatcattttcaattattacgtgtcaaatatggagtagatcttttttaaattaaattaaatctatctcatttattgtgttgggtactgggttccaatttcatgtttctagcttgtgtttatcggtgttgtataaaatttagtcacttatcaggaatttaattaacttaataaaataaaatgcatgaattatattataattttttttactactctttattattcttacagataaaaaaattacaaataattattaatataacttttaaataaaagttcactaaaatgatgatgaataattactttatgttagtgtataatttattttttcttctagtaatttttaacgaataaaaatgtttttgaaattctgaaaattcgataattggctgattatttatttaatgaagaaaatgttaaatttttttatatttttgaggtgttaaatacatttattttttaatgaaatgttgggataattaacaagaagatactgtgtacactgtacaacattagtcttatttataatagggatggtttggagatattttcaatttaaaattaaaattaaaaatggcagattcggtttaaagatttttcaagtttagtatcaacttaaattaagaagtcagttctcaattttgcgagcttaggttctttgattaattgaataaacagacaactactgatatgttttcaggtactataagaattatttatagacgaaaactttcaatttaataaggctaactacttaattcaatttcatttaatgtatttaatgttctcctaaaaaaattcattttgcacattttttttggcatttataaaacgttgtttatatggcattttatcatgaactaacaaatgctaacatgcccaagtaaagcattggttgggtgaattcagagtatttccagttccagcataaagttaataactaataatttaagatattggaatttatttaaaatattaacaagagttagtaattaatcttttaagatactagatttattaaaaattgaattgtttcaatagatctttttttattgcttgagagatgtcttttatacacacaaacatggaattcttaaacatatacctaaggaacatgattatatgtcaactatgtcatatgtaaataaaaaaaacattgattattaggtaaacaaaagcataaaacattttattaaaaaatatttattttaattaaaaaataaaattattttattattttacttgtagtgacttagcaagtaaaatttcaaatctattcctttataatacatttttcacaaatataaaatcaatttaaaatttgaagcatttatttacgtataaagataatatcactattcagtaaccgttgttgaacttgaaagtgagatatgtgtgattgaaactaaaaaacgagagttatgctgcattggttaagggggtgttgagtgtttgagtgcagaaaactcttggaagttgcggaaaatggggaaatctgttgttggaagaaaacgagggttgtgaggggacaagagttaatttcatgcttcctaggtcacaaaacgtcgtgctcaagcaaggtatgtgctatatacaatataaatcgattaccttatcatgacaattgccttatcatgtgaaccaaggaataatgatgttcatggtaattaagactacatgtcgtaaaaaaaaacccgctcatgtcacgctttttattattattattattattattattattattattattattattattattattattactactattattatgtgtacacaaagttttcatgaatcaagttaatttcacgttgaaattgtaaagtcaccattctgtatatatgtgataaaaatgaaagtttcaaatctgcacttagacttagtggaaaaaattggtgttataaacaacagtctgtgatactagcatccaaatcattagtgtacataaccaacattaattaaacaaggttttttcctatttggaacttggggagcatatagtcttatatgttcctcttaatgatatatgaaggatgagtattagagaaaaaatagttttagatcattcatttatttttatttttatttttctatcacatcataaatcttataatatttatattttttttctttccagatgtcttatagcatagtatcaatgaaacatttttctttactatataacaacagatctaatacagataacattcccattaataattaataactaataataataaagataaaactgacacaaggtacatagtccatagaaataaaacgtctaaacctaaattgaaacaataacttattcaatgattcttcattagtcaaggcagagagaacatataaggtattgtttcaatttggtagcatagctaaatagtaaggtaaacttgaacatcataattatataccagaagtgcttaattaaatgctaacacaatgcaatgaaatttgatttgatggaaatatactccagttattggtcccctccacatgctttagcaagcaacagagtatgcttgcaaacaacaacttcgaacattgaaaaagagatttcttgagatcagttccacttcttgcaggcctctaatctggattccccacatagctctcttttcaaattgataagcacatggataacaaagacaaaagatgcatctccttagccaatttgacattttcctcaaattttgaatttttcttaaatgggaacccagatggaagctggaggcactaggcacaccaaagtctctcaaaacattaatgttaggggccaaattatctataacattaccatcacattaacaattttgactttaacaaagtaagagacaatggcatatttcgaagtttaaactttagaatacaaatacttcccccaacaacagactaaacagcacaagtaggtattcatcactctgcattctattagctgtctgccttataccaacaaaacaaaaattatgatttatctatggcatcagataaaatattgtgctatagcacaaaaaagaaactgtattatatcaacctacactagtatagtacacgtgctttaacacgtcatgtttgttgttatgaacatttgaaaaacactcatatatacttaaagttatatactaatccaacagcaaaagtggtggtggataattgaaatattagaagcaacaaattataaccgtgaaaaaataatcaatgtagcatcaacacaaatatatccaacatacacttaatcgaaggctcactacatgaataataaaataggaagaatgctatgggaataagtttcatatataccaaaaaatgctacaactaattgattaattgaatgtgtaaatattactcataaaaataatgactagtatattacacacataaagtgtacaagtcctgcaaacaataaaataaatatatattaaattccaattacatatattttcaaacaagagtaaatattaatgaacttattttgtgtaatcattgtgtttataaacataaagttttactaacaaaacctttgaattcatcatttttattcaatatatgaagtttataaaaatcatgaaaattaaaaactgatcaacattttattaaaattttacttttatgtataatattttgaaaataaatattaaatatgaaattatattgatataagtgtttcattttttaaaatttaatatatattttcatcaaaacaatatcctgcaatttaactattaaattcacatttgtttgaaaaaactattatgtttagtaaaattctgttttaaacacctatcacatacttcatctagtactcgttattagaaggttcaaattaaaaaatatagcttcattttttttataaggtgcaatctgaaatttttggtgaattaattatttttttacaaaaatatcttctattaaagtccgttctaaaacgacatggtatggagagaaacacaattcattaatgtgtgttagttttgttcaaaagaataattgtatgagaaaagatagtattttaagacaaatttaacgctcttatataggtaatttaatcaaattacttaatctgataaattggttatttgaactttataataatgacagaagcattaagaaaataagaaagtgaaataagttgaatttttttgcataatataaaacaaattatacaattatattttataaagaaaatattttacttagtttctttcaaagatggaatgcataaattaattttaaaagagaaaacttgatttattttataaatatttaagagagatgttcactttaggaattaggaggttaaatagtaattatattaaagggagatgctaatcagtattattaagataatagttaaagaaaagaaagattttttattgacatacgtaaaattatattaatcataatttttttacacttgtatatgatttttataataaatatcttattcatttagttatttgatgaatttgttatggacaataattattagaagtatacttagcaagtgaatcccttgtgaatgaggaaaaaatcagaaattctagaacattaccagcagtgatgagaatagaaggataagcatccaaatatcgaattggtgtgtggtgtgtggtgtgtggtgtggtgcggctctttgaaggaagaaaatggcaaaattagagtcagcagtgataatagcgatggcagcggaaaaagcacgttgccaaagtccattgcctcatctcttcgaatccctcgacagagcttttgaataaaagttataagtgattttgggaatttttttattaaaaatataaaattttttcaatagataaatcttcaaaagcacttctactctaaactcacccgcctcactcctcaacgatctctcatacgacgccatctgccaaatcgcctccacgcagctccgcctcggcctcagcgccctcctcgactctccgctcctccgtacaagccggggacgtgggaggaactggagaagcttctggaagggtacggagggtgtacggagtacgacgttggtgacgtgccaaagctcgtcgtggatacaaccgccattgtccccttggaagagacgtgttccgctgcgttggagtttatcttcgctcacgctgctaagccaactgcgatttagccacgtggcttttcatcgttcgttctgataatatcttctttcttctaagatcgctggtagcataaataggataggattgtaaacattataaaaaaaaaaactattgaaattctacttgttaaatatatactccgttttagtatttgtttatttaattaaaaacaaaaatagcttttaatctctacaaagatatctattatctaataatcacttggttcttataaacaaaaggattttgtaaactatttgataggaaagaagcaaaaagataaaaaaagaaccttattttctcttccttaaaaagataaatattcgtaataaagaaagtaaatataaaagtaaaaaaaaaaatagttttcatttttttcctcatttctctctcccaaccaaaatggacagattactataacagtgaatttcacattctttttattcatcctttcccaccctcaataccaaacaaaagaacaattgaaattaatgtcttctttcatcatactcgtatttgtttcgctggttctcacttgtatcaaacaaataataataagattgaacctaatctttatgcatctattccaatttctaccattaacttaactgtttatttatatgtgatgaatttataagaactcatatatatactacgtattttaaaaccttaactattcattcaaggaataaagtattaagatttttaagttatcaaaatattaaatgttcttttaattgtttcaaatgataattaagaaaacttcaggatgatgcaccatttcttttttatttttcagaaaaatctataccaaccaccttagtggcatgaaatgtgacagcagcgacaggaaatttaatgaaaaataaataagtactttatgctttacataaatggttataaacgttggagaggtataaaaaatgaacaaaacaatatacataaaaatcgaaatttagaaattatctcaattttaagaaccaagaattgagttcaagccttcaaggattctccaacatgtgtgtgtatatatatgtttgacatatgtttagattttgtacgatcaataatgattaaatattgtaaaaaaaaaaaaaaaaaaaagcaaatgtgaaaactgaaaccaccccctcctagaatttgatacccctaaattccaatcgaacaacgatgctatctgcacgtaattaaatgtgctccttgtgttggagaatctgcaatttttcaatattcctttttgaaattgttattagcaatttagcacgttcattttaggatgttctggaacgtagaactgcactgaaaatctgaaatccttatccaaaacaaacaaatttacgttggaccaacttgctttcagaaagctgatgatacctacattactgtactctgtagcagtaactaaagtttttactatccctttagcagagcgaattcctattttggccaatacaaatatttcaatattctatcgcatctttttttccaaactttgtttctataatttcacactctcataactcggaatatagcaccatttgccgaaaagagaaaaagataaatgcggttaatgtgcatcctaatcctttgcgttttgtataagttacagttgcaatgcattaggaaattggtataaaaaaaaaaaaaaaactatcacacaattttcatcttattaaaaacagcaccttgaacatcacaaaatttaaatgcagcttaataaataattagacggtcaacattcaaaatccaactcatttaaattttaatgtaaaatagaatatttaagtgttgttttcaattaaatttttattataaataaaattttcattaaatataattataaattattgagataaaagttcgatttgaaaaataaattaacacatacaaacataaattattaaaataaaactccaattttaataataaaaaataacacaaaaatacacttgacatataaatttgtcgttttgaatatgaattaaatgaacaaacaaagatgtgcgagagattaagtgattcacgaatgtaataactttttatgcttaaattccctaactactttttcctcctccaatcacatgttttgtatatgcattaataattgtgctgaaacatgaaaactagggacatggtcacaatatttattaaattttgggtcatgctaacaaaacgagaaatttgagagcgaataagaaaaagagaaaaagacagaacaatattcaacgtgtagtttgcgttttctttctcttcaagaacacagggagtctcggttaccgagcatcatctctctgtgttttcccatatcttctctttccagtcgttggtcaacctttgttcattggttctctttctctttccatttcaagtcttcgcttctttggttcaaaggacttgagcattattgatgttaaactagccatcttcttcagtttcttcttcttcttcttcttcttcttcttcttcttcttcagcgttttgaagcctcttccaagagtctcttactcaagattcgcccctggttcattctctcaagctgctgttgagttcatcttccctcttaagtcttaactcaaagggtaacaccctgtatgtaatatttattctgcttttgctcttaacatctttcccatgtcagttaagttctaaaagttcaaacttttttgctctcatgcctcaatttatttgatggatcatccccagatgaaaattcatatcagtttttgcttctgggaatctgagttttgttgcttgacttgcaagtgactttggtcttgtggttggcgaaacagtgacctttctcaattttgcttatttaatttgagcttagtttgtttggttatagattgtgttagctagcttttcaattgagatgggtacttaaaggggtttaatttcttcttttgcttctaaatttagtcaaacagtgctttgactcaattggaatctcgtatatttggggtcatggataactcatatgattcatcatcatccttgagtttcgtatcatctcacctgtcacatggttctagtaatcacaacgtgtcttccaccaccagcaatgagcatggggcaaatattgaaattttgagtctgaataagctcagtggaagccttgagaagctattgattgaggctgactatggttatagtgatgctgagattcttgttgaggacatccctgtgggtatacatcgctgtatattggcgtcgcgtagtccgttttttcatgagctttttaagaaagggactgatggatcagggaaggaaggaaagccaaggtatctcatgtcagatttggtgccttatggcacagttggatatgaagctttccaagtgttcttgtactatctgtatactggaaggctaaaggcttcaccaacagaagagacaacatgtgttgatgaaacatgtatccatgtagcatgccgccctgctatcaattatgccttagagctgatgtatgcttctgccacttttcagatgaaggagctggtattactttttcaggtattttggttgtcatttttagttcttcttcctttatcttattactaatttttgcgtgaaagagaagaaatgtgacaaattcagagcaattctacaaaatcattctgggctgaataacatagaaatactaccggttaaagcttttttttttttatcagcaaatatttgttgttagaatgctagctttattagtagaggggatcgaacctgtgacctttcctccacttcccttctcccttaaccattcaacccaccttatatctccgtcctacccattaaagtatcccaatgtttacctaagactaaaagcagataaacattgtacatttggcaagttttggaaattgtttccaacttacatgtgtgtctttctgaatttgttcaacactttatgtgcctagtgaacaaattttgaaatagatgtacacctagcctaactgcacacacatatgcacacttgtgactacattatgtacctttgtccactaagctcttctgattttccactgctgcttttaacttctaacatatatcttgaggatgatatttagatcctatattacagtctctgttacttctatgtttctctattattaccaaaaaaaaaaaaaaaaagacagacatcttttgcttaacaaatctaatgtaaatatctctttactgatgcagcggcatctcctaaattttgttgagaaggctgttgtggaagatgtcattcctattcttatggctgctttcaactgccaactagaccagcttctctctcagtgcattcagagagtagcaaggtctgactttgacaacatatctttggaaaaagagctccctcatgaagttgtgactgaaatcaaatcactccgactcccatttcagccagaatccacacctaatgcaatggaagtggagtccttgaatgaaaagaatatcaggagaatccacaaggcattggactctgatgatgttgagctactgaagcttcttctaaatgagtctagtgtcactctagatgatgcatatgccctgcactatgcttgtgcctatagcgattctaaggttattcaagaagttcttagtctaggcatggctgatattcttcgtagaaattcccgaggatacacagttcttcatgtggctgcaaggcgaaaggatccatccattttggtagcactactgaataaaggggcacgtgcatcagataccactccagatggacaaaccgctcttgcaatttgtcagaggttgacaagatgcaaggattatcatgagaaaacagtgcagtgtaaggaatctaacaaggacaggctctgtgttgatgtcctggagagggagatgagaagaaattctatgattgtgaatatgtctgtttcatcacagttaacagctgatgatttgcacatgagactggattaccttgaagatagaggtagggctttctcttgtctaggtcgctttgtttctatgaatattgggttttggaccttttagttgagttggaaagttgaaagggtaaaatccagaatattattttccattgttcagaaaaatacatagattgatacaaatatataaactctaatgaaactattccaaatcgggaataaatctgtgcacaatcaaatcctcctaattacagtagtaatggtaacttattaattacaaatgcatagttaataccagtaagctgttattttactttaggaatatgcatgcatcataaccacaacaaaactatatttgcatgatgcttttaaatttggaagcctatggacatgaaattaacatgctccatatgttgcagttacatttgctcggctgttgtttcctgctgaggctagggtagccattgagaatgctgaagcagattcatcatcgctgtacgcatattcatcggctttgaagggcaaaaatggcaacccgaaagaagtagatctaaatgaatctccctctgctcgaaccaaaaaactccagttaagattgcatgcccttatgaaaacaggtatgtccaagacaattttgaaatagcatccttgtagaggttatgcatctgtggaatgtggatatgatttattctattaacaccaagtctagcttgcttgtatgttgccttggttggaacatgccacaattgtgaaaatctcagaattacatgatgcatgccaacaaaaaagtaaaaataaaactttccacttacacagatggagtgtagtaactactaattaacaaagaaactttttatcacttgtatataagcaaagtttatttaaaaacacagtgcaagggatactctaactcatgtacaagagtgttataagaccaaatcagagggataagagacaagttataggattagtacaccaatcagaaaaggagcattgaacactacttattttttccttaaagcatgtctacgatccaaccttaatcaattctagatttctagtgtgctagtgaagttaaaaggaacaccctgaaacaaaatattgtttctcataatctaagtagaccatatcatagcgtaccaaataagatatcaaatggaacttaaaactttccttcttatgatagagctaaccatgcatttgtagtactttacagcttaacacaaatggaaatgaatttaatgcaacttgcaattgtagaggaaaagaatgatggtggtttaatgttgttattaaaattctgagaatgctttttgaattatgtacagttgagaatggtaggcgcttctttccccattgctctgaagtgcttgataagtttctggaagatgacgaaatgccagatgttttcttccttgagaagggaagtgaagacgagcagagaatcaagaaagcacgcttcatggagcttaaagatgatgtgcagaaggcatttcacaaggatatggctgaaaataaccattcttgtttttcatctgcggtgtcttcctcatcttcctcaactcgtagggaaggtcttaaccatagagtaaggagaaaatgaagtccatgttcttctatgtagagtgttgcaacttgcaagtagaagctgtggaatatttagaaaaaataagatggaatgttaaattaggggttttttctaatgaacatgggagatttttactagcttgatttagtttcttatagttgttgtaccaagagaagaagaaaaagaaaagacgaattggcttctagtaatatctttgttccttttcgaagacccaaaagtgtgtattttttacattgttatctgattatagattgttatataattgaaatttttacctcctctaataattactttaaagatcatatgcaagacactttgaaagtcatttttaattgattatccttgctaaattgtatatatatccattgtacaccgaaataattgtatatattgaaaacataaaaaaactaaactcttgtttcagttgcaacaaggagtaacccttatcttcaacaaagtaatgaaaggtttaatgtggacttattgctaggttgagttttgtttagaatattttttagaattgatatattaatataatataattgggcatctaaaaagactagtgggatgaatatcacctttactgttgaagtcattagttgtaatgaaatgataattgtgatgttacacgaaccaaccaacttaaaaggtgaaattagtttttctttttcttttcaacaataacacgtgagattatgttatcattatcagacatcaagccataaattatttatatattaaaggattgatggattccagcacaactcatggagagtctcaagatttttaatttttttccttattttaatccagagtcagaggatctaaatttcaaagggcaagtcatttctccattttttctttcttttattaatcttttgttcgtatttgttataatacaagtttgaggtgaagtctcacattaggaatgaatgagaagattgaacaccatataattgagaatcaagaaacttgttgatagaaaacccgaaaaaagggtgtcctcttaagcacgccacacacattaactagataatataattgccacttttaacattgattaattaatgagtaaattatatttgcatttttttcatattgcacctggtactcctttctttttatacattacttttaactttttttgttaacgtcgttaactaatatcaattgaaatatttgagcagacgaaattgtccgttagagtaaattacactcgcatctcctatgtttttctcaaattgcacctgatacccttcctttttatacattatttttacctcttttgttagtgtctaaggaaccgaggcagcggtgatggtgaccgaagttacggcaagggacgaggaggtggtggagatggatatggtagtgtcgacgatggctacggtgaaggttgtggctacggtgacagtggtcgttctggcataagtgggtgcgctcggacgccatgtaagtgggcgaggacgacaatgagaagaagagatgatattgtcgtgggagagagaggaggaggagaaggaggtggtggtggtaagtgaagaggggttgttaaacaagaggaagatttgtaaaatccaaaatgtgattttgaggaaggaggtgatggtgttttagacataaattttcattaaaaatcatgtgactagtatgtgtctactttctgttaaattatcaaaaggtgtttaggagagagagagagagtctatgtgtaatgtgagctaaacaattaagagattttttgtagggtgtaaaaaaggaaggatatcgaatgcaattaaaaaaagagaggagataagagtgtaatttactcttaattaatcaccaaataattcttgcaagtttgcaatgtttataaaattaccaagctttttttgttttcccccattgaatgggaccttttacatacaaataaaatataaataggatagaaaaatactaattcaataatagaagagtttttcttagtgagaaaaaaatacatttgtttaaaacttttagtttagaaaagtctcaaaagtaaattgcagaagattgtttttgaggtaacttgtaaatatctaatggcaattaatttgatttaaagattgatttaaaagttaaagaaattcatatattgttttttgagtaattaattaaggatgattaaattctgatttgataagaaagctctaagtcatataccagaaaataaaaataaaaaatgtaactcaaaagtaaaatgttgttaccctttgaagaatgttctctgaaatttataatatacaaatggattaacacatttttccttcttttttttacacattttaaaactgattatatgcttgcaaactgattaaatgaatgggttgctcttcaaccatgctggtaacttgagatgtatacagttctaactcaaaagtatcacacattgtataacggttacctcctaaccatattggtaaacttctgagggcctagaagtgaaaaaccataggcagtaggtagtgacaagagtttctttacttttcctacatatgccctttttgtgaagttattataatcattggcttcaatggaatctaatatttgcctatacaacaacaatgatgcccacacaggccacctgctagctgagttgagctctgcaacccctctctctgcctcatcaaaaaacatcctcgccctctttatttgtcccttcatgaatttccgccatttgtctgtaactcttccgcggaaaatgtcatcatctgaaaggccagcttgtgccaattcatcttgtgggagatatactcttcctcttctagcactataatgatcaagaactagaccaagttagacaaaacataatttgaatgatgtggacaattaaaattaagagtttaactttcatgtatgtacattaaagatttttatattagaaaagtaattcttataaaataaacaatcttttcatatatgataatctatataattaaattctaaaattgaatgttgaggggcattggcttaattgattgtatgaaacaagtgttattttgttgttaatgttgttatttttattcatttcttggaattgtgatgtgagatacccttgagtgacaagaggttcaatgccatttgtttattgtttttggtttaattgcaatgcattgaagtgttcaaagaaccttactcttctccaacatctctaagtatgttggtaagttgatttgcaatgcctagagccaatgcagcattataaatgctctctgttgaagcatttgattctggtgctatccccattactgggacactcataaggcctactgtcccagcaacatagtaacagtaaaggtagagctcatcaaagttattgtatctagacgttctcaggtccatcctcatcccttcgatcatgtccttgaagggctgtttcaaaaagacaatgcaatgtcatttggatcagttttagcacataaaaaagaaggtgaaatctagttttataattttgtttttcgacagaattagtcctctattctgtataagataaccaatttacttctagtctctaatttgaacatgttatatctaaaggataaaacttacatacagttgcataggtgcttttggcattattctttatcccaacttggagtttcactttgataatatgcataataaaagtttacataaatgtcaagtcaacctagattatcaaaggtgaaactcccattttgatagagaacaacatcaaaatcaactaaagaactttttatgtaaggtttgtcctaaaatgatgtaatgcttagatttgggcatgtaaagtacctgaatatcaacagggtactttgagacagtatgtgagagggcagcatcatacatatcatagggtcggccttcaaaaacatcactcaatcgttgctcccacctgtccaaggccccaggggtgatgtgtgaagcatttgggccatccactagctcatcagttcttctgcaccacactgcaatgcgcaatgaataattgtcaattccaaaacaactctcactggagaagctgaagtagcagtgtgtaatataatctaatcacacataccataaattgcccaaattgcttttcggcgctctgcagtcatcaattgtgtgcctagagtatacagttttcaagatgagtcaattcaacaacaaaatatattattaacaaataaaattttaaaatccattaaaaatagtaaaaatattttaatctagctgctaagtacttttctgtacccagcaaaacaaaaggcatatatcatatgaattgaactttgtaattagacttaaggtttaggaacaaaagaaacatttcaattatattaacgttgtggtggaagaggagaaattactagatggtctgagaccatcattgtctcttgtctcccacaatctttacatgacacataattgaattttatgaaatatttgtcataaattaaaaaacttcattatgtgtcatcgtgcaaagattaactgagatcatgaacacataataactttgaaccatttaataattttctggagacatagagacattatttagatatgatgggggaacaaaataagaggactaaaattcatttgaatcagaaaaaaatgaatgagaaaaggctcaaaacaaaagagcagcaagtacctaagtaaaatgtcttggcatactcagcacaaacttcaccacaccgatcataagccgcattcaacagatccacattgttgaaatcagcctcaacgtctttgtccaaatccagagctatgtttgtaccccttttgtgttcttttaccaaagctgcttgcttcagcaccacttcatagaccctctcctctgaggatcttgaagtctcagtagctgccactgcacttgaaaaagcagaagcaccactagcaaaactgattccagaaaacctcttttgtgttctttcaccaccactactactcctgcatgaaaaactcaccaaggagttgatgttctctttgggtccacaactcacccaaagaagaacaccagacatctcaagaacaaggcacaatttttactgctgttggtgcagctccacaagtgaaagtgcacaccaatgaaaagagagggaaagaaattggatgaaaaccttttgagaatgagtgtataattgtgttagcaaaactatgatgaggttttttttcgtttgtgaggctgtcacaaattttagaacctgcccaaagatatagaggaaattgtgaatgtaatcctatagccttaacacatgtcaaaatgtatggacagtgtccttgtaatccttaacgtgatcaacttgtttgtctttagtgcacgatcctcttcactctcagcctctctattttgagcacaattttgtttggttttctttattttattgtagccccagaaaaaaggggcaaccttacattacattttacgtgtgtatgtggtcctatcttttgttttgcttgtgtagttgtagaatggatggcttaaatgcctttgatagtgtttttgtaagcattacttgtatagtttaggtttgtccagattcagagtcataaaacaaagggatcaacatcaattgattaaatagatatgagttattataaattctcatatttatctttcatttttacctataaaaaaaatatattttgaatcgtaattttttttgttgagtctgcattacacatctaaataatttcttagtaggcagacttaattttatttgatatatatattatttttcacgaaaggaaaaaaaaaattgtattttacaataatacattaagtaattttactcgttattttttaattaattggcacactcacttaagtatgagttagaaagtacaaaagggaatcaatgcatccaacactaagaagatttgatccacaaactagataccatgttagatctatatatatatattattatgagggtaaagagacagcaacatatgcatgtaattaatgttatggttcattatcaattcctccgagaattgaaactagctctgtgttttttgacctacgattttttattttttatttaattaatttttttctacaaaattgattaattttggaatgaagtgaaacctgacatgatagaagcaatgctacttgtagattattttatcaatcttttacgtttatagtccaccccgttaactattttgactaaaggcactatctaagtcaaatggttaagaatatatcttattttacccaatccaattaatataacaggcttaacacttcatcccatgcatcacataacaattaagttaaactctaaaatctaaaacgacagccgaagtaagacatacatttgaggattattgatttgaacttttataaaagttaattttaacttatggaagaagtttatctaaacataatctgaatatttgcctcattaattgctgaaaataatgataaactaaaataaccaaaagctgtaaagtctttttagtcatgaaacacgagatgccagaggaatattcgactttcgagcctcaagtttcttccttggggcctcagccacaacctcatgggtatgcgaaaacaaattgaagcacaccaccacgtgcacttcattcgtgtcaacttcatggagctgatctccaaataacttatgaacgttttccattctctatcgtggcagaaattgaaccaaagcttaaactgcctaacaggctttcaaatgtagaatatttaaaatattaattagagcataaagacgaatatgcgtgatgttgttctttcctaccacaattaattaaccttgatgccaattcagatgcataaaatattctacgacgattacgacaagtttggaagttcacacggttggtttcttcttttaataacatcaactcttcaagtaaaaccgaacataaatgctgactatattgcaccttaattaaacatttcaatacaacccgcggaaactcgcaataaaaattaattttgcataaaacatttcattaaacatttctttttctctatcacatgaataattaattattctgtaattacatctattaaaaaagttccacttcactatttgtgtgtgtcaaatatcacccaattagtcattttataatacatcttgaaatgttccttgttaaagataaataattaattcacgtaaggattgtagtcaaagtcaaatatgccaagacttgaaataccctttatataacaatcaaagcaatgcaactgcatgctataataataaataatcaacagaatataagtttcagcatatataactcaaccatgctgccagctatatatagctaattgcagtagtagataagaaatcaaatcgcaagtgggctctttcaagtttttaacttattgtcctcaggagcgtctagattcttggagatggtttcatacgtttccttaatttttttgagtgttaaataactctttctaagcatttatgagggatggaatttagcgtagtttaaaattttgaacgttggcgtcacattgacaacaaattaagttgttcctcttcctccatgtcaaagcttcaaagggatatgctttcatgaacttttagaatcccgaaaggactttgtctttttctctccatttttatggtgaatgtatgtggacaactagctagctgggtgatcaaggaaaggccacgataaccaatcagaaccaagttaatggtgtgagctgttaatattgtcaagcaataaacaataaggaacttagtcagaattttctttttacatgtttcatagagaacccaacgctagctattttacatccgaagaaagaaagaaagaaatagaacagaaagatgtgatagtttcgaggtgttcaaacaataataccctataggctgagaaacccctaagtagacaacatgaatttcggcaaaggatcaggatcggacaagggtgaaagtattttgcttttttaaatcgtagaatggttataaaatttatatatgtaaaaatatatattattagataaaaattaattattataaaatttattatgtaaacttatatatgtattaaatatacattagaaattttaatgttatatataatgatattaattattttttaacataaatgacctgttagttcagttgatttggattgtccaatccgtatgaatcttatagattacgaattcataatgctcttatgaattacaagcttttatttattaaagggtaatatcggaattgtaatgtttagtgcgggatatattgaaaattcgtctggtgtaggaagcaatatgcctagtcctcttgggtcgtgaaatgtgggctgagttgctaacagcgattgtcatccgaataacccactcaacgaccccttattctacccgcagagagatgattgtaattggtagctttcaagtttcagagcttcggatcgagtatacacttttgggtaacgaaatgaaacgatgttgcgtaactgcagttgcacatgcatctattatagttaattagcttaaaagttttgtctacggtaattttatatattcatttattaattctcaactattttttaagtaaaattaattatatttacccatataattaagggatttactaatttacacacttatatttttttaatatgaatatattgacaaactatatcattatcgtattttaatatgtatatatactgcaatggcaaaaattacaagtaaaaataaatactagcgtcacaccaacaccacttgatactatttgtatggataaaattcacactagaaattattttcccttcttacaaatcaacaagttgaatgattgatgaagaacaagcaaaggcaatgacgattaattaaggaggtgatcccaagagaaaggcctaagaatttgaggagccctaacctccatgaaattcaaatgagccttgagaaggtgcatgtaaaccaaccaatcaccattcccattagcacaaggcattggcatgacatagccagaatctccaccccaaggaaaatggtacgatgcaaacacgggcttcccccacccaaagtcaacctttgactccggaaacctttgccctgaagaaacaacaaaacttggtcctttttcttttccatgcccacaataaatccttgacaaaccaggcacaggtcggtgtacttcaacccaatcaacaagccctaaaaaatggtcttctgtcacacccatcttcaaaaactcatgaactttctccgccacccaactcaatggcttttccacaagctcatcaaccgcattcccaccataaggaatcgaaagaacattgccaaaatacgaactcatgttcttttcatcgttgcataacatcttccttccatcaaccacaatacccatcttggcaacaacgtttttcttaccatcaacactagcagttgcttcagcaaccatcttccacaagaatgcagagaaagactggagctttgtgcgcttcacggtaccgtttgagctagctagtgcttgcatgcggttcaggtattcgcttgtgacgtagtatatgcggctgatgagtggctcagatttgaacacgagtttcttattaggatctgacggtggaggtagcgccgagacgggaacgtatatgtggtggagtgaagggtggatggaaggtgggcgtcgtggggtaagaagggaacgtcggaaacatggctgggctgctattatgggcttgttgggccgggttgtttcggcccatgatacgaggaacatgttcgcagagtaggcatcagctatgcgatggtcgaaagtacatgcaactactaaacccccacaattaagctgagttgcctgcaaaactcacatgtcttataagataaataattaataatatgttttccgcgcgtttaagaaccaagattattattttttatttagagcatatttagtgtatgagcaaacaccttcagcttaaaatttcgtctttattagatcttctaataaaaaagataaacaaattttcattatgaagaatgagttgttatagaagaatcatgaaaatgcacaatattcaaagaataattttttatctctttctttcctaagatttcaaaatgagatttaccaatataaaagatgagagaaatcttacatcctaaataacattataggatctacaaaaaaaaatatctaaaatctcaatttgaaatctaccactaaagatgttttaatatttcatttctttaatcctatatataaaactcaattatctaattcattaaattaaaaaaataattaatttaattaatatcaataattttgttttaaatttttaatgttttataaaattatcattatcatttatatttcatttttaattatttttaatatattctttttcttcttttaacgatgaacaaacacagttttaaatttaggtcttataaaaaaatcaaagaagtataaaaataagtttgactaaccagtactcttataatacttgctaaaaaattcaaagaaaaaagattttaatgtaaaattataagaaaatatagaaaaaattaattatgatcactaacataatttttgacatctcaataaaaaaactttattcttttagttttctaacctatgttctaatatactagctaacatatgctggtaaacattttcaaaatataggtttgtttatcaagttgttttatagtgtatcacctgaacagcaagcacgccatgtttcttccttggtacaagcttcccttcaacagtgtcatcaggattgtacaagttgaggcactgtagctcaacatcagctacagcttcaaaaaaatctaccccacggttactgcaaaacagctcaggctcacccatggtgttggccaccatttcaccagcaaaagggtaatagtatactagagcccgagccagtgcatttttcagtgacctcaccatggttccaaagcaataatatttttcaggcaaaggttttttgtagcagaagaatacactcacgtctactgggggaatgagtagatcaaggtttgatagtggcagccattgctctttcattgaaagctctggtaccactacctcctccttggtcacactcacaatgaattttccttctccaaccttaccatccatttttcaggaatattaaaactgtgtagctagctaggcttgttaattcaccatggcagtactacttgattggcttattaatgcacaggctgtaagggtcgcatgaatttactggcagtggcctagagagacatgcgaattgaatgtgccatgtttgatattaatgtcaattttaagcctgatctcataacacaatttgtatcattaattcaaatcacgtttacttgactgaaaaatactatatttccaattgtagtatcttgtacttcccgaacaatatcaaaacgtttgttgtgtgtaaatattactgtatttctgataagaataacattaaatgtcaactggcaaattaagtatggtagttgttggtgaccacccgcatgcttgttacttagttttcaattgagtatgtggttctatatatatccactaaaggtctttcatgatggcagaattggggacctgtgtgatgctatatatcacattaataaattttcactccatagtgttggctattaattaagtgtggcatatattacttcttttacttctggcaggaaaaagtcactggactaataaaaaaagcaatataaaaccgtctaaagctaaagaacattgattgatagtagtatattaccaaaatataaaaatcataaattaaagactaacacctatttgaaaatttttaaccgcgactagttgtcaaaatcccctcaagtttcaaaaagaaacactgaggaagaagtccaatggtatgctactgagcaaggcttttagtaccaaaagctgctattaataaattgttgtgttttgtaacacttcataaggctcatggttttttaggttacaacataacgatatggtttagctttcctttaagtgtatatataaatacaaacaaacaagtataaccaaagtgtgtgcttgtctgcatgaaattgctttaagtgggccagatggagtccaaattattcgatttatctctcttgcgcgcccattgaaacgtgcctcatacaaaaaatggttttctctttaattaattattttcagagattattaaaatgttcacaattttatcttttaacgttcaaattttctcccaatctccactaaatgttaatgctttcattctcagtttttatataccttttatctgatttttttcttcttatcttatcactaatttttgaaagctttttgttcctctctttccttctgtgagaagtctggattgttatatatataaattacttatgcgcttgtcagttctgcgaatcttttaacttttatcattttttttaattattagattctaaacttttttcttctctcaattggttggccgaatgaccaaaaggataattccttttcaaatttatcaaacaaattttgaattaatactcataaaaaattgacaactttttttattgaagtaaaaaaagctgaacaactttagttttttttttttctttttatatgaagttgtaaatttttttattactccaaagtctccaaagttttatgatcttttacgactttcaaattctatttttaaatttttaaattattggtattaataaataatattaacttaaaatttatcaaataatatttgattttttaaatgttttttaattagtttttacatttatcaattaaggaaactaataattttgtagagccacagcttctcctacaacacccacagggacagctgccttcacttcatccgttagtcgtatcgaccggcgaatgatctcatggaggctttccattcctgtcctacataacatgttatattctgtgcttcaacaagtccatccatcattgcatcatagtatatttgcctcgttaattgttgcagctgaggattgtagccttgtttctcatcacttcactaatggccagaggatgaagcttcttctacctcgtcgtccccgggttcttccttcactcctttcagtgcgagatccttatcaggctcaacttaaaacggcatttgaatttgatgttgcccattcgtctaaatcacgaaagctcagctttgcctcaaggagtccgttgataattccaatcatgtacatcctcattgcaactgtgggtagtaccacattccaattgggtgacaatttaacccatttactcctgttttaagctgcacttctggttttaacaatatccagaaaaggaaagctatgtccatctgtcattccatcatatattattcccctcaatatttcttgatgctcagagtgaggatcatagccttgttcctcatcgatcacttccctgatggcctgaggttgaagcttctacaactttcattgtactgattgcatctaggaaaggcgttgtttcgagtacatgtaggaaagatgtcaggagggagtgtttttttattatcctgttcggattccaatttgtccttagcctgcgtagatatctcctttataaatccaattagggaatacaattcctctaaacctttaccctgcaaatcctttcttttttcatactagtccactgattcaatgaacatccgcttaatcatttcgtgtagagataattccactattatctttttccattaattcctgcttaggatctttcataggaactaatgccggtgacaacaacatgtttgaatacttggggtctggacacgtgatttggacatcttccatgttgttcgctccttcgaattcttcatacacaaagactccccaacaacttagcgtcaaggtggacgtggcttcgtatgaaacttgcactacaatccactcgtgctcgagaaacactgcatcaaggctaagccactcctcgtcactgaacaaaactcgtagatcacaaattaagacgtgatctgctgcaactctgaagttgtaatagcctttgtggtgaggaacacatcgagtgccattgataataaggtgcaaatcaacaagttcaggaagagaatactgtctcgctctcgcccttccacttacatcctggaagaccacgaatcctgaaacgcttaaatgagaaagtcgtttgagaaatccaacggttttatgaacagcaattaggtttctacaattatctagtctcagttcccttagattttgaacttcagaaacatcatgcatttcggtgattgattggttatgtgaaaaattcatctgagtcagccatgaaaatctctgccagaaagaaaaggttagtacaatgattagcaacatgtttgggttatactattatttttaaatgtgagtaacaatggaagcttttgttaaatgaaaaaataaaaggaagtagaaagaacaagaaaacattctacacaattgtaccttaaatggctcttccaacgttagatggcttctaggcaaattaaagacaatgatttccttcggatgaaattttgatgggaaagactttgaaggatattcttcccagtcaagcaccctcaaatgatttggcagatgtttaggctcagatgaaaaagatgtgtttcgaacaatgagaattctgagccatttcattttctcaaaagcaaaaccactccaatctacttctgctcgctggggaggatcaagcattatccccttaatcttgtcacttcctttaaaaaaagtacaaacaagtaacgtcaaatgcatgttgtcattattacaatagactataatgtataatttataaaacaaaagatacatgattcttaccaaatcatcagttagtatttcaataacatcaacataatgccatagtccgctacgttggccaggattttttggtgcctccttcctaacaatctctctacccatatcttgtattagatcatgcatcttcaagcagccatactcaatggtgagaagagatttattaacataataccatagtctgctaagtcatttatggatttgtccttttggaccggttttaactgttatttgaccggtttaaggtgtccttgacagactcagttaatatttagcccggaacgtgtcatatgttttttgtctcgtagaggatcgttggctttacaagcgattaagggtaattaatatttaccccagaacaggtagtgaagagaaaagaaaggaaagaaattgtgggttctaatttttcactaaaaaaacataagaagtaaaaaaaaaaaacatataacttttattcaatagcaaaagaaaaatagaaggtaaacaacaggaaagttaagagcatgaccacaaggaatatccaaattaaacacaagcaaacaactgaaaatgaaagaaagcacaaattcaacacattctattaagtttaacactacccactttcttcctcaatccctcactttcattggaatatgctaaaagtacatttggactaacatattcaaagatgatacactaatagctgttttccctgaaactcattcagcaactagattggaactttgtagagctggagaaccttgttccatgatggtctactgctaatgtcatcccaccaggcacccacatgcttcctctccattaataaatactttttgtccatattgttcacaacataatcaagaaatggaaggtggctaatatcagcaatgctgaagaaatccccagccaaatacttggtctttgagagcctctcctcatagatgttcaacacttgcaccagctttgcttcactttcctcaatcaccttgggatctggagtcacaccaaatattgaaccaaacaaaccatgaagacacaagttgtgggcttgtgggtgaaagttgtgtgcttcaacttctagccattgctccacaagacccctctcttctattgtttttcccagcaactcaaccccttgggatctgtatttttctgcataatacctcattatagcacgagattctgtagaaaaacatgaaaacactcaaattaaagggtaccagtaacaaaaactgaaggaacaataatcatagatcaacaaaattggttaacctattaatcatttgatcttttttaattttagttcagaaaactgttgagttttagtccctacacatacaagttaagttttgattctattgctaacacccatgattttaaatagtgttttgcaaccacaattgcgaccgcaatgtcaaacgtatagtttaaaatcgtaatttaaaatcatgctaacaccataaaagaatttctaacgctaaaacgtatagttttcttacaaagactctaaaacttagagagatataaaaagcaagtgaatagtttaaccaacaaactatatataagtagaaaagcagaacaaaggagcacaaagtgtaaccatataaggtataatctccatctttgatgacaggaacaactccaaatggctgcagatattatgaataaagaacatgaatgagaagataaagaattgaagacaaatcatattcaacaaaaaaaaaaaggaaaatagaagagttgaacctgtagtttgaggtagtcaggatccttctgctcccccttatcgacatcaacagggacaacctcaaattcgacttccttctcaaccagacaaaccagcacccgctttgtggaagcacagtggggaccgtatactttcactaccatggtttgattctcttgaaaaatggttcaaaacaagagtgaaatggaagagccacttatatagttatattactcaggtttgatcagcaaatatatattattgtttagttagtgacccaaaacaacttatagctctacatgtcaagtggtcagtgaaagcagcaagcaaattaacaaatatcaagttgatgggtgggatctaatctggggacaccacgttaaacaagagattaatatttaatatttattgtataattttaatcaattaattaatgttatgcgtaaacaactttaactttaactttagttaatagattaataaaaggtaaatggtaatcaatattttaaaaatattggttgaaaaacttaaaataaaaatatttttattaaaaaaaattatgttatttataaatttttttacaattttttacaatttaaataataaatattttttctttaactttaactaatatcttagaaatatttatcaataacatatttgtataaataaatgatatcagaaatgcagcataggagaatcacttttcattagttaatagttattaagtggagaaagaaactcactggttgttgcttctggagagactcttgggtccttatcttttttgggctattagattataagatcatacgtcgtgatcttatttcctcccttgggtcaataattcaggtgcgcttatgttttcaaaatatttggttgtttggtatatgtgtgtgtgtgtgttagtctttgctaataacttacatatgtggtcttaaataagaatggaattgaagtaactcatggtttccacaggttcacgctaaggagttaagttgatccttttgaaaaacagtacattggaacacgaatttgaattatgtaaactccgtatgtacgaaaaggaaaaattatgtaaagaacctaaccaatatatggttattatcaagcctagttgcatttcttatttttcaaggttcacaattatattattttaatttttttatgttctaattgccctaattaagtcctcaactatttttaattctgcaatcaagtctctatcattaatctgctaaatataatatttttgctatattgcctaaacatatatattgatttgacattaaatgatgacgtaatgcttatgttacatgcaaaagtgatgagaaacaaatttagtaatggagatgagattcgaactatcacgccatcaaattgtgacaaccatcaagcactacattagtatgtttgtaacatgtcaatatgtgtatcaacatctatcaatgtgacatcatgctaacttagcatatccatgtcatgttagcaaagtctgttaaacatgtaacgttgatggaggaatttgattgtaaaattgaagataatttagagactcgattaatataattaaaacctgagatattattaaacttgcacaatatatcctaatatctaacaaatcaaaaatataattaaatcttattttaaagtaatagctatcaaaattgctattatagagcttttcagtggtttattattattattattattattattattattattattattattattattattattattattatttgctatattttttaaaattattatcttaagtatttatatttaaatatttatattttgttattaaaccagataacatgtttaaaataaacagcctcttctttttttaggtgaagactcataacatgttaacctcttgtacatagttcaaatctaatggaaagccattgttataactacagtataagacgacactccaactaaaaaaactaatactacatttgttaattaattgggagagtctcatgacttgtgtatataatactacattaaacttttttttttactcggcagagaatcaaagtgatcaatgtctcatgtgaatgagccatttggaaaaacattcgtcatatatattcttattgagtaagaaaaatagagggtaaacagatcgaatgctaagaacatgaccatgaggaatatccaaattccacacaagtacacaactgaaaataaaaaggagatcaaggaagtacaaatcaacacattccattccatgaggttgaacattacccactttcttcctcaattcctaactttctttggaatttggtaaaagttcatttattcttctctaacatatacattcaatgatgatactgttgccattccatataacaacagatactaataattcagtttccatgaagtccattcaaaattagattggagccttgtagagctggagaaccttctttcatgatggtctattgctaatgtcatcccaccatgcactcacatgcttctctcctttatcaaataccctttctcccttttgttcacaacatactcaacaaaaggaaggtggctaatgtcagcaaggctgaagaaatctccagccaaatacttagtatttgacagcctctcatcataaatgttcaacacctgacccagctttgcttcactctccttaatcaccttgggatcttaagtcactccaagcattgtagcaaacaatacatgaagagccaagttgtaggctggtgggtgaaagttgtgtgcttcaacttctaaccactgttccacaacctctcttctactgtcctccccatcaactctaccccttgagacctgtatttttctgaataaaactcattatagcacgagattctgcagaaacacatgaaagcactcaaattagcaggtaccatgtaagagtagaaccaaaattagttgaaccggagaaacaatattaatcattaagcaagaaaatgagttcaaagtgtaaccatataaggtgtaatctccatctttaatgacaggaacgcatccaaagggctgcagatattacgaataaagaacattataatcagaaaatacagaattaatcaaataataatcttgaagactctaatcatattcaacaagaacggaaggaatatagatagatggaagagctgaacctgtaatttgaggaactcaggattcttctgtttccccttaaagatatcaacatggataacctcaaattcgatttccttctcttccagacaaactagcacccgtttgtggaagcacagctgggtccgtacaccttcactaccatggttaatttgtttctcttgaaaaatccttcaacaagagtgaattggaagagccacttattgttgcttagttacacttcttatagtgcctctacatgtgaaatagtcaaacaaagtctacatcaacacaaacaaaactgaggttgatgggtgagatttggggacaccacgtgagaaagagggggatcaatgtttaattgatagggcatgcatgcattcaaaatacgttttcctgcgtgttagtctttctaactcacacatggtcttaaataaaagtggtagtgatcgactattactgactaaattggcaggaaattgatcaaaatgcattcgaaacactttatcattttgtttacaaacgcgctactacttaaacccttgaaaaggtagaacgtgcccagatgacaaaatagggaatgaagagaaattcagtttgataataacaatgtcttcatttcagcttttaattcttgttcttggatcttattttaggacattaattgaattgaaggtatcctctccaactcaagcactgtatcttttagttatataaatttacatgtcaagtgataattcatattatttgagtcactattgtttagtatgctgaattaactcattcactggaaacattatatatatatatatatatatatatatatatatatatataatacaatataatataaagaacttcaaccaagcctttgattaaaaaaaatcagatgggtctcttgaatcaatttttaacatatatatatatatatatatatataaatcaacatataaagtaaaaaatgattatatttttacaaaatttaaaaaaaatgcaactcaaactgaaattaggtaaagatctcttgcagcaccactatttgtgaaagaaatcttgtaattgtaaatgctctaggaaagaataatgatcttctctttattaaaatgggaaacattatagaatgaaccctcaaaagactggccaattgttattttaagtctttcaacataatttaaaaaaaaaaaaatagacactttttcaccaaaaaaataatgtcacctttttagatccacgactaacaaatatcaatttattcacagaatgatcagcagctactcatgagaagaaatcatgaaagaaatctgactggacagatctaagcttcctactgttcttatccaaaaccattcagttctatcactttcctcctgtgaatgaaaattttcctcactgcttacgcagggatgaaactatatatagttctatggtactgcaaaatttgaataatcaactgctgatacaaagcaaccagcatgctgaatgatgtttattcgtacttagtttccagaatattgaattacttctcatataagtgactacaacgggatgggatgaacatatacagatatcaaaatgacaccacagacagcaaatgagtctccgactatagctgagataatgtagtatcactttcttcaatctcatcaaattccactggtttcccacaaacaagcttcctgtaaatcaaatatcaaattataaggacatttataaattcatatattaagaatcaacaagttagaaataaaacaacacaatacagctatttcaaaataaaaacagcaaattccccaacaaaataaaacaaataatttataaaaacagtggattagatgcaactagacatgccgaacaaatgggtattcctcaaccatttggaatgactttttatccttcaaatgtgttaaactcgactgaaatttctatggtcaacaaaaatcaaccattactaacatccagcacattatatatatggaaagcataacatgcaccaactgaaattgtcatttgcaccaaaaaaaaaaaaaactgaaattgtcatttttgtcatggttaacagaaattttacaaagattttttcttctttttgctcctttaatccttcttatcaggtaaaccgatgacaatcaattgttattaactagagatacctttgagatataaaattctcctcacacagtgccttatccagcctctcttcaaatggggttgcatgccattttactttctggtcctagggacaataagcactaatcagaagctgtagatagatttagaaaccttataacaaataatgataatgattacaagccatacctccttgtacttagttgttgaattcgggatgccattgccataccaccacttgaatgacataggcgaatgctcctcgatggttgacacaggacttattctagtagacaaatttgaattgacctcatcgtcattttcatttgaaaatttcttggaccctttttctggggtaggagtttcattttgagctttctcaaccaaatcactcagctcacttgaatcttcttcaaggttaaaatctctctccttgagtattttgcaccagaagacattatcacctggttcgttagttggatagacaaactgggaccgaacttgagccttagccttacgtaactcttctaatgatgcagggtacagagttcctggtgtttgcatctcgtcaaataacttcaatggggtaggataaggagatggtttatgcgcactttggctatttggtgacttgttttccttcatatgccaatcatctgatgagcttccataggttgccaagtcagtttcactttcaaaacgaacagacttgttctttctctgagtatatgtggctagcaaaggtgaaaccaaagctgcattcctttcagacctatctgccgcatgaaggttccctgaccaatttttttccatatagtcaacagagtcatcttcagtatcttgtgctttggagatacagctgcaaaagaaatgaaattaaaatctgatcaggttctagtcctccctccaatataattatcaatggacaattctaagttccaaccaacaatcatacaattaagtaattatctaaaatccaaaatatgaaagaaaggatgcaggaaccatttgaagggcactttttttaaagcagaacgaattgtctgattctatattatagttaaaatgcagttgctataccaaggagctctaactattgagaatgtatctaaagcttactataaaaattgagtaaaaatcgaagattcacctaccatgcaaattgactaaaatatcacttgttcaaattcattatcattcaatatcagcattaacataaaaaaaaaaaaaaaaaaaaaagtcatgaataacctgcttggcgtgtgctcaaatgaatccatgctatttcccaacttttggcaaagatttatgggtgttggtggatcaaatggttggacatccagctgcagtttctccacagacgtgttaggaagccaagaatgaaatcttgaagggtctgaatctttatcaggagcaggtgatttcaacttctcagatgctttacgaatttcaacaggtgttcctgctaaggtcccacaagctttaagaaacttagcctgtagaaagagtttatataaaaaattcaattgacaataacaaaatgaatacaatccataaaaaatgcaagaagaaaaaaaaaaaaaaaaaaaaaaaaattctatgagtaacttgaaagtatttgaaatttgatatataccatggtgcaagtataatcctctaggcattggatacaaaacaggtataacatgaggacacagcagatcatagaaagagtgatagatgactgacttttcacaagccaaaattgaaaaaagctaactaatggtcctaattgtggtcattattcaattgtttccagtatgttttacagaaaaggtttatgaaatcactctattgctttccatattttttctttatactacattcatgaaggttcgtaaaatttacaattcaaaactgtccaagaacaactaagaaacctatactatgtcagtttgcagattccattttgcccaggttaacgccaattcacaagataaaaattgaaccttattttactcaatgccctaactagttcaaacaaaaaatacaaaaattaaaaagaccaaacacctgagaaaaaccattaaaaaaatcatttcagctgcagtaatagtgcaataccaatattaatagcactatgaaaatacctcatccttaagcccctggaaatctccctcaaacccaacaccatcaatcctcgcagaatcatctctctcttctaaaaaggttatatcacaaaattagcgggaaaaataaaaaaagaaaatgtaaaagcgaaaagaaagaaaacgaagaaacaaagaaaagtaccttcagataataaagaagacgagcgatttcgagataccacaacaccctgggtttccacacagcgaaaattctaattactattaaaaatataaataaagtaattcgtgaaaacagcaaagacaaatgcgaaatgttacggtggatcgagtggaggaggtaatcaattgtgatgtgtttgtgcggcgattgtctctgatcctgaagcacgcgaagaagcagcccatcgctttggtgaaggatcggaagaagaaacggatcatgaaccctaacacgctcctcagcatatcagggaattcagaaaccctaacttggaattcaattgagaatcgagagagagagagagagagagagagagagagagagagagagagagagaggtgtgtgtgcgcagtgaggtgccttcgtccctgaagagtcgaatttgaattttgaagtggctcccagcgagggaaattaaattagaattattaataggataaatattcatgatatcttctaacatactaagtcagatattaattcgatgcatgcatgtcgctgacagattgatttttttttcttctaacatatatactaagtcagaaaccttataaaggaagttgaatttttttcttcttcttttataaacgtctaacttttaataaataatgatttttaaaaaattactatttttagtcataaaattaaaactaattattaaataatgataacattaattattatcctaacaacaacaaatatacaattagctttacacaattttatattaattattacaataaaacaacaaacacaactaattttacaaattttatactaattatcttttatatatatatatatatatatatatatatatacattaaatgttccaagggagaagagaggagaaaaggggtcctcgaaatcttgttggtccccctctaacacaagttttctattaaaataaattgttgctccacatttaaatttaaatgtagtgaattatatattattgacttagtatcacttttgatttattatgttttgtagttgttttattctaatatattaagttttgaaaattttattttgatactttaaatttttaaagtatctcattttgatcatttcttttgattttcgttagaaacattaatattatgttaactataaaattttaaaataatttaatatagtgacaactaaaaatcactattatctttattttatttcaaaaatttaaaccacaacaaaagaaaagaggtgaaagtattaaaattaagggtgcaaaagatatatagaaaaaaaaaaaaaaaaccatcaactaacaccctctatgcctctttctcatctttcccaacctcaacgcttcattatccaatctaaatggtcggaaaaaaaaaagactaaaaattttaaactattttgatttgtttaagtcataaatttcatcatatccaattcataactatctctaatttttaggaaaaattatttattataaatttgttatatgaaaaaaatatttatgatgtgattacacaaactcataatttcacttataaaagtgagaaattatttatctttttttaaataacaaaatatttattaaaatcgtgaaagttaccataagttatgacacccaataaaaataaggtttcacataacattaaatgacaaagacctatttaaatattttatgcattaaattataaaaaaacaactttgaccactattccctgatccataagaagattacagtaaaaaatatcctccttcaattccatgctcattaattaatttgttgtagttcaagtattctggtttaacttgttactagatatatgtctttctacaatttagtccacgaaagtttaaagtcactccctttttaatttctaaatgtattttttgtgttaatttaatcctaaatttaatgaaatgacaaaaaagttagtaatttaggactaataagggagtaacttagaacttttgaaaactaaattttacgaatattaaattagtatttttattctatcattgacatattgaattggtaatatttgtttaccattgatatataagtacataatttttattattttcctatagtgttaacaaaatcatataagaaacaatttaagaaaaaaatatcattagagttttgttaaataataataatttaaataaaccaatccatttgtcataaaagaattttatttggtcttccttattttttctcatttaagaattttcaaattagtaaccttaatttcttcattcaaaatttcaaaaatcgtgtctaaaactgaggaaaacatcatagatgaaacattttccacctgctctatccaatgccattgaagaatgaaagaatatttgagcatttagaaccctcatagaaatagttactggaaacacatgcttcaacatgaagaaaggttgcaggcttagattagaggtcagctttgactgaattatgtaacttgccgggagagcatatgagtgccaccacagggtatgtaacaacaattcctttcatatttttacttttactttttcttttgccctttggctgtggactttttaaaacatttccttggttgtaaaacgatttcttatttttattaattttttgaatatactgtattttaatttaatgattttttgctgtcaaaaaaaaattaattcagattttaggattaatatttttaatatatagataaataaagaatagcttgcaattcactaattgagtagataaaatatcagaaaacaaaaaaaattttgggactccgaagcttaaatcgcatttttgaggcacttagaggcctcgtttgggaaaaaattttgggcaagtttccttcgggaacttgctagcggcttctcctctcaatttcgagcgtgtggccaccggtttcgcgtcaatcggacgtcccagtcaaaagttatcgccttccgtaattttacgaaaacaccgcgaaaaccctgcacccccatttttccctaccacgtggcgccaccagggcaaacacgccccaaatgggcgtgtttggctgcaccattttgctaattattggaaaaattatccccttttcctaattaaataattaatttgtattatttttaaaaatcagcctaaaatactttgcttggatagtgtattcagaaataattgaacattctaatattttgtacggacgaccatcacagaaatataatatcttaacattcgtggcattcagaaaattatggtgtttgttaaacttggagcaaataataggagtgatctaattggtattacaaattttgctctcttggttttctattttaaaaatatatctttctttcacctttagcactttgaacaaatttggtggaggatgtgtttcgacagcacagtgacacagtcctcgcctcaaagatcttgatttggaatctaggaaagcagaaaaagttggtactttcccattatttttctgggattccatcaaaattcagttttggaattgtagataataataataatgtgtaaaaattcatcttttaacgtgaagtgtttgtttatcatttttttcgtgtgtctatggtggttgctttgactgaaatttgattagtttcaatttgttctcaaagaaaaggtatctggatttttatccgttatcctgaaatagcctattggtgacttattgatcatgagtttgaatccggaaataacctatttgcatatgcaaggataaggctgcttacaatatccctccccttacctacgcatagcgtgaagcctccggacaatggggtacgtagtttttttagtttttttttaatcctgaaatagaaaaatctttaccatgcagcaggatatgaagcagcggggtggttgagaaaaatggttggagttgttgcagctaaagatttgccagcagagccctcagggctcagaggaagagtttaggcttcgtttgagaagtgggattattctctgtattgttattaattaagttcaatcgggaactgtatccaaggtgagttagatcataatttagtttaatttgcaattttactggctcaggttttggttattccgtcattgtatgttacaatgtattcttttaaggttgcggagagtcctgttgattccgcattgatccctgatgcggcaccattaaaggcatatcagtattttgaaagtaaatattataagtaaagcattagatacttgttaactgttttcatttaagtaaccaattcatatcatggtgaattcaattgttaataacaccagatagtcagcacttaattgcagactcttgatagtttaataatgtgttgttgttttggtttctactgagttattggtcatattttagggaggaaaatcatctaggattgtcaattgcatcctggcattgaaacaatatagtgaatgaaaaatgaccggggcaaatggtgtgtagaaatttggcagaaatctcaaatccattgtctctgcaatgaggaaaaactcagccatttactaattccttattatggaattcatcgaacaatgataaatgccccactgctcttaatctgacattgagtctaataaaatggtaggaaaacttgatttatttgcttagcaaaaaaatgaaaacttggtttattttgacttttatacctgctttggacttgtctagttgaacagaaagagtaagtgatgaaatattttattttgttagttgcagtgcggttcccattctttgagtatgattgtacatgcaattctatcagataagaagcagaagtttcaacggtatgggaatatgtagctctgtgtttcacagctgaatttaatcacaactttaataatcaagattcaagttacaccttatagattataagtctgttacattacttgaaactctctgtctctattatgataaaaagcttttgaaaattgtagctttatcatgaaagttggtatgagcttgtttcctcgctgcttaaattaatgggtgtaagaatttttttaattgatgtcatgtgccccttgcttatgatttgatctgcatcacaaaatgtcaaagatcagttctaccattcttacaaatcttggctctagtttttctttctttatttatgatgtcaagtcattgtctaattatgaaaaacaagacaacagaaaatagcttatatagtgttgattactaactaaattaagatcgttgatataatatagtttagcagatttaaaagtgataaagcttagcagagagatcggattcgaccacagagagaggtcatcctccagacttagacaatcctttattcctgttcaaaccagaccaatttatcctatagttggaaagtaaggaccaggaggaccaaactttcggcagttggaccaattaagaatgttatcaatttgttttaaatattaggatgcaatcattattctagtacactttggctctatttataagtacaacactaaaaacttaagtgatgttagtgtaacatttatttctttgttctcagattaagcacgctttctgctcttctagcattcattcatgatgatgaaccaagaaagactggaatccaaagccaggagtaaactcttttggaagttcaagaaggaacacaaagctatgggcaacaaatttgcactacttgaaaatgaaaatgtttctccggtaaaaatagtgacacaaccagctcttggaaaaatcaatgtggtggaattgattgagaaattcaacactcaatctgatgagtttatatcaaagaaagcatcacgactttgatttgtactaatgacttaaactctgcttcaagtagcacaaagatatttgcctgcgtattatatgatacattattacataaaatagacaacaattcttgccgtataaatttcttgattactatgtaacaccacaatttccttcctaacatgcataacataaaaagtaagagcataagccactaacttgaaccctagtggtaaacaggcctggccctggggcaggacgagcagggcgcccgcccagggtccaaaattttttacactgataatttaagtaaaaaaaattaaaaaataaaaacaaaacttacattagaggtccattttgtgtgttagaggccaattttttcatcctttagttttaatattatttgtatttcaaaaaatttgtgtgttaggggcccatttttttcatcccttaattttaatattatttgtattcaaaaaatttgtgtgttaggggtccatttttttcacttcatcctgggccaaagaattttcaagacaaaggagtttagcaaataggttaaaaacttttagattgtattgtaccgaagaagataaaaaggagaacaaacagatctaatatgtgtactgaattctcagttaattaattcaaatgttgaagaattagataagagtggttcttaagtctcgtctcaatgaattgcagaaacttgaagatagattgttaatcagaaggctcgtgatttgggtttttgcttcttattgttgtcactagtccttatcatttatgagaatctaaaaatagacaaaacctgtttgctttatgataaagtcatgagttagagttaagccaaaattccaaaattccttctaggggaatagctagcagagaatataaaataaataaaaaatgtacgaaccaacagcaatgcacgcaaatgcacgggttacttagtagttttcgattataattatatttactattcttgtgcttaattaatttattccagaacttgaacaatcgtttgtatttatctggaaaataatttttttcttcattaccagtcttctacactgaattagaaagatggatatatatatatatatatatatatatatatatatatatatatattgtaagttttttacttttcggaaacaactgtcttcggttctttagatcaactacatatgtataaagacctaaacttaaaagtgacatcacccaggagtcactccagataaaagttttgagtgacctcatattgtcacgtatgaattgttgaggatcaaagcaaacatataaaacgagaagggacgtagaagaaaattcatgcttgtatttctaatttcttgttatcctatgtataaaaagaagaatacttcaaattagaattaattggttcaggaaatatatgcaaacaataccatcatcatttgcaaattgttgggctgtagatttaattttatgacaaaatgtcttttagaaaggtagaaatcaatatttggaaggtttaaatacatttgcatttttttttttcattttcttccccacaatttttatttattttaatctttgcaaaatatttatttttgtacttaaagcattttagataatatttttttcattgttcttaacactatctaaaatatttttaaagatgaaaaacaaaataaacacattttacaaggactaaaaagaaaaaaaagttataaaaataaaaaaaaatgttaaattatgataacaaaaagtatatttaactctgtttgaaaagggttattacctttgaaaatatttagaactagatagtgattttggtggatcttaatcttttttgttaaagttagctttcgaaaattctctaaaaaaattatgtctttgaaatctcttttgactttttcccttcttaattgcaaatatctgttccattccaatccatatatgtatgtaatagtcaaagttgtgcccactcttgtagactttactccgttgttgccctcaaagctaacatcgattcaaaattcttgtcattggcatttcaccttcctcgattaattaacatttgtcctttggaggcccctaaataaattgatatgtatcatctggtcaaaaacttgtaagctttaattttatttttaagacacacaccacacacacacacacacacacacacacacatatatatatatatatgtgcacttcataatggaaatatttgacttgactccagcagccaaagttcaatttacacaatgaggtcacaaaaattaatataaatacatggaaaggaggaaaataataatttacacgttataagaaggttcccaagttttcaagtgttgcacacagactaataatggatgtgtccaagttacataactctgatgatgatgatgacaagaaaaaagaagttgtgcttcctgggtttagattccatccaacagatgaagagcttgtggggttttatctgagacgaaaggtggagaagaagcctctgagaattgaactcatcaaacagattgacatctacaaatatgatccatgggatcttccaagtaagattagcttcctctttaatatatggtatcagtcactgaaagtgaaacctattttttgtttctgctgcagtagataaatttcatgagtttggttatgattcttgatatatataattcaataattaaggactagagtgtttgatatatatatatatatatatatatatatatatatatataaattgaatgaaacaagctaggataattaattaagcttaactaaagaaagctatatatatatatatatatatattgtgttggagaagtgtatgtatagataaacttaactagcacatcttaattattaattatatggataacaaaagactaattaaatggctcaattgatacttaacattttgggaagttttcatgtgaagatgtagaaactcgggcttcaataatatgttattggataaaatataaattgaaaatgaagacagagttggtgtatacacgcatgatatatatacatttagctggttttcaattctaggctagctagttaggtatgcaactagctagccaccccattttgattttatacatttatggtatggattatttcatgatttctaatctcaagtaattttatgtatgctgataactaattaatgtatgaagaagtgagtgcagtgggggaaaaggaatggtacttcttttgcataagagggagaaaatacaggaacagcataaggcctaatagagtgacaggttctggattttggaaagccacaggaattgacaagcctatatactgtgttaaagaaccccatgaatgcattggtctaaagaaatcattggtctactatcgtggaagtgctggtaaaggcaccaaaactgattggatgatgcacgagtttcgcctcccacccaatggaaaaactagcaataatccacaagctaatgatgccaatgatgttcaagaagctgtaagtcaattattatatatgttactcgatctttgtttcgttaatatctatgcatcgttagcctacaaaattttacatatataattaaccaatctgatcataactaataaatgacttttacaatactttataaaaatcaataatttaccatatataataataataatttataattgaatgatacagtataaaaaatctttacataagtgcatacactattttttataatctaataagacagtacgtttgaaatttcttttttatgttgcatgtatttaaaagaagtataaaatattaatttgtaataggaaataaaccatctagaacagcatgtaaagaaaaatctgagataacatagtcaaacgaccacaacagtttctgagattcggggttagaatcttgttcatactcaagaagaccactaacaaacaattgtacttataaattatattctaaagtcataagcacgtttattagaccccaaaagggagaaatgcatatagataaagacacatgaaccaatttatttattaaataatcacatcaactcttctaggctgaaataatttagcaaagaaggacagacactttcaaataataattgtgttgtaccgtagctgtatacgtaaccatgtcgaatattgtattaatatttttaattgtaatattgtattttttaaaattttttcaaacttgtgtacttatcacaacaattagatgattttttgtattatattttattatgttcataatgatttgtattcatttttaaaacatggattttttttctcgtgatttaaatcattactttatattaactttatattaatttacatactatattatagctgcaacgttttctgtaattttcaaatttttttatgttatgtattttatgcatatatatcccgaattgtatctatacttcctagtagttaattagccttccttatgattttagacctaaacttaaaattaaggtagttacttcacctaatattttgttactaaaaaatatttataaataatcttgggtctcaaacttctagcacacatggcatgtacaatgcatgaaatacccagaaattttggctccactgcctatatgtcaggatacgggtgttgcactttcttgtacagcaaattaagtttatactatttgcctattagctaaaaaaattaaaatatatgttatgtatgcttggaatatcttgttttataattaatatattataatgaagttttagttaagctaaaatccctaaactttcatttatagaattaaataaatacaattaacatattaaaattcataacatatatgttggttcctatatatgttcagtctagtctaatttgtgttctgatgacacgtttcttaggtcattggctcgtcaagctcttttgaattgaccgaatgggatttaatagtaattaaagaaaggagaaaacaatcaaattaatagtacactatcatttaaccatataacttaaattagtaaaaaaatgtaattatcaaaaaaaaattgtagaaaaattaatgatcgtgtaaaaacctttatttattttttgacagggtaaaaacctttattatgaactagtgaactacatatcaaattagttatttttagaagtactacatatcaaattagtaatttccattgttggtttcccgttcaattataccaaagcattgatggacaaaacgaaaaaataaaaagtagtagtacctaacattgtgctatattaatatactaaacgatggtttacgtaacaagaaatctcgcaactaattaaatattgtatacacttcgacaattttgtgtggttctcatctcagcgttacataaattgcatttatttcattttgtggcatcacttaatgcgatcaaccatgtcaactctagcattctgtctcttttgtttaatttgcaagtttttaagtgtcttaatttttttatgtctttttatttatggggttcgcaggaagtgtggacgctatgccgaatattcaaacgagtcccaacttacaagaagtacacaccaaatttgaaagacttggcagcaccaatcactgagccaaatcaccccacaaattcttcaagttccaaaacatgcagcttagaatctgacaactgcaagccatacttgactttcagaaactcatcatccccacaactcattcaacaaaatgaaaagaagccagttattaatggacatgttgacgttgaacgtaaccacttatttctaggtcaattaggcaatgtagctcaggctccaacatccttggcttactcaagtttttggaatcatcgtcagaataataatgtggaatttgctaatgagaattgggatgatctcacatctgtggttcagtttgctattgatccatccagggtttctgatcattgtaaagaattcaatagattttaagagcatttggatgcttaaactactaataacagtaacagttttaatatctctcagtttgaccaaataggagtattttgttattttttctttggcccatttgacaaaatatattattgtatgaacgggttatagttttgatattatttgtcatatatatggtaccctctattcttttttatcaatctcattaggggacaattcttgttcctttttatttgtgtgtctaaatataattaataaagcattgattatttgatttaattaactttacccgtcgtgtataataacaggtgacagtggacatcaataaagtgatgttttaaatatttcaatcaagacataggagtttagcataattatttgatttgaattattataaattttttatacctgtttttgttttctatcgagaaaaaaaaaacttcaatcaaggaaacttagacattattttataaccggattatttatttaaatcttttaattcacaagcagcaatattactagacatatacaaaataaaaaaatgattaaattattaatcttaacattatgtatagttaaatgattgaataaaagaagtaaaaaaagcttaaaataatatatatatatatatatatatatatatattttttaaaacaaataaaatccttataaatataatattacattatataaaatattatctattaaatcaaaagatttcaaaaaacttttattttttaagataatatacgacatattttttcaaaaataacgatgagagactgggggactaagagaggcgaagactccaaaagaaggaaccaaacccgcaacccaacacccacaaaccagagatcatagaattaaaactaaacagtttataccaaaaaacatgagggaccaaaccaacccatgacagagattaccaaaaattaaattcctcgatgaaacctataggaagttttacaagagttgtttctatagagatcatctaaaataaaagaaggggaaaagtcccaccaacaaaaattagaactatacacttcgaaggccgttaacttacctgcataagtgttgtattctctaaaaatatgggagatgcgaaaattcatcttagaagtcgcatataattatatatgcatgcagtttctccatctattacggaggttccaaaggaccaagttaagatacttgaaagcaagagtttccaaagtcgaatcacattctaaccaaaggaaatgccaccctttatcatgcgcaagctcaatggctctcatggctgccagcaactcagaatgatgggaggaggacaccccatagaactcaacaaaagcaccaatgaacataccaagggagttcctaaaaaccacaccatcagctgcccttcctgggttgaatatacgacataaaattgggttgaaataacacaagataacacaaacttgtcctcaaaattcattgggtctaatttaacttttttggatacgttatgatagaacaaaacaaaatcttcattatatttcatttcactcaaattaattaaataaataaataaataatgatataaaaatgtaataaaattcactcactttcataatatttcttccacattttaccaattcaaacgatatccttatatttcattttcatctagacgcatacataacttcgacgtcaacacttataacaacgctccgataaattcgggttggaaatgggaagtgatgtgaaacacctagcaatcccatcaatgctgtctgtttttttttttttttttttggtggaaacaaaatagctgttaatacaatagttatcccagtaaagggcataacttgaggaggaggtgaaaagagggagtgtcaggttgcaatgattctaaagaaagtcacgcaataaagtactacatcaagttattcgtaaaacatttgtgggctttttactagtcaattcttcaatatttatgatactccatcccatgggactcgaaaaagctcagttgtttaattgttgaaggtcctcaattcattgtggataaaaaaagggttttattcgttgattaaatgttacatatcacagatggtttaccggacagctcgtgttgtattacattatatttacatcagaaaaaaggtattcacttttcagggcaggtcataacacagcttgattaggcaatgataaaatgaaaacaatatggtttacacgctcatccaacaaaatggtataattacattgcctaaagttgaaatttgctctatgttgtatacttgtgaataacatatcagggttgatggaaagagttagctccttgttcatggtggtgattggttcctggctggctaaccacaggaatatccaagctgcttccatcagtttcaggagctacttcccttacatcagctatcctcgcctctgtagcctgaatatcactccattcattatccccaactggttgaatgttcacctgatctgttgccatgtggactacattctctgcagggacggggatggctctagaaacactcaggcatgctttatccacattctcttccgtggggtcaacatgctttgtatctgagcatgactctgtcttctcaaaaacttgagttgtatcaatgtgttgcctgttgtaaagaaaaatatctgctgtcaactttggttttatgatgctccacatttcatactgatatacatattcaaactcaatgaaataaaaaggaaaataaaccatcaaaagtctccttccatttccctgtttcaataggtattgatatatactatttccatctttatgtttatgtgggaaaacagaagtagccaacaaatctaatttaacaaaacaaaaagcaagggcaaaagaaaataaggcattagacctttgaagttgggcttttagtacattcacatatgcaagaagctcttccttctcttttaacgctgtggattctctctgaacagcctcccttatcctagtttcagcatttgcttctgcaaccctaaccttttcttctgctcttactacagctgcttctaagataacatcatgctctctagcttttgcaagttcagaacgccacatatttgcttcctgaatagcagcatctctctgcctgattaattgctctctttctttgcttaagcccacaatcttttcttcagactctttcagctacaaaaaaaaaaaaacaatttaagacaagatgaacattcaagacaatttcattgcaagtaatacccatacatagtaatagctaagggtcaattgtcgaaagcagtttaacgagaatcacttgaatttccatcagccaaaaaatattttcaaatgaaccagcacaatggcataccttctgtgtaaacagctcttgctgcttctcagaatctttattcaaacgctcaatttctgcacaagcaattctccgatgctcatccatagtataagcagcagatgctgcagcctcagcagcttcagcagtctcagagagtttatctgctatatcttttatagttgaatcgcgtgctcgaaggtctcgagacaaattctgtagctcctcatccttcactctaagtgtttcctgtattgtggagtagtgatatgctgttagcatatgtagtttttagggtaaattcattaagaaactaagcataaaatatcaaataaatactagaataagtacaaagttcatcattattgtgtttatcactgattttatgcaattttgatgttaggagccaagaaaaggaagaaaagaagcaaaataaagagctaaggatttctgaagtctcgcgccaaccgcgctgatcgcgccagacctactggaagctgacgccagttgcaccagatctcgcgccagtcgcgccagcgacacgggaatttcaaattagcttaaagataacattaaactgaaggctattagggcttttatagtttaagtataaataggaacataatggaaagggaagggacgttcaaaaaagaaaaagaaaagaaggaaaaagaggcatcaccaagatcaagaagaaagaaagaagattcaagaaagatccaagattgaagggtttgcatactcttcttttctaatcttgcttattcttctcactccattgtatagagtcagacataactatgtctagctgattcctctctctttatagttagggccaaaacctaatgagaactcctctgtaattggattgatttctattattatttatgctaatttgtttcattttactctgttttcattaattatatctttattagggctgatcattctaataaagttctgaggattagggtttacaataggaatattggggctttaatgactgacaagagtaaagtaacaatcgtacattacctagggataggatgtatgattgcagaattattaatgtatttcttaatgcttaatttatgagaaattactaaggaattaggattttaaatgaattaaagggttaaagtcactaagggattagggcttactagattaatggaaagatacattgtctaaacatttagaataattaatttagtaattaatccaagtaaaggaagtagggataataaggttaagtgctctgactacaattctttcccataaatcataaaaacataatcaactctatcttttatttcaattgcaatttacttttgtcatttaaattcttcaaaacataatacaaatcataaatcaattaaattttattccttccaatttaaagatagtaattacaataaaattcgtgcctcaatcctcgtggagacgatactctacttatttactttattacttggaacgatcggtacacttgccgattccgcaatacagatatgtgttttccttcactctaagtgtttcctgtagagtggagtagcatcttcagaaccaaaaggcccaagaagacaataaatacccacataaaaacattaaaaaacaaatccattctctatttatatccaccatcctcatttcctcttcaaaatcttggccactacgccccctccccctttaatagatactacaagaggaaaaagtgatattccccaatatactttcttccttttttttgctttcatttctttttctaagcaagtgaacataaatcaaaagtctgcaaacgttagttagccaagtaaacagtgatgaaaagggtagtcctcccctaaccccaaaagcaaaggagtaattcatgcattttcaaacaacaccatgacaaggaaagacaaatttctttgtttaatacatgacaatggcgtacaaagaagccttatcataattcaatttcaaccatattgtgtatcttgccacaaccattattgaatgcattatatacaaagtacgacaattagttcaaagcatcacacaatcaaaattcattaaaaaaaaaaaaaaattaaaatgttatagctagtaactatctagttaagggtgcatttggttaagctttgacaaaaaaaaaaaaaaaaaaaaacacactttaccttctaagaatagtacttaaaaaaaattcctcagagttttagcttattataaaaagtttaattaaactttttatcactgtacatgacacacatgtttaatctagtccttgcacaaaaagaaaagatttccaaatcagtccttgtatataaaaggctacccaaaaaaaaatagtagctataactctgcagttctctgctgcaccatcacaaatgctgaactatacatttgagcacaagaaagacagaataaaccagaactagattgtaccttcatgattgttaaatcatccataggaccatcagtagtcctattattcatcattcccagagcatttcgcaaagaaatctgcattgctgcttcgatttcttttgaacattccaaggctgtcgaattggatgcagcaacaactgttgcaacagttcctaattttgtagacccattcccacttaaggaattcacagcttctttatgcgcttttagaaccaactgagttgcactaatgtcagatgataaaataaatcagacatcaaaataattacagctattagacaggaaatctgaaatagaaatgatccagcaatcattcaaattgattcactgtagcggaaagcaagaacatcagacaaataattatagtaaataataacaaaagtaacataaatataaaggctgaattatgacatgacattagtattctgcaggtctccctttccaagcaaatgcctattcaaatgaatataaaaacacactgttcaaaagagttagaaaattgtgaaggactgcagttatgacttatgaatcctcaataatttgaaacatgacaaagtaaacaaagttttgtaagataatagaaaataaatgataaaactcaaaacaaatgcattagtacatttaggttcaagcatgcagtatttcatttgtaagctacacctctttatacacttttgaaatacaaagggattataacattcatactcatacattcgacaacataaaataaaataaaaaggataagattatattccttggaacttggcccagagggaaatgggagataaaagtgtgggattatattgggaaaaacccaagtctcatatcggtcagatagtgtcaaaatataatatataagtgagggccaaccctcatcccatgatctaacttttggggttgagttaagtccaaactcacattctaagatgtcctagatccattaaaaggtttatccaccatgttacccacacaccaagttcaaaagtgctaagcgtgagggggtgtagggaaaaacccaagtctcacattggtcaaagataatgtcaaaatataacatataagtgaggggcaatcctcacaccatgagctaactttttgggttgaattaggttcaaacctacattctaagattataaaacttactgtaaagttgacacccatgctctagctacaccaggagtctccgcacagaggaagtaatcctttttctgtggtgtcccaatatctaaagaagccaattaaggtaacaagcagagtgacttccatcaatttgctgcaaaatgatgattcataagtagtaaatgcgataaaaaggatacaaaagcagcacccatcgtactttggaagtccgctgtaatacacagaagtaaataaacaaccatgtcaatataagaaaattcatgcaacaaaacttcataaaaacatctggaaactaggcaaaataagcttatgttaaaaacaccaatcttactggaaattcacaggagatatggtgatggtgctattggcatcaaatataatcgttcctttaacagaaggttcatttcgtcttatcctaaggtaaggaaaacattcaaaacaatacagaagatcagtaatcaaagtgattttccgtttccccacacaaacagaaaccaatatgcaaacacatacttgtattccattctccccgttgtcgggtccaagatgacccaacgctcgttccattttctcagctgtgaacacaaaagcgattcttacatgaactagctttttttctttttctttctaaaagcatcaatcaataacatttggctattcaaacgattataaaacacgtaacaaaacagaacgcattggaattataacagaacatcgaataagaaattaaaaattggaattgggagaagaaaaagagtaaaggcgaaaataaagtgaaattgaagtgagaaataggaaataggtattgagataaagggagtgaatgaattacggtttcagatctcttgagaagtggtccttgcaacaggtttctaccggaagcggaagcgagctggcgcttgatcttctccaagctattctcggtgttttctgcagctcgctgtgtcattgcaaattcagctcagtgttattaacaacgattcaaaatacacaacacgcaacgagagtgagaaagagaaggtggcgattgatgagttaccggagaagccatgagcgtagatcaagactttgtcggaagctcaaacacaaagggttttgggtgatattcccccagatttgcgttttcgagtgtttgttttttactttttagaagaaaatattgaaagaagaaaaaaaaaagtttaggaaactaaattatttaatgggaaagaccggtaggttattatttggcatactgacttgcagttgtgcagttagcttcacttttttctgtgttggtcaggattaataattttaataaaattaattttgaataatgaaatacaattaagaatgcatatttaaatttattttgtgaatttaattagaatgataccacagtgtaaatatttattatgcttatcatcgtctgttgtatataattaaaattgttgatttttataataattattttgaaattttacttaaaatgatttataatcagtttataatttaaaaactaaaaaaattaataaaaaaagtttatattgtaaaaagcctttaactaagagtgtatcaaaattaaacactaattttatattaaaaaaacatgattttaagttttttaaacattttcaatgtatatatttttacactattaattaaagtaagagtttgcattgataatatcaataattttacatcacttgacacttcttgttctcagtttggctttctattaataatacatcacttggcttataaaaaaatataaagatttttatatcatcaataaactagtattttaacatgggtgggaaaaatattatttcatataactagtttataataaataataacttttaaatgtataaattatgttatattatatgttataaataaaattcataattaatgaatagttttaaacatataaagtatattttaaatttgtaataaataatttatactgtgatatagaaatattttgaattattgatcatttttataaaaaattgaaatttaatttaaaaataaaaacaacaataatattttgaaacaaataagatgttaaaaataattcttaaaaacatttttattgaagaaaaactcctagaaacactttcgaaaaatttgaagaatagatcttccacccatccccttcactttccaccaaccaaacaaagtgtatttttgttttggtaaaattaaattttaggagaaggaaaatgatgttttggtacaagacacaaaaagttttgtgcaaaaatagagaaagagagaaggggaaaaaaaaggtcatacaccttttaatgaataaacaatcaatttagttataaaaaatattactaacattaaggaaactaatttgaagaaatgttcaatactaaaggaactatatagcatgattttcaatgctactcttatctgatctatatgacacggtaggaacaagctcacttgggaaaacaagcgtccaacagcttttcagattattttttaatgctaaacaatatttgtgtgattggactcaaacaaaaggtttcaataattatatatgctaacactaattaaaagactattttttaatgctaaacaatatttgtctgattcgtcaaatgcaacaacattaatgccgccttccatgtagatattaatagcactagttggggcatttgttgtagaggcaaccaaggcaatttcaaagttgcgatttttgacagtgaaggtcagttctttcctattgctgaaagggaggccttggggtcattgaaagccctcaaatgattattggagaatcacttttgtagagtgatttttgaaatggatagtaagctagttgtagataagatctatagtatgacccaagatttttttgacctgtgtcattattcaagagtgcgcatacatactctccctcaatccaaactatttgatctagtttatcaagaggcaaacagactttgtcactcattccattgcaagggtggcaaccgattatgctagtctcacaagttttgaaagtatagatcatgtaacaccccggacgtgttatcattaataatatcataagcgcgctatcagcgttacataaacgcggtgcggaagcgatagaatcgatcctcttgatttcattatgcatggaatataaaactcaacacaaagcatcatagaaaacaagcccctgttgatccagatgaacagaaataaacaaacacaggcagatacacacatctaaatatagagaatcaggaggaaacgtactcttatacaacaacataaactgtacatatacactcaaaacaagaccatattaggtcatacatcatatatgtacaatacaatgggtgtacacttacaccctatctctatacagagtacatgacagagatcaaactaaagactcttctagtcttcatctgcagcccatgaccagctccagcactctcagctagggccttctgccctgaggtatcttctctcctctggaaacacctgaaaaccacaacccacaacaggggtgagacaaacgtctcagtaaactcagggttctgggagatcttcccttaccctggttcacctcaaagcatacacataaaaccaaagcagaaacgagcttaggaaattatcctagctttcataacccattacaggcaacataaccagatactctcagtatcataggtatcacacctcatcctggctctcacagccatctcaaaaccatctaacagagccaagccagaatcatggcttcaatatctcatatcggctcttataatcgtctgacagagatctcacagaggtacctaatcatcagtgtcaatcactagacactgtatataccagagaggcaccgcctccaatgctatatatatatcaagcatggcctgagtccaccactcaggacttcatacacattgcctgaggaatctcttcactcaggacttcacatacactgcctgaggaatctctcaactcaggacttcacatatactgcctgaggaatctctcaactcaggacttcacacaacatatgcctgaaagagatcatctcacatcggaggcactcatctttcaggacttccagatccactgcctgagagagatcatctcacaacggaggcactcatccctcaggacttctaatcacggtctgagagagatcatctcacacaggaggcactccatccctcagactatcaatctctcacctgagagagatcatctcacaacggaggcactctatccctcagggtcatcaaccacatgcctaagagagatcatctcacacaggaggcactcaatctcttaggactttcaatcacataccatctgtcctaccaccataggactctattctactggccagagaatctcagaactcagacactatcacagtgtctatttatcctcaacacagaccaccaccatggtctttatcaatctccgcataatcacctgaggatactcacgcaggactttcatcatctctgcctaaggaggaacatccatacagggcaatccacccttaggtctttagacggagagcagtggcacctcccatggaatctcagctattccagggagtcctcaactcttcctctggctagggaacctcaactagcccaataccatctcagtatcttatagattccatcacagatcattttctgatctgtatctcatcaaagtcatggaacacctcacagtgttcctacatctcaggcccaaggccacacctgaagccacaggtgtcaaataccctcacactttctcagtgtctatcctagggttcatcaattcagcccagcacacactaggctatcatacattcatataatgacaccatcccggtgtccagtccatcttacatcagaattaggccacaatggccttacacagcaatctatacatatacatatcaattacatggagtataatcatcacccacttgggtggcaaacaagcataagggctaattcccagaacgatgagcttacctgttaagctgtgcctgcagctccaacctcagatgatggtctgcttctctgacacccaccgtgtcaagccctattaaggcatgcaaacacacatatcacagaccatccaagcatataagcatgcataagctcattaagcagtcaccaactgcctctgagaaaggaacctcagtcctttccaacaacccaggttatctaacctaaggttctcaggctcatccatcaaaatcctgtccatagatcctcagtggtctatcacagatccaccatggctgcagagtcattccagactcaccaatagccatctacaacgggcatcacagcccacactacccaataacacagaaattccatagggcttgaacggtctaatcacaagacaccgttcccaaggcctcacaggcacctcaagcccaacaacatggctcttgcatgtctcaattcaagtgactcagtctaagtcacacatgcacaacctagagccaaaaccaaagttcaccaaatcacaaactaaaagctaattcttcctcctctcatcattctaaacacatctctcaactggacccagagctaattctagctctaccaaaagtgggtcactattcatcagaatccccaattcacaaattaaacggtgaaactcgagtttcttacctcaaagatgacaaggaaggcctttggaccacctctcctagtctgggtgtccgtgaatcgccgctgttcctagccaaactcgagttctacagatttcccttgagaaagggatttctctgattgaggggttttaaggaaaaagaggaaggattatagctcacaacgtgtttcccacaatattagaggttaaagggctgagttttggtgaactaagatgaagaaatgaagcttggagcctcatccatggcagaaatggcaaaggaagaggaagagaaacagtttttctctcccaaaacgcgaaaatagccttttatagggcctctgtacgcgttcccgcactaatagcgccacaccccacgctaatcgcgccaccaattcgaaagaaatggctttctggagcattctggcgctaaccgcgccatatctggcgctaatcgcgccactctggcgcacctcccacgctaacagcgccagtttccacactaacggcgccactcactggccgtcgctagatccatcgcaaaatccgtcgctaattccgtcgctaacacttttgcgacataattttctgaaaatataaacttttctcttcctttttcttttattaagccaaggttattatagatcaattacctttttgtattcaacaggtgatcatcaatggaagttcttaagtttgcttttgaaaaaaagggagtacttgtataatttcaatagtttaacactatttaagagagaggatgatacttcaaaaacaaagtaaatggtttattttgctttttattttcttacttaatgagtgggatttttaacgatataaagatcttattctcgataaaattgatttacttttgttaataattcacaatagatttgttttggttttgggtcagagatcaagggtgtccctcaaagagactaataattgttgtcgttgaaacaagaaattgtacacataatgagaatcaaacatatattataccgttaaatggatcatcccactcatgtcatgtgaatgtagcatgacttataccattatacccatagttgtaaaacctggttcggtcattgactcgattgagatagtggaccaatggtccaatcggtggaccaatggtccaatcggtggaccatggctctggtttgaccgggcatatattaaaatttaaaattatatatgtatctattatatataagtatataactaatattatttctgagtaagaaagatccatattcaaaaattcaaattaaaaaaaaatccaattttttcaaaaaaaaaatccattgttttttaaactagctggatcggaccgattcaactgagatctggtgaccaaccgaccggatttaactggaccaatccagatcaactgcataaccagtcctaaagcgaaactgacccgattatgttactagttttcgatctgacctattcgaccgaccactctggaccaatatttataacactcattgcaccaaccttttttggttacaattctcattagattattagattgttagtgtatataaaaaaaaatcaattttatataaaaaaatctaacttaaaatatattttaaatttcttatttttttattaaaatttgctttcatcctttacttttaaaaatcttttatctctcaaatttaagtcaatattattcttccaaaataatgacaaatgagtaaaaatatagtttagcagaaaacgtattatttttttctttctgaaaatcaatatttttcccacctttctctttttcctattcagtctttcattttttatttttttattgagccataatacagggagtggatgtacgtgtatcatgtgtacttctgaatttaaatacagagtatcatttttcagttggcgctttttcattgtaaaagcaaaaaccaaaccctagacaaacgtccacttacagtctcaaattaattgacagcaatactgatccaagtcctgctccttcatccttcacttcactgatcaggcatcgaatcgaagtgaacatcactgtactcaagttgcacaatcagctcagcattttgtcaaacagaaagcaggcgacgataactaatgggtgggatattgaagcaaccgggcgcgtttgcaatcacaccgcacaaagtatcactctgcatacttcttaagatctacgctccacccgctcagatatcggtccccttccctttcgcttccgttgctcagcacaatcgccttggcttgttcttattagccctcaccaaggtcaccacttttttttctttcattctggacaaatgaaattgcatttcaatcaattctaccattttgaatttgaatttgaatttgaacttatcacactctggaaggaggaatttttggtttagtcgtatcgcaggcagcttgtgctaaatagtgctcgttttttttccttagcttctcgccttgtctgttttctcttaccgggttctcagtaaatacttgtagcagaagaaattaagaaggtagaatgaattatacttttcccaaaggttaaaattattatgcattggctaagttatataagctctctcatttagcttctccaaagtccaaaagctaataattttaacttataagctaatcttaacttatgggagaagcttaattcatcttaccttcttactttctcttattgaagagtctattcaaataggatcttagttatcttagggcgtagtgccagtggaatgggcatgctattttaatcgttttttagcattcccatattctttggggttttttactaattcagtgttcgatcacacattttcttcatactggtgtgttgaaaatgttgttaataatgcagtcctgcgattatatcttggagccaaaattggatgaactcatccatcaattgagaatgatgagccagaactgggaggcttcctgggttattgatcagttgatgagcagactatcatctctgtcatcacctgatgatttgtttaatttttttagcgatatacgaggtgagttgatcagctttaatatttgctagcctttgaccttttttttttatatgttctgtcttgtttgattctgatagaaactggaccaggcttctattagattccgtcttttatcctttttattttacttgcaagttgcagcgcatttggttattgcttatacgttagatcaaattttcatatttactgatagtaaaatgtggttcaggaatacttgggggtcctgattcaggtgctgtggaagatgaccaggttattttggacatgaacagtaacctggggatatttcttcggcgttgtgttcttgcttttaacttgctatcgtttgaggtatgatgttttctgcattcttaagatggtttaaattgatcattgtttgaatatttatatgatcattatccatgtcaaaaaaaaaatggggggaggtgaagttgtcttctttgaagctccataatattgctaggtgcttcgaacaaagtattgttgtctgaagtaaactctaaatgatacctttgaatgagtttacattgatattactaaaattcgtggagtggggctcagcacctattatcctttgttttcatgatgagcatgttgctattaggagtttaatatacaattttgagtctctggttaatttttttttcttactcttttctcatatgcttagtttatatgtgtaattttcacttttcctctttaaaatgaaatcttatcctcctcataacctctaatttgggtgtccagggtgtatctcatctcttgacaaacctcgggatctattgtaaagaagaattctcaaattgtcctgcctatgaagaacacggtttagatgattctagtagtaatctggagacatattcagaatatgagaatatggacctggagaactttgtctatgaaaaggtttcagaagaaattgaagcaagaaaggaggctagtgaaattgttccattccatcttcatacacccaacactcttctgagtttagttgatggtataaggatctaatttaattgggctgctcttttagtgttttctgtagttttgaaagcacttgaaaaatctagaccaggatatttaaccaattttccaaatctgttttctgtttctacacttgtttatcctgcacttctcttttgggttttctctgtttatgccttgctcttggaaacactgtttgacacaatgacataacttccctgataatgttggaactcacatgcacagatattgatgtgcctgctgattcagtatccaaacagagtgagaaagttagagtagctagtccttatggggacccttcaagtaacatgctgcgagatgttgatcacagcagtgcggtatttctgcggacaaactggcaggtacaagggtacttgcaggagcaagctgataccattgaaaagtaacaacttgtaaacttagaacttcactgattttttttttttttttaaattaactgtaacagtgcatgtaattatattaaatttaaagttttattcatatattgcaggaatggtagtgctgtatctttcaatgggcttgaaatcattctacggcaactacaaaagttggcacctgaacttcatcgggtaagtttattagatttttttaatactattccttcaatatattagatttttttcatttttgccgagattttgacttcaatccaggttcactttttgagctacttgaatggtctttctcatgatgattatatttctgctttggagaatcttcattgctattttgattacaggtaattgagcggttatttctttattcaatctctttgacggcattgccaatgtttgggttcatttgatgactaattacatataaagcaagcagaaataatgcatcattcatttgtggcagttcattgtcaattgatattcattgctacctcaataaccacaattgactctcatcccacaaaattgttgacattgctagtctgtttgcgtgctactgaaggccattattgtcttgcctgcattctacttttttctaataaccttattctctttatcttcaatttgacattaattcattaaagtttccctacataaattgtaaaccttttccttcatccatagattttgtcttttgctttgattatagatctcaaaattatatttgtcctgtgcccatacccttaagggtttagtgacttaatagccaataaaaaggatagagaacattatgttctgcaactgaacttgtctgttatttgttggacaaaagtgcagggactgaaggatttgattatattccttcagttagtggtagtggctttggaagatatgaaattggattattatgtttggggatgatgcattttcactttgggcatccaaagctggctttagaggtaaatttttttagcattttgattttgatacgtgctcagcattctaccttttctaatcctcaaggcttctataatttgtattattttgtactccactaatcattaagctaatataatactatacatttttttggtgtcacttatattggtttgttatgtttaggttttgtcggaggcggttcgtgtttctcagcaggtaatcatataaaaataagctttatttattaaataaaattgtgaacatgtattcaccaattatttgcaaaacctaagctgacaacaaatgtttgcctgtgcatgctatgctacaaggggtacctggcaacataaatgttgttggcaaatatttccatatgttgtgctgtaaaaactgacaattttcatttgtgcagcaaagtaatgatacctgtcttgcatatactttagcagctatttcaaacttgctgtttgaaaatggcatcccaagtacagctgcgacactaggatcgtcatactcaccttttacaagtataggtatttcgctttctgttcagcaacaattgtttgttctcttgagaggttctttaaagagagcagaaagtttaaagttaaaacggttggtggcttccaatcatctggcaatggccaaatttgatctaacggtaatgaaattttctgactactttaaactaaacattctctttatactgctagtactttttctttatgaatcctaagcaataatgtaaaatctttgttgtggctttagcttcttaaaatattcaagcctcaaatatattgacctgttagtataagaatataggagagacatggaattgtgcaaattccagataatcaagttcatgagttacactgtggaacgtgagaaagagttatagtgagttgattaagattagacctgcatttgagagtgattgggtttatgccagggaggtcaaccatgaaagctttatgtctactgcaggatgtgatgtatctatactgaaggaaacaaaaagatccttgcatagtcatcattgagatagatagagtatatgccagtatggcactagaagtcttatggaaggctttagcgaaggattgactttgaatccatattaatgttaaatggattgtaatacagttttgtatgtggtactggactttccttgatatctgattggttagctatttaggattgaaatttgcttaaaatttgatcatgatacatttacttcaatctatcattaagtttgaaccctaccaagcaagaaagcattttttggggtgggaaaaatgtttctctccctgaaaggatcgagagcctaaatctgtcatttgatctatatcttaggtacgaacccagtatttattctctcaagtctcagcacatgctactgttcttgtttctattgctaccatgttgaagttcagagcactgctttgagcattccgggttgcaaacaaacaatcacttttttgggatggaacattaccatatgcgggataaaacataatagggatataagcatatcataataggttacaatttccattattccatcagtttaccttggtattggatgtagttattgggcacattgaatagctagtgccttagtgtatgctttatgcagacaatacatgacagagatggttgtagttgatgaattgagagaaagaatgaattctaaacttgagtcatggagagtagctttggaatgaaaagatttttgggtaagtaggagtgacagagtgagacacaatgtgtggaatacaagttcaatgagactcaacttgagtgaactatttcttgaagatgaaaattagggatcagatagatcatactcgatgttgcatggtttaggtgtgtcttgaaatatgaccgtaattctaataatttttaggatctcatttgttaaagttgaatccatagtccatgtaccttacatatcatcattatttttcttatataacttatttcaagctctaccaacttaaattagatcttaagtcctgttagtgagtaatgaaacttgaaatttgtcttatgccatttacatcatggtaatatcttgattgcagcatgtccagcggcccttgctatcatttggtccaaaaacttccatgaagctcagtacttgcccagttaatgtttgcaaggttgtagaaatctttgtgattattctttggtgacagtttcagaacacaagaattaaattctttgcttaatctattttcttcttatatggctggcaggaaattcggttgagttctcatcttattagtgattttagctatgagagttctgcaatgacaattgatggtgcctttagtacagcttggcttaggaatttacaaaagccgacgggttctcttgttttgtgtcaagagaatggatctggcaatagttctaatgcttcccaattcattgcacaaccaacctcaattcctggatctgtgttgcaagtattgggttcgtcttatatacttcgtgcaactgcatgggagttatatggcaggtaaagttgctatttgtgttgagatatgtttatatgaaattatgaattaaggttacactaattattgttctatctttcttttggaaattgccaactaacatggtataattgattaaaattccattgctttaaggctaacctattaataaaagaaaaaaaaaaacttgctgtaacaagctggcatttcttttcttgtattttttttttttttttttttttgctgtttttaaaatgagagtctaacttttactgaattttaatccatatatcaatgttctattatgttaaaaccttgaatgtaactgttatttatttggcaacagcaaccactccttccctttgcaatataattataggttgagacttattggctgtgttagccatatcaattgttgggaaaggtgggaaagattattcatgggtcacaatgcttgaatgtaaaaaatggaagtggggatataaaaatagggccaaaacttggaataaatatataataaagaaactaataaattggaaagatgttacacacaagcacaccctctgctaagaaatgacatagctggttttattggagcatttatgtatgggtgagtgcaagtgtggtaatgaatgcaaaagatgaacaacaatcatggcctgaatgaatttttggaaagacattatccttgcagtctctcttctattgtaactattttcttaatcttggattgattttctgtcaaatgattttctttctcagtacccatcaaaaacattttaatggtattgtgccattctgtgtagttcttcatgtcaagcttctgggaagtgactatttttcctttttatggaaccaaagtttaaaagaggaaaattatccactttaattgaagacaaaatacgagagagagagagagagagagagagagagagagagagagagagagagagagagagagagagagagagagagagagagagattcagacacatacacacacatatctctgtaatttatatttttaaaataaattagcagtcatttctatttataattcatcagtaaaagtaaaacattttagttgctattaaggtcttgcttaccaaacattcagaagcaaatttcacccatttttttctattttagggtttaatcaggtgaactatggttttcaaacacagctggataaatcataagggtacactaggctccatcttgaccaaaattctttaagccctggttgtattttaccaaagttatgtttataaataaaaaggcagattgcatgctttatctttgcagtttttacatatttgttttgttttaattatttttcatcacttggggtgattaaagatatatttcttgtttcatatgcatataatgctaatttttgtggttttttaatatcttgaaagtttgctgtatgtatttcacaatctgatttttttttcttttccaattgtcattagctcaccgctgtctcgcataaatgcgctggtgcatgcaactcgctttgctgatgcatcaaggtagtttctgagctgaatatattacagagatcacattctaagttgttattatcacctttgtttattatgaaaaataactgtatcggcaccattttgttaaaattttctgttgaattatcttttggtttccccagctcatcagatgcagcattagcatatgtaaagctcattcaacatttagcagtatttaaaggatacaaaggtcagattggttgcataaaattgaatagaattccaccattttttaaaatattgtatgtgattgttttcatatttgcatttgttttatcttgtttttgtacttttgctaatagtttgtaagtcgccagagtaactttttataaaaaataatatgataaattcagcttaatggcaattatttgctgtgcaaattgcattttgttaatacagagttgtcattttcttcatcgagattgttgatagtggatagaaatgtccactatcacccattcgagttccttattgttctgacttcttcctttttctctgtttctagaggcctttttcgcccttaaaatagcagaagagaagtttctatctgtctcaaaatcgcaaatcttactgctaaagttgcagctgcttcatgagcatgctttacatcggtaagttacctagttcatttgttgtattaagaatcttgaattgtgttagcatctgcaatttcagctcacttaattgagcatcatgtagtggacaattaaagctagcccagaaactgtgtgatgaacttggtgttttggcatcacgagtaactggtgtagatatggaactaaagacagaagcaagccttcgccatgctcgtacattggttgcagcaaatcaattcagagaggttttttttagtcttcttctatgtactaaatattaaactatatacagaaaatcaatcacacactattcacagttcgattcttgaaattgttcttttgttggaaacatgtatcatttgacaacagcataggatttgtagatttcaagcatgctgtatgcaatgctgttattgttatgtattaaagtacagtatgtggggatcttagcttccttgccccataaggagacaaaagggtgaaatcaatcactgttacctaacagttgaacaattaaaaaatgtatagattgcttttaattttcatataatgattcttttaggcagcttctgtggcacactccctcttctgtatgtgctacaaatacaatcttcaagttgagaatgcttcagttcttcttttacttgctgagattcacaaggtaaattatcatattgtctaacacacttgttagtttcatgtggtgtggatcaactatcaaacacttttatttcattttgctttatctgtatgatcatttttttttcttttctttttatgcttgatctatgtctcatcctaaattaccggcaatctactacattgtcccaaccctagctttcacattgttgtgttctctactgttttttattttttactttaaagccttcattcatttgtttttatcagaaatcaggcaatgcagttcttggtcttccatatgctttagcaagcctctcattttgcctctcatttaacttggaccttctaaaagcttcagccacacttactctagctgagttgtggctctctcttggatcaagccatgcaacaagggctctaaaccttatccatggagctttcccaatgattcttggtcatggtggtttggaactccgctcacgtgcctatattgttgaagcaaaatgctatctgtgtgattcaaacttcaatggtatgtcgctgtaaatagttgatgttagactatgctcttcaaatttgttgtctatccatgtatatttaaacatatgctgtttttgcaagtatttcaatacaatagccgaatttctgattctttaaaagataataatcaaatagggggaaactagtttccccacattttcgtcaatagttttctgagggtgttggtcctttttctatccccttgttggggctttaactgaatcttacttgtctgatttgaatttctttttcagtctttgaaaattatgagattgtgatagattcattgagacaagcatctgaagaactccaacttttggaggtaagcaaactttctgccttttaatattttgagaaatcccttgtgagaggaagaaaaatgagaggtcatgtgaatgaatctgtgtgtcttgactacacagtggaggctcttatttgtaattagaaccacgaatacagtagagaattgtcatataattatactactcataatatccctaatttacaatacttctttaacactatattacataattacaagcttccgaacagttttcattggtcccttttcatttgtaagcctttttgctgcatctctgcctcccgtcaaagttcacttggatacatgattgcatgcatgtgatagatactagagtattgtgtgtgtgtaaagcgtaaaatgaagtagggatgactgttacaatgaaaatccagtgcaaaccaaaagcagaggcatacattatattcgggcatatagatactagataagtgtttatcaaattggttttatggggtcttaatacattcaagatttatgttgtgatggtgaaagctcacaagtcaactagtaaaaaaatttcatagtaaaattgactcatttaacccacattattttaaacaactcttcaacacccaaatccctttctattgctttttatttaagatttgattttcttgcagtttcatgaactggcagctgaagctttctatctgatggccatggtatatgacaaagtggggcaattagaagaaagggaagaagctgcagcttcatttcagaaacatattttggctctccaatcctcaagatgaggatgatcctcttgttagtgtgttttgattgttctttatagtttatacctaattttatctatataagcttatttaattaaatttacgtacaatagtgacccctgatcttctgtaattatcattcaatagctgtagtcattttgtttccaattgtaaccgtagccaagatgtacggtggcataaaccttggagatattttgttctctcttccctttatagaggacaaccgttcatgtaatggacatacgaacgacaattaaattatttatcattttaaaagattagatattttttcttaaattattcttatgtattgaaatctccgctacatggaatgagataatattaattatgaaagtataatatagttaataaaatttatatttctttcaaattaagagtatctaatgatttattttaaaattcttacagaaaatttcaattagacatttgtaccattagagaaaaactgtgggactcatttgtttattagattatttctgctagcaactgactcttttgtacatttcatttttacattcctttcattatgaattattaacagtagatcgcatctcttaaaaaaaaacattagattgcagtattgctttggaaatatggaattataatgttaaaatattttaacgaataacgatgtgtagcttcaagttcaagacacaattttaacgttatacagtgcattaatgtttgaaattttagtgtataaataacgtatttttgataatattttttacacagcaattcttttaatttttcttatcttatttcatttaactgttctcttaaattttcttatctttatttcctttctttttacacacaaatgaatcccaaaaacacattgttgggatttatttgagttcttaactttaggaactaaagtgacatgaatatgtaaatttaaagactaaattgactacttactactaataaaaaaagtacatcggacccaacctacttcaagtcgtccataatattttaattagtacgcgcgaatctttatttgctgaaaagaatagcaacacattaattttttaaaacggcaatctttctataaagagaatatatactaatttactagatgagtatattttaatatattaatatacttcaaaaaatataaatataattcatatttctcaattaattataaaagtactgtattattacttatatgcaaaatattttttattaattagcaaaagaaagacacaaatgggtacccaaaatcatatacagtgccatgtatatagtgtcatatatataccaaatatataataatttaaaaaaaaaaaaaaattctagaagaaaagggtgtgataaagccaagagaagcgtgtgaagaagagagagtcgaatcctacgtggatttgacgtaggttgaatgatgaatgatgaatgtcgaatgtaagtaagagtaacgctgtaggtgtaggtgattgccatgtaataataacaaaaataagagttcgaaacgaggaaaggtagatcaacatcatccaatccatccacgttgaaacagtgtcgtaatctatttccatttcttctctatcttcacttcctcgtcctcgtcctcatcctcatcctcatccacctattctcaacccaaacgcaatgcccactccatcactctccaatcacactcccattccccttatatatcacaaccacccacctcaacctcaacctcagaaccagcaccgcaccaatgccattacccaattccaataccatgtgcaatcaaactgcctttcagctccttggtttcaaaaacttcgtccgaaccaatcctaaatcggaccgctttcaagttaaccgcttccaccacatcgagttctggtgcaccgatgctaccaacgccgcttgccgattctcttggggacttggaatgcctattgtagcaaaatccgatctctccaccggaaaccaaatccacgcctcctacctcctccgctccggcgacctctccttcctcttctccgctccttactctccctctctctccgccgcctccgctggtgcctccaccgccgccattcccactttcgacgccgccacctgccttgccttcgctgccaaacacggcttcggcgtccgcgccatcgccttggaagtcgccgacgcggaagccgccttcagcgccagcgtcgcgaacggcgccgagccggcgtctccgccagtgctcctcgacggccgcaccggcttcgcggaggtgctcctctacggcgacgtggtgctccgctacgtcagctacaaggacgccgcgccgcaggcgccacacgcagatccgtcgcggtggttcctgccgggattcgaggccgcggcgtcgtcgtcgtcgtttccggagctggactacgggatccggcggctggaccacgccgtcgggaacgttccggagctcgcgccggctgtgaggtacctgaaaggcttcaccggattccacgagttcgcggagttcaccgcggaggacgtgggaacgagcgagagcgggttgaactcggtggttctggcgaacaactcggagacggtgttgctgccgctgaacgagccggtttacggaacgaagcggaagagccagattgagacgtatttggaacacaacgaaggtgctggtgtgcagcaccttgcgcttgttactcacgacatcttcaccacactgagagagatgagaaagcgaagtttccttggtggatttgagttcatgccttctcctcctcccacctattacgccaacctccacaagcgcgccgctgatgtgttgaccgttgaccagattaaacactgtgaggagcttgggattcttgttgacagagatgatcagggcactcttcttcagattttcactaagcctgttggcgacaggttcctcattttctgcttctttttatttacatttctcttttttatccctgctaaacaactttattataactcaaatcttcaactatcactgaactaatcactcttaatttacattaaactgttccttttattctcctactttgttagctttttttttttttttttttttaatttgattttcatttttttaaaatttttgttgtacaattatattctattaattaactttcaataattcacaaatgatggtacagtggagtgttatgtcagaatggatgtacttgatgtagcagttcatcagagtgtttcccctctccaaattgtacttatgtccctttcatgagataaaaagtttatgacattgaaaaattgttagataaaattgcaattatatcttgaatttatttatcttccgctttgaactgattgaaagtggtaaaagttagattaacaattttacagttggtgtgttggaggatggtgattagttaaatgtgttttgtgttgaattgacaggccaacgatattcatagagataattcagaggattgggtgcatggtggaggatgaggaagggaaggtgtaccagaagggcgcatgtgggggttttgggaaaggtaatttttccgagcttttcaaatccattgaagaatatgagaagactttggaagctaaaagaactgcgtaagcacattggaagaacacaaatactcctttattgaaatgattaatgaggaatcgatgtggcatagggtgtttatactctataatacataatagaattacaaggatagtgtcttcccttgtatgaaaatgaaatcatagaaacttaaactttgatggatagtatttttctattaaatactttgagagattacttgatttgtttcctctgacggatacgaggcgtccccaaccacaactttatctgcctctctgcttgtgaagtgcactttgggggattccatgagtaactcatcttgaatctctccctgttccacagcatcccactttttgcaacatcatatcagataactgactatgtataacagcataataatatgaaaaggatgaacttttttgagtgtatgagtgaaaggaaacgatacagagaaagaaaatgacagatgtaataaataatataatggaaagaaaaaaaaatgaaagtgaaatgaaaaagataatgagtatatgatgattataactcataataatgtcggtttcatgctatttaacataattttttagaagaaaaaaaagtaagttctattcattaatcgctatccacatgatgttgcgtaagatacgcaccaaactgaagtttaatgcatttaattgcaacaagcaacaatcctaactaaactttctagatgtagtgattcttatgatatcacaagttttcctgacacagaaatgataaggaatatggttttgaaccttgcatagttcaaatgtgtttttgtagtgaatccaagttctcatccaaaggaagagaagctaaatatataacaatgatccaatgtaactcgattttcaactgaattacaatgccacaatatttgttccttcacacaaccatggaagtgtacaataatatggtgctctccaacagcaagacaccctaagatcacaaaattcctgaaggaaaaatttcagcaagtaaaatgagaaaatcctcatttgaagtggcattgtcaaactcagttcctgcagagacaaatcaaagaccattacaccagtagaaaaatctgatacaatatataaaactggatccaagtgagtaggaactgcagtgtttagaccaaaagtcttagatatgtaatgagaagcaatacaatacaagtttcgcttgttaatggttggaatgttgtttacctgaatccactgagtagtagtagtcttcaaaatactgcgggaacttgggttcctggtgaatatttcaactaagagccacacatgacacaaagtatataattttcacattaattttaactagttttgatgctaccaacaatagtgcagagagcttctggtaaatatgctatgaatgggataagtagtcatgactatgactcgttatatatatcacagaaaaaattacaagatttttacaaaacaaataaaatacataattttaaatgatttttccgttgccgggaatcgaacccgggtctcctgggtgaaagccagatatcctaaccgctggacgacaacggatttctgtacgagtaggtgaacaaaatagtaactaatgtttatgcatcataagcttgtaatcttgagtcatgagactatgacagtgcagcagtatttgcatatatttaaggtttttaactcacccttagaatactggaatcgattatgccagtaacatataaaaagtatttggcacaattcatcatgtctatttatttttcttttccatcttttccttttattctttttttttcttttatgaattgaattattgaaattctctcataaatataaaattttaatcagacatgttttgtaatttacccaaaaataatatttttacttatagtactgatatgtcaatttattgttgatattgaatttaattaattaatgaaacagttaaacatttttgtagactaatataagtgtatatttaaattaagaaaaaatattatcaaaagtaaatcaccttaataataaattgtttatgttatctatccaaaaatgttctaattgatcatgataatatataataacagattgttgtttactaggcttgttgtccataaggatatcctttaaataggatgtggattggcatagactgtcataagaaactaggcactagacttgttgtttactctcatatgcagatattaattaattacaagaatatccatgttcccctatgaggaatcctagaggcaccaaattccttctacttagccctaggagtgagtgaacaacgaaagacttgtcagggttgatccctcgaatagttttcttagccttctcaccacttgcatatgtcttaagaagacacaaaataccaacattatattcctccagcacaactttcattaggatgaaaagctttatacctcttgtacccttacaattccaacgaaggacgttcattaagaaaaatggttattagagggttttaagcaataaaggaagacaaaatagctgtattgaggccatgtgtgcctacccttgtgtctctagaattggaggtttccttacgacaaatgagttctcttgggatgagctcgaagtaccctaatgaccctagttgcattgctttaatgaaagcccttgtctccgcattgggaaacaccacgtgagtgataagatttttatccaatttcatggtccccttttggctttcgcggacccattttgttgcatgcaagatgccaatagcttgctcctttttctttctcatatacatggaagtctaggaaacatatcaaccaaagagtaaaacaactaactaacaaaaataaaattattattaatttttataaaacaaaaaatatcacatattttaacaaaaaagttacataaaaggacttaacatataattttctcatttaaagaattttttttcttaatatttatcttaggtctcactccattatcctggttgtccattgaattggaatccacccatagaatacttgcttttgttttgatttcaatgcgcctccattttggtctttacctttggaatcataaataaattttttaacacccgatttgttacctaggtaatccttttccacgaggcatttggggatgttctcccctatgattgtttcaaactttaaacaccatatgtctatcaattgtagaattattctggctatcacatttgcaatgaatacaaaattattatagctatcatttgcaataaacgtgacatcttggtactgattcaattttgaatcttaatctggtttccccttttcgatctgttttttttaggagcttcgcattaatggctttcaaaactttaacattgatttttgtgccccttggtgtcttagacacatttttaccctttttaactaccatccatggaccgtataatcccgccttatcttgaacaaattgattagccacaatttgcgactcattaatttgtttagggcttatatgagtatgattttccttttctccaccttcatagctttcatggtagcttcctgctggtgattgtgttgggacatttaattgttgtttgttcaatccctaatgttgcttcactacattggtgaatccactttcatccctcaaactgttagaaaacaaaagttttttttttttattagatcttttttcttttcattggatcctagcttagatttgtgccaaggttttagacgaaaagaaaataatatattttatctgaatatcatttattagttatttgttgaaaaagtatcttttgaataattgaactccatatacatgtatttaatatatatttctctcttccaattcctataatcttcttgaccatttggaaaattgaaaaaaaaaatagtatttaagtagtatttttaattactttcaatgaaggtagtataatatattttctaaaaatggattggccgggttctttatgatcgtacttgccataattaaaatatattgagtgaagcccttcgtatttcaattttagaatctaacccaagacattgattcacgatatattctagctttcttcctaggtcaatttcaacatagattctgcaaaatctccctctggagtgtataaagttagcatatcgatttttaaaatggttcccagctttggacctgcttaccacataagaacttatcctcatataattcaatggaaagacctagaatgtagatataaacatcaaagtctgctaaatatgatataaccattagaggggtcacttgttttaaggaaatatatgtcatgtaatatataaatgggcatctcttataccctttttggttatataatagtaattttgctgacaaaaaaaaaaaaaaaatccatggtccttcaaataggacatgccattaatccttctttaccgagaactaattaaactagttagtagtagtcttgcgacatattgataatgcgtatagttcccattttagcccattctttgggtagcttgtgttcaatcataattaaaactatctttcttcccaaggcatcaacaatatgagagttcttccggcggtcacaccattattcaaattcttccttcgagataggaattattattggacatagttatagctttgtagcatcattattattgtcatactcctaattaccttgtaacatctaccctatgagtgttacgttccatatcatctacaaagctctggaagtttgccacaatctctttttcagcctctaacaaggtatccaaataggactttggaaccttatctttctacatattgtctttgtagatgccctcagtaataacctcatctatcgtaatcgaaccttccttagtcttaacctttttggtactatagttaaaagagtcttcctcttcttccttagaactcttagcaggaaccctagcatagctcttcacctccctcagtcttatgccttatcctttatagttgtatagatgttttcttggctttcttcttatttttaaatgttttatatagccacattcatggcctaattaagaaaaaaatcattctaacctttattagatcataaccgtaacactttgcagttgcttttcaactatataggtaaattttatttagtttcagaatatataattttgtaacttattaatataaaagtatatgtgtaaaaatttgctggcatttgatccttcccttagatgttattgaatttgcccatgaccgatcttggtttactcgttttatctagggagaaattttcctaatatagtattaaaagactacgtagaactcagttttttttatttatctggattgtttacaaagcactattgaattcgggcatgacaatggatgaaaatcgagtttttgctatatagaatttgtggtctccttaagagaatcaggtcacccgattttccgtcttttgttattttattattattattattttcatagtttgagcgtagacttactcctgcaactgcaaggcgtggtcacttcctttttgaaagctttgttagtatatatcttaactcttgtacacctttagcatagttggagaataactctttcatgtgtaaaaacaattaattaagcataaatgctaaaattcaagggttgctttgaattaattcaataatattagtaataataataatacacaatttttccattttacagtagaagtaatttctttcttgattttaaaaaaaaaaatcttcttaaataattaataattaattagccccgcccaaatcaaataaaagaccgaaaaggaagcataaggaggttacttttctgcgcgtaggcatgcttgctaccccatatgtggttcggaagttgatatataaattagtttattggcatggcaaatcaatttgagagatcgagtatatatctgtcaatatcttagtgattgtgacaaggaccatgaaatacccttatgttttgatcatagaagtatgacttcattattaaaataattgatagattacaaaacaaacctaaccttgtttgatttaaagtccaagctggtgtatgcatgtttcaagctatattaatattgtattataagggatgatgttttcagaaatactataacaatttttttttgactaaattcaaaagtatgtttgattaaattttaatattttttaaaatgtttaaattcaaaataatgaaaataaaatataataatagaaatatatatataaagtataattagatttgaaaataaaaataaaacttttctgtacatatactcttatgatataaattttccatatcttattataggaatataaaaaaaaaagatgttattacttatctgaacataaataatatttaagaatactttaaaaaaatataattaacttgtaaatattacacaccaaaattcatatgcataagaataaatttttaaaccttaataaattcattccttgcattaacaaactcaatacattatcaacatgattaaaataaaattacactctaattctttaagcaaatattttatattaaagcactgtggactaaagaacaaaaaaaaaaaatcactaaaaatatttagttagatttcatgataaaaaatgattattaacaaagtcagttgatacttcatagttatgatatgataaataaaaattcaaccgtcaacaacatcaataataataataataataataataataataataataataataataataataataataataataatctttcgtcactctgtactttctgtatatgtacttgatgaaaattaaatagcgtgactcaagcatgccacttggcagatatattaaatggtaaggaattaaatgccaattgcatgccgcaaggacttatttaggttaattaatctcatccaaccagtgaggagccctatatatattaatacatagtcttctgtaagagaaagcaattgcagggaagatcgatcgaaatggaagaaggtcgcaaagggtatgttccagtgctagtgggcaaagggggacacaacgtggagaagatttgggtatccatcaaagcgattcagcatccagccattgttgagttgcttgatcagtctgcagatgagttgggataccagcaaggactcctcagaatcatatatgatcttcacaacttcaaagccattcttcacaaggcttccaagaattgtatctagcaaattacatccatgatgtcttgtttttcattttctcttaattaggacccattctcaaacatgttaatagaaaataaataatcaattttattacttgctcgctgtgcattcaactttttcttctttttctttctttctttatagtggaaaactaaacacaactccccccccccccccccccccctcttcattttctccaaattattttttcttgctaataacatctacttagaaatctgactatttttaatgaatttttttctcctaattatattttttttccactcaaagacttaaacataagattttactcaaagggtccaaatctaattctactcgaatcataataatgttagaaaagattatgtttatttcaagggatacaatatgttttttaattaattgataatgtaaaaacttatctaccaatttttctagatatatttatatataggtaaactatatttgagaactagtaataaagtatttaatgttataatatgaggagggattaagttaatgtaggtaattttaaaagagatattcttcatttgtgtcttttattttcttttaatgaaagggttctaacaagtaattaatatatatatatatattaaatatgatagataattaattaaatttaactttattcaatacaaaatatttattagatttaaaaaatacaatatatatttattaaatgtatgaattttctcataatttatataagtcttgttaaccattgtccttggggtattggttaagaaaataaaataaaaaatatttagtgtaaaaattataaaagggagcaaaaatgatcatgaacaacacaatttttcatctctcaataaaaatattttcactttaaattttttaactaatatactaattaagataattggttaacattagtatttgtcaatctatacatattaaaaagtattgttaaataaaaagtgaacggttttttatacatttattgttgcatttaataaatacaatgaatctacatattattttattacagtaattaatatatgttaataaatataagacatttaatgagattcaaacgtacatccaattgcatgtgttttagaaacagcacattaacaacttatatatatcttaggtgtatttaagttgtaatttgctaaagtgttccttctcacatgaaataggtgcatttcaaggatttgttgacataaacccatttgttttgttggagtactctagcaaagttcatattgggtgtattttaaggtgatcataattataacttgttaatgttttcattttttaaaaaaaaaatagtaagggtatggttggtaaatttctatgcataaatttatttgatttattaaaacgtatggtattggataatataaatataaaagtttcttgtttcattttaaaaatagataatgagataatacaatcaagtaaaaatgactaggacaaaactatcatattttgttgataaatcatgacaatgttttgtttcaagtataaatacttaaaagataaaaaaatacttattttacttctcatttaataattatatttttttatttcttatctcctccctcatagttatcaatgttgtcggcatcatcgttattattattacatttttttattattaccaccaaatcatcgcactcattggcaccagtattattactattgtcttcattttcattatcattatcatctttattattcacaccacctccatagttatgcacttgttttggttattctcattgtggttgtttttactactatcattattattgttattattttcattatggcctttttgttgctaccaccctcaccatacctgtgtcatattaatataattaatatgaaatatattgaaacaattaatattagtaaaggaattacgataatatgcttgttaaaataaaaaaatgtattaatacctaaatagtacagatattaacagagtacttaatatagccaaataatccgaccaatatgatgatacattatgaatggcttgcaccaaattaacccgtcatatatatatatatatatatatatatatatacatttttgtttcaaagtttcaattaattaaaattaggattctcattagttatttctagacatcgcgtgtattcatttgtcttcaaaaagtcaatatcaaaactcacttgtagaatccacaatagaggatttggttctaaatcttaattagatattcatttagaataaaaaaaggaaacatctgatcagttaacatatccgaaataaaattcactgaccaatatttgattcaaattcgttatctataacttagggcattttaattatttaatatagatatgtcatatatattcctttttaatgtggcatggctattaaaaattttgagcagcacattaatcaccgagagaaggtgacacagaaggaagaaaagtccattgattaagttagggaggaaaactgaccaaacagaagaagattgagggccttggtttttgatatgttagagcctagaatcactaggtcgtcggcttagtggtggagggcttggacctttgaaataatatgtctgaggtcatagatttaaacatcagtacgatcattgtaaaaaaaagaagatatgttagaaccttcaacatgctcacgaggaaacttgacatggtttttgaaccgaagcttgctgcagaattttatttgatcaccaatgtgatttttgagtctgattgctttcagcttgtgaatagcaggaatagtccaaatacaaattaaataacaaaagttattttgcaggaattgttgcagattgcaagtatcttagtaatagtgccttgatataaaaaagaagaagaaagtaatagtgccttagtttttacaaaaagaaggggaataaagtggcacatgaattagccaaattggctttcaattgggagatacattttgggtagatgaggtcccaaaacaattggaccttttagttttatcttatgtacgtacagcttttatcctctgatttataataatatattcctattctctcttcaaaaaaaaaaaaaacaccgagagcaataatatccaactttgacggcatgcatgattttgttgattaggaagtagtttgcacggctcaaactactaaaccaggtaggatttttaattatactttttcttataaaacttggcatttccactttcattgtgatataaatattcccaatatcactgttgtttctgctccagatcgaaagaaggccatactgatcagtttatcaatttgatgctcaaccgtactggttgtcctatccatatgggatcttttatatcaattgatttaataaaggaaaaaagaaaagcacaatgatcaaaagagatttataacactcatagatatttgttaaaacaaaactacgccttctgtgtggactttatcaacatttctattaagtttatactcttgcaagaaagagaaaaaaaactaagtgaaatgagtataaaatattacgcaaccgtacgtgcatattgatatagctacatgtgtgtgtgaccgatcatcccagacacacacatctatatatactctaatatatatgtaatatgcccctgaaaccctagatttggaagtaatttgtggctagaacaatgttttttagttttaatgtataatttttaacaaatcagtaaataaaaatcttatttaatattaaaattaactaataaaatattaattaaaagtataatatttaactgaattttaaaaaatttaaaagtatattatttaaatattaattataaaatataagaaatacgaaattttatatttacattttatgataggtgttaatttgtttagggatgggataagttaggtatgataccatttttttgcgaataattatccaaaccaaaattcgacccttattaattacataaataaaaatcctgtttttattattattgaacataatgaaaataatatatatttttacataattaaaataatatcttattatttaataaaattggtttccatgaaaatgaacaaacttgataaaaacagattttaacattaaatttattatttacatatttttataattgttctattttatttaagattattctataattgctgcgtttatgtattaaaaataaatcaagagtcttaattatttaattagttataaataaatataaaggtaaaattataacagtacctacttgcaatttctcgtacacacaaaccttaaacaaagatttatatgtaagaaaaggatttgcattaaattcacctaaccatcctcttttattaaacgaagatcaaatgaagatttctccgttatgagacaacagatacttaaagaaagatagggcctatataaacaagaaggtttgaagactgaagcaattgatctcacacaaatttttttattcttttctccttcaacaagactctctttatattatattgtaagattaaaaaaaaaaaaactctcaaaacaccttgaatatcatgagagaaaaagactaagtgttgtttttatttatgcgtctataagacgattctattttagtcttcgaacaatcttcgatcataaattttttctgatttgtttacagccaacaataacttaataaaacaaagaatattgggtgttgatcaaacttgggatagagtttaatttgtaagagaccgaatacttgtaacttgtgaaaagttaatagaacttggtagtttaccaagaactgaatcagtagtagagattaactaatataactttatgcctgtatatctttacttttctatttgttttcttgcttttaattaattgagtttgaattatgattaactaatataactttatgccagtgtatctttacttttctatttgttttctgcttttaattaattgagtttgaattattttttagttgtttaaggagttataattagtttataattgttctgttctattttattatttaagaaaattagtttccattacaagaaaaatatgtattaaaaagttaaataataacaatccatatataaatattatatgtgagtattaatatgttaattttaaaaatattttaagataaaaaaataaaaaaggcatttgaaaaagggttcaaactgattttctttattttttataattagataatgtgagaatttaatttaaaaatgtacttcaaactgtaagtatttaaagattttgtctatcattagtgttatgactatcagatttaatgcattatctttaattctctttcatatcatatatatttttcttatgcataaaattaaaactttataattattaattaaaagaaataattaaaattataataaaatacatgaatatatgtaataaaattataaaatattaaaatcttaataattagtattttaattatttataaagaaaactatgttctttattcactttaggtaaatagttatcataaaaaaactttaggtaaatagttttcatatattttaattttagaaagaaaaaaaatttaatttattgaaatatataaaacttaactttatctatatgcaaaatgagattacctaaagttttttttatatatttcaatcaattttaaaaatgtagattacttttttaaagttaaaataaatgaaaattagttatctaaagtgaataaaaaatatagatttttataattaattaaaaataattattaaaatttcaatattttataacttgtttacatatatttatgtattttaatataattttaattaataattataaatttttaatcttacacataaataaaattaatgtaatacattaaatatgatagttataacattaatgataaaattgaaaacttaagataattgtgtaatttctattgctcatcaaagacggagttgcttaaccccattttcatttggggtcagttaaagaaatcctttttttaattacataaaacatcttgtatatggggttaattaaccccaaatttcacttggaatatgttacaaatccctttaaaaaattattgtgaatgacacagtgagatcgtcactaaattggaaaaagaaatacattcacgataaagttatctatagttattcatggttttttaatttttaaagcagaattgtttatattagaataggcgtaaatgcaatacaactttatacatcatgtaaatgttctttactatatatgtgtctggtttttatttatggaagcatttctcctaaaccgaagacccgtagaagagcagaaaggagataaaggaaaccaaacaagtcacgaggtgggatatattactggaaaatgacaatcatatctaatagcatacgttgcaccaaactaagatgccaaagaaatacacgtaacatgatattctagtaaatgtggcaatcaaactcccaccatggcatagcaattagctagacgacaaccacacactctctaaatatgtacctacatttagatattgttggccaaatattatttattagaggcatatcctttgctttggttttgccttctccatccatggcaatgaaaatcgtgaaccacgaaacctttcatacctgcctcttgtcacttcctgtgactgattaatgccgtattctagtagataagtacatctacacatttagaaccttctcatcttaattggtatgttcagtccccttttcaatttgcatcagcatttgattccgcaatattaggtaaatgtaattttcatgtcatggccacttttaccgcctgcttatcattgttgggtgtgtatatatatgtgtaacatatatacatcctttcaaaatatgtaagataataaccttctcattttgtaaaccagttaattgcctcattttcctctgcttcattccccactcttccatatatatatatatatattatggccttatatgacaacaatgatatgaacttagaagagatagatttggaggtctttgaaattgatgcggccatcctaagagaattgctagaagaagatcaagagggcaaggatgataataaggatcatggtaaagtagaatgcatagtagaatccgtagaagaaaacaatgctcatcctgacatgatagatagggagcaagaacagaagcagcagcagcagcagcagcagcagaactgtttggagaagtatgggtgccatgactttgagtggctcaatatgatggagccaactaatccactgaatgatgtgagaatgaattggttttcagatgacattgttgggatggtggattttggttatgctaatgaagaatgttactctcaaatttgtgatgggcttgtctctaatgaggcaagttatggttttctgtgggaagattatgatatttaggtgcatattaaagtttacctttagctagctctagaagagaagaggggaaaaggggctaaaatagctcatgtgtgaaagaatctggttagtaattcgtaaattgaagaccaagttagcagaactacatgtgtaaatgctgtttgggtcaaattctattaagacataagtgaaagaaaaagagttataataattagtttaaagagtcgatttccaaattacttgcagcatgtctacgttaattaattatccatttatgctttccttattttttccatctctttcattctatattctgcatgatagttgagaaataagatgaatgcttacaaagtaatagtaaaatagagggaccttgctttgatgcctcattcaggacaatatctacatattaggacctatttggctatgtagaattgataatgtgataactatatgaatcaggattattcagtggttcaaagggatgagtcaacctctagtatcaggaagtttagaacaaactcatgcatagtcaatcaattggattaaatctctgaatggattaaacctctgaattgattactcaattacatcattgtaaggttgcataaatgcctattttgtgattttttttaatggttttgaatttttaaatcttattatccttaccctttaaatttttgtagtagcgtttggttgacattatttgggaaggattgaggtgagttatcagagaagttgttagactcacgataaatgtgaagaagttattaacaacgtatttgatgaacataaaaaatattgacaagttgataattacttaggcacttttcccatatttaaaaagtttgaagcacaaagaaatattatatctaacattgaaaaacagtaataaggcttgggaattgccgaaatatatatgtacgctctgtatcttaattatgtatgactcgagtgttccatctaatcacattagttatctattacacacgtaaagttacgctcaatgagtttcaaatgagttacaatagtttaaacttaaaataaatatttttaaaataattactttaaaaaaaagttattcaataagcatataagattttcttttcaaaataaacaaaaaaaaaatattttttttaaacagaaaagatttaaataaacatacgaaaaaaacaaaaaaaactacttattttattaaaaataagtatttttaacaaataaatttaaacaaattaactcaataagtttacaatacatgggtacatgcacagatgcaaaatgggagctacagtacataacatcatgaatagttgtcaacttattcgccgtccatcttgattgttgaaattttcttaattcattttccaaatggacatatgtgaagctctcagactgtttccagaggccaatcataaaaaaaaaattgatggcttccttcagtggcaattatgaagtaaacatatatccacgccaacacctcatgaatagttgtcaggtatctttagaccccgcgagaaatttggcaataaaaaatccaattgtatcaaggggagatgatggatcaaacctctgaacaaggtcttcctcccctggtcgtaaccactccctgcatagatatcatggtgtgaaaccaaaaattggcactgaatttttttatttattattttggataaaaagaaataaaaggtatgtccacaaacaataataaacagcatcacagatgagtgtgtatacaagatcatctatgtaagggagagataaaaatgcacaatcatggacaaatggatgaagggcttactctatatatccatcaggaaattcacagctaccaactagacccggtcctccaattcttgggtaatcaaatagtaaatccgaataactcaaccaagtgaactaataattcattacagaaaaactaaacatcaaaatttgtttgtagtcaccacttacccatcttatttataaattgtaagagggatcatccttcaattaattacatatataatcaagatagtaattcagcccgagaaatattgaagcctaatcaattcaaaagaataaaaataggaaattcggactgcaaagaattagcatcaaacctgtggtgccaatgacagatatttgtatttatccaaagcatatcgaactaatgcttcattctcaccaggattaatcgtacaactgttataagacaatagccatcaacaaatcagtgttaaagaaacgtctcaaataaaacggggtaaaataaaacttcagaagtgcccatccaaagataacataatggtttgaggcagcttaggtacaaaacaaacttcttgataattgaaaacaaaaaatctcttaaatctttcttgtattaagctgtttggctggaagcagattccgaagaagcaacttagacactaaataaaatatatttcagaccattacaaatacatttcaaaattactaatgtcatgtttagtttaggtaagaaagtgaaaggaaagaaaggcgaagggaagaaaaagaatggaaagtgagattatttttttggttgtttggtatgagagaaagtgaaaggaaagaaacatgatcacatgttgtaatagaaacttgtgagcatgcacagaaaaatgtgatcaacaaaaatgcatacttacgtggaatagacaattactcctccaggtcgaactaattgaacagcctggtcaaacatccttctctgatattttgcatgatttcttaaagattgaattgtttcctgccaaaaacaaatggcattgcatggttattcctctttttttttttttaagcaacttttttgtgggttaaatttttttatataaaaatgaacaataaaaactaacttaaccacccagagatgatgactatgcatcacattgaccaatatataattcatgctgacaatttcacaaattacactttctgggcaaaaaagggtgaacttaccatagaataatttttttccccaatcacattgaaataaccattgcttctacacattcctgtgtttcaggcaaaggttaagatatacacttatttgtgcaggatttagtagtaaaaactaatggtggtataaatcaagaaaagaaaaatgagaacacaatttcattttaagataagccagtagtccccgtatcctatctatatttgcaccaataaatctagattggtctaagcatgtgtgtgtaaattcaagtaaatgcaggataaatttcaatacacagatccacttctacctctccagcaaacaatcgaggccttaaaccaagggcagaacagggagcatcaagaagaactctgtcaaaactgtcaggagaaaaaccttttgaacgatcaaccctaccacccacacactgatttcttccaggtccattttgtgctcttcgcatgttcttccggatgtcagcttttctaacataagctcctccatgtgtttttttgcctttacctttaaaaattatttaaaaatgcatttgtaaattgttgatacagaaatgcttattgtgtatataacaaaatataaaacaggaaagtgacaaaccatagcacagaagaaatgagccaacagaaattcaataaatctaatcaagcataatatttgacatcattattcactttccagaccattttttaacactaaatgatactatgatgatgaggctcatgcaacagagacaaacaatgattcacagttctttcttttcagctgatgtttttctctttcatcttgaaaatataagaataagtttcttcgatctttgcatttagcaaacactactttcaacataaaacagaatgttagacaataaaagcgattcgattagtgtgattcaatgtataattccaatgcactagagttcagaatattcaccttattatgagatctatctgttgcaatgatctctccttcgtccttcataagtattgcaattgcagttgttttccctccaggtgcagcacacatatctagtatccgctcacccttttgtggatctgagtataaaaaaagaatctatataaagggaaaaaaaattacaaagagatgagaggataaggaatcctcaatccttcttaaaataagaacaatagtaaaacagcaatgaaaagggaaaaaccaacagagcaaagtaaacagagtgcagttcatatactccatccttcatatccacaccaactccttcagaaactcggaacatcccagcccttgacaacattgctgttccttgcccaatataaatcccatttcgttcaaaataataaggatctgtaaaacaagaaaaatacaaaatcctatcaaccatattccaaaactttacttcaacagaaacatttatcctcctcctaaacaaaccattttgattacaaacaaaacatcctttgcttgttttctacaaagaagaatctactcatgtcttactatttcaaactctattattagaaaatgttaccatgtctctttgaaaatacaatttcatctcccggatggctatccaattatccactgatggtttttcaggttaagcaattacgtatctgattggcaagtttaaaattaaagtctacctaaacatctacagcattcagacacaaacacacaattgttacctgtctcagatccttggagaacagtgccacgcgtcatagcaatcccccatcctccatcagcaccctgcttctccacagcaaccgaaaccgcaactgtatctcctttctcaacatgagcactgcaagccatcacaccaggaacatacatctaaaagcaaaactaacattaggagccaatcaaattcttcaccataatctgtaatctcccaaacacaacatagaatttggcaattggcaaagatattactattcactaacctgagcacctcgaagaactgcctcagcacacttcctactaacaatgacttccttcggaggctcatcgcggtacacgatggggtgcggtcccgaaccccaaacaaacaccacataatcaagtccaggaatctgacacttggaaattggatcagcagcagcagcagccgaacactccttcaacggattcgccacgtcatctccggaatcggattgcgccgatgccacgtcagcattcggcacgagcgaccgtaacttgtcgatgacggcgtcgccggtggacctgagcgtgttgactcggatgcaggagtagcgagaagggcgcctgcgaattcgaaagctcaatcaaaattaaaagttgcaaccaaaataataggctttgagggaaatgggaagagggtgcgtagtgcgtacgttagcgcggtggagatgcgagagaagtggtcggcgccgtaggctttgaggaaatactggtgaacttgagtgttccagtttagagtgggggtgtaggagtatctgtttgaaggatcggaatgcgacatcgtttgctggaactgagtgggggcaatctgtgtttggtgaagggttctgtaactactaaccaataattccctccctttcttcattcaaatgggggtggacatcaagcacccaagtaccgccacgaataggtgcgatggccagggcttcaaggtctttcttcatggataaatagttattttcatgtctatagaggaattataaattcgtctcaaaagataaaaatatggctaatgaaagagcatggcacattagagacaaatttgtcaatactttatatatttagaaacaaaaatagttatttatctaaaatataatttaatcttcatctcccctccttttttaatcgttgcaagtctaatagtacaataaacacttaaaaaaacaaaaataagttagaataaacataatctgtatgttgttctgaaatttctattgtgacagtatcttatcaaaaaatgagactcaaacaaaaatgcttagattaaacaagcatttttgtttgaatctcatttttgggtaaggtattgagatttcagagcaacagatatattatgcttattaattaatattattatgtttattctaacttatgattgcttttctattttttaagtgcttattataatgttatgcttggaacaattaaaaaaaagataaaaattaaattatattttggataaatagtcattttcgtctctcaatatgtaaagcgttgataaattcacctttaaatgtgttaagtagattctttcattaactgtaacggacgaaaattaacatatggatggatttgttacactttttttagtttcggtgactaaaatttaaattttcatctttcaggacgaatttcttagcactttacacatttatggacaaaaataactatttacctaatttaaaatataaatactatcaatgttattttgtttagttctttaaatacttttgtttcgattttagtccattttttaaattttgttgtgaattaacattaattgatctgacgttgacagtcattcaagaaaaaaagtacattaattattttatcaaattccttatttgatgacgtgataatttaataagttgtcatgttatcacttgataacaaaaattaaaacaaaaaaaatacaagaactaaaatcaaacaaaaaatatttaaatgattaaaaaaatatcatgttttgacgggactaaaagattatttaagctggagaaatagatttcgttcaagaaaacatactgataccaatatattaatggaactaggcttatattttaatcagatttcaagtctaagttttgtgaattaaaaaaatatagttgataaaaaagatccatgtataggtggtcaattaaattcttaataaagattagttatttttaaagttaataaatatatcatactaattaaatagtgacaaaaaataaagcataaaaatattaagtttacaatatgaataaaatatcaatctaacatattatacctccaactcaatgcttccaatttttttttgataattatcctgttcatgaagagaaagattttgactaattcaaaatttaaccaaaagataaataaaatttggttaataattatttttgtcaaaactaaatccgaataatatccaaatgattcaatcttaatttaggtatattaatcacttatatctaatctaatcatttccatggtagaattgacatgctttttaaaaaattggctataatcttgcaaaatttccaccttattctccgctgattgtgctgaccaaactatgtacagggacgagttcttaaccttgccatatttggattttttttttcttgaaatagtagtgactgctgcagctttgagtgccacttacattctaataactgaagttgatgttcaagatgtcaattctctgggtcatgtgctgtatacgagaacgatagagttaactgaaactatagtctctagttgggcaattcaatttaatgatggaaagaaatggaaattaaacaagtattgatcgtatttataggataaaaatgaaataaatttagtttgttgactaattttaactgccgtaactttaggacataaagagttgattgaatagatagaggtaaatttaagttgtgataaattacaattttttatacaataaaaaaaaaaaatcttcgaactagttcagaagggtgataaatattaattgcgttatcatgtgttcttctgttccagataagctgatgtaatattttgataaattttccatttatgaataaaactagaaaacgacttcaaaacaacggttaatagcggactcattcaaatacgtgataagaataagatagagtagaagaaagacagacattgctcgtgttgtctacacatagatagatagaatggcaattttcatagtccaagcaaatacaatatgctttgacaaatgagatcaggtgatattcattattcatgttgtgggtgtttgattctactattagacttcttaatgcacaaaaaatgaaatgggtgaataggattcggcataaacaaaaaatgaaatgggtgaataggtttcggcgtaaagtctacattttaactgttaagttttcttagaatatttttaaaagaaaataaaaagaaaaaaatgaaatgaatttttttatgaattaaaatgagtttttcattagcttatttgtagatgtcatctcatcttttagagaagttatattgatgtatttttaaaaattagctaatgaaaaatttatttttatttatgaaaaagttcatctcattttctttataaatgtttctaaataaacttatccaaacatatctataataatagtcaccaattagattaatgtctaggtatgatggtagtatttttttatagaaaagattttattaagaaaataatatatagtatagcctgtaccattaatacaacactacaattagtacaagaaatctacaacaataataaatcaacataaagtagaaagtaattgggttgggtgtggacgtcgaataagacgtggttttggctaaaggttccacaaaccactattgtcagtgcaagtcacaagtgaaaaactagagaagacaataatcgtacagttagatttcttttatttaattcttcacggaaagtgtcactacccactagcgaaatgatttcgtgtatatttttctttcattttaagctttgtgacactcaaacccacacgagtcatgttatagtgcacatctatctgatcgatatatgaaaaaacttggaagttatacagcataaacattttttttttctgtattcggagtgaggaagtatcacgtggaagaaagattacaacatggtacagtaaaatccaagaattaataaatggaagagtctatcacttttcaaagtactagtaacctcttcctaccccggcgcggataaggaaaaaagacactaatttgatgttgattcttggcacgtatgtttgcatcgaatttcaacaactatgctaatttttctatgatctcaatgttccttcacacttatttgcctagtgattgagatttctgggtattcacaatcagttccaggaacccattttgcacgttacgacaccataatcacgtattcacatgctccaaccagaaaactgcctcggtgtgcagccacacccatagcaatatattccatttactctcttttcttttacatcacattaattattgcatccataattttctcttttcagatcatttcactaagataatgatatgttagtagatacaacttgtataaaataaaattttgaataatatttttttcaagttgtgataataaagattttaataatttaatgttacacgatttgataacgatataaaaagttaatagtatgttgaaattaaattatttttttacctatctttcaaatgatctttttaagagaaacttattgttactagaaaatgttttatttaaataacttttaatcccttaaaaattgtaatttctattatatatctcttaaattttttcctacatatacctgtataaaatatattttttgtctacaataaattttccatttattgttttctcttgaaccttttaaatatcaagattttttaaattttattattttaaataattaaataaaataatgatatttaaaaagcaataaatgatatacttgtaatatttaaaagaatcaaacaaaaacaaaaacaaaaaactatatacctaatagaaaaaaaccaacaaaaaataataataaaggaatcgtttactaaaaatacgtttttattaagaaatagttttaaaaaattaccatgaggaactaagcaagaaaattacacatttttggggccctccctttggcctctacttggcacattattagctacactttttaaaatacaaattcaaacccgataaaaaggggtcgataatgatctcattctcctgaatcactattatttactttgtcaacaaattctttagcattagttttcattatttaagtcacaaaggtggatttgtctttctccatgttccgttcaatagatgacgactggttcaaaattctgacagctccaattttgtttttttggatcatgatttatcaaacaccatgtctttgacttttgctagttgcagccttgcgaggcaaaagtaatatctgtgacacaatcacaagccaaggaagcaggaagcagagaggaaaatcctgtgataacaataccagaccaaacatcatttattatttagacttaaatatgatttatctctaagataattattttgaatttctgataattttttgtattaaatttaagatagtaattatatatcaaaatttttattttaaatcactgcgtgacacaatctcaacagataatagatcaaaaagatttgtcatacaaaatgtaatgtctcatatatattgaattttaaaaattgtttctaaaattagtataaaaagacgcaaagcaacaattttaggtgttaagattgatgcacaccatatacatcttaggtaaaataagtgtgtctttgaatagaagattgcaaacctagatttgtagaagtatcatcactcttatttttacttttaacttacttttatccattaaatttacatagagtgcacacatcatattttcaacttaaataaaaacacactaaaaaactcggaatgtaatcctaagtctcttcttttgaagtactgtatgtaatcctaactcggaggtgtaaatagtttgaaataatgctatccgtgatgagaaattcacttcaaataagtactatatgttttctttatttttaaaaatggttttccaaaatgaaaattctacacaatctcttttattagaaactttataattcattttaagggctgataaaatatgataaataataattagtgctttaataacattggttaaagaatttaaaatcaaaataggggcaaataccaatataatttcatatatctctttaaaatattccaatttggaaaaaaaatggatagacaaaaaattatatcatccataaattttcttataattttttatgatttatataataaatatttttaattttaatttcttaatcaacgagagaaactcagaatgctgatcaccaaaacccataaaatactaaggctttattgtgaataaaaccgcgttgttgggatcaacctttgacattaggcttccaagtctttctcattcgttgttactaataaagtcacaccaccttgcttttcaatccttctttcttccttctctccgtcaaaaacaattcccatctgccaaaaccaatgttttggcctcaaaactcataagttcacattttttttttcttcatttccatttactttgccaatccctcatcttcattcattttcctcttgttttaagattttgcttctgattgattacctttgagataaacttgtgaactcagttctttctttgaccctcttggctaagctcagaaatttccataaagaaatagattttctccctgaaattctgttaggtgcttgatcttggattttcattgggtccaagaaagaagatatcatcgttactatggttttgaaggtttctctcattgtggttctgcttgtgatatgctcctgtgttgtggaagccatttctaggaatcacaatcacaacaatatcaacaaaaatggatcttctctggctgccataaagtttcctgatcatccaagtttcaatgatgtctcttcttctggggacaatgattgtagcttctcaaattctgagcaacttgggcattctgtacctaccaggacatcaggtgaagaaactgatgaagagagtgaggcttttccagcaccaaaaccacacaagaattcggtgaaactccacttgaaacacagatcagggagcaaaggtgctgagcctaaaaagtctgtgattgattccacagtaagagatttcaccagaattcagaaccttcacagaagggtcatagaaaagaacaaccaaaacaccatttcaaggctgcagaggttacagaaggagcaaccaaagcagtccttcaagccagtggttgctccggttgcttcaccgactagtccagtttccgggcagcttgtggcaaccttggaatcaggggtgagtcttggctctggtgagtacttcatggatgtgtttgtggggacaccccctaagcatttttctctgatacttgacactggtagtgaccttaattggattcaatgtgttccttgcattgcatgttttgagcaaagtgggccatattatgaccccaaagattctagttcttttaggaatataagctgtcatgatccccggtgccaattggtttcatccccggatccacctaatccttgcaaggctgagaatcagagttgtccctacttttattggtatggggatggttccaatacaactggggattttgcattggagactttcactgttaatctcaccactcctaatgggaagtcagagttgaagcatgtggagaatgtgatgtttggatgtggtcattggaatagaggcctgtttcatggtgcttctggtttgctaggattggggaaaggatcattgtcatttgcttctcaaatgcaatctctctatggtcaatctttttcctattgtcttgtggataggaatagcaatgcaagtgttagcagcaagttgatttttggtgaggacaaggagctcctcagccaccccaatttgaatttcacttcttttggtggtgggaaagatggttcagttgacacattttactatgtccagataaattctgttatggttgatgatgaggtgctgaagatacctgaggagacttggcatttgtcttcagaaggtgctggtggtaccataattgattctggcaccactttaacatattttgctgagcctgcttatgagattatcaaggaggcttttgtgaggaaaattaacggctatgaacttgttgaaggccttcctcctctaaagccatgctacaatgtgtctggaattgaaaagatggagctacctgactttggaatcttgtttgctgatggagcagtgtggaattttccagtggagaattattttatccatattgatcctgatgttgtttgtttggctattttggggaatcctcgatctgccctttcaataattggaaactatcagcagcagaatttccacatactatatgatatgaagaaatccagacttggctatgcaccaatgaagtgtgctgatgtttaacattttttggggttgaaacttgaaaggtgtatactgtatagtctcataattgtaaacatggtgagtcagggggtagattttttggttttcccttaggtagaaattggaaagtgatatacaccaaaaataaataaataattcaaagttgattatagaactaggttccaggtaattacagaaaactggatcattacaaacataaacatttgttttgtacacattttgactgctcaattttgagcttgtctcatttaattttaatatttgttctttctatatatgaatatatgatgttctctcttactatcattctggacatgttattgttttgtatattcattattctcaaaggaaaattgctccgtatatgtgtgtgtgtatatatatatatatatatatatgcacacacacaagaaataaagaaacttggcaatgaagttctgtatcctgagtctccaagtcaagggggcaataacagttcgtggtttgctcattgttactatcctactttcttgtagactacatcctttaaaatttatacttatttcctcttttaaaatacttttaaatgaaaaataaatcaaatggcacatggacatggtcgtttcccatatgtcgcatcagtgtattattccatggcttttctgttaggatacactgccaactttataagaaaaatggaccaaagaataggtcaactctattgttggcctaggtactttgacattaatctaaagaataatactacctacacgtcaattttatatgataaattttacagtttacaagaaaaggggggaaaaaagggaaaagtattagggatcacaatccttctgcccaaggatgtatctctgtaaccaaagaattaaataagacaagttatgtgataaaaaaaaacaaattataagaagtgttataagcatttattgtaagtgtattattactacaatctagctctctcatttctttctttgtttttttcttttgctaagagttatacttttttacccttaaaatagagtctttttatatccttattttgttcttttgttttatattgtgagagacgtttttccttattatgccgttatagtaaatggtaatgtttataggaatttccgaagaggaaatagctccatcaatgtagattttataagtttctcattaaaaaaatataagttttatgtgtaagcttctgtttaataagatgagtacaaatacaattatttgactgtcgtcctttgctgaattggtctgtatacttaaacgtaaaatttgcagtttgcctacttccataaatgttctggtacattttattctttttcatagttctgcatcggcaaccagtatgaactatgaagcctatatttaagttttgagtgaataatcatcgtagactattatcatatatttattttcctccaaattccaagcaacaggagtacaggactattttgtaaaaaaaaaaagtagtacaggactatagttattagtttattctttttttggtcatattcaaacctaaggttaagatatgaattaagtgggtattattttcaactcgagagccgtgttttaccctgagcatattttgttagagtgtgacatcaattaggtgaaagaattttcaatgaaaattttaataaatttatgcaccttgttaatatagatttgcttacagagagtggtcataatataactgtgtctatgaccaatggtgacaaaaaaaagtgagcgaatatattaagggtatgttagagtgagctatttgcgaatttttttttttttagtgaagttgattttaaataaaattaattttacaaaattaatttgaaatgaaatgaaatttaaaatgatttgatttgttttttagtgttttaagtttaaaaataagttagtggtaaaacttaggttaaatttcttagttgattcttaaagacttcaactatttgggatttttaagtaggtctttatttttaaactttggtcttaatcatgtaattttttttaactggattcttaatgatgaaattaatttttttatttataaaaaagtcaaccttgagagcctacttttttagttcaaagactttttttttttttttttttatagttgcacgtgaattgtgatacacttacaagttacaaccactcatacaactctctctatgacattattcattatattttacaattcttcttcttttgtactatttgttgaatgagttgttatacaaatattatttctcaatcaacaatagtggatggtgaaggttggtgagtccacaatatagaggacggatttaaagtgtatagtttgcatatgctcccgtgtgggtattgtggaccacggatttaaagtgtgttatttgcatattttaaataagtaattatatatgaacccttgtatatcaaataatttattaatatttttttcttttatattatatcatttgacatgtaaaagaaatatcatatatacactcttttttctcactaggaggtgtcatataaatgttagatgtttatgaattattgtcatacttaaataggtctgcccaagaaattcaaaagaggcccaagtaatctatttttagacttgatatttttaaaaacctaacttgcaatttattattttatttaaaagcttattttattttaaaaaaattataaactgtaaaaattaaaatcacgactactcaatacacaagacaaatgtgaaaataaataggttagactttataagataaaatatgaatctgacttgtctacatgataaggttgtttttaaggtataatatgacctccataataacttatttaataacacatgaagcacatttcattaaaaaaaaaaaaaaaagatgaagcacatgtttggtttggatgcgtttttaaagagatgattttttctataaatcctttatagaaaatttgtaaaagatacggttttatttttaaaataagctgaacttaaaatgacttctaagttctaattgtcatagtacataaattaaacagtcaatctcaataatatttgtaaatttaccttgtgtaaaaaatattggattgattttagattgtaattttttttcattgatttctaaggaaaatgatacatatgcccctggagaattagaaaaataataatttgaattggctttatgaaaggaaaaaaagtttactgttgagagtgttagtcaaatgtaaaaaatggtcaatctgagcctggggtttcagttgggcccaactaaaggaaggcaccggcccattagggttttagtttgcatatatgatcctttgttgattagctcgtagcagtggaacaacagttgacggaagcaatcgaaatcggcggagatggttgccatgagggtgggtaatgttaatgttaatgttaatggtttttgtgttttatttagtttgcagtgtgagttggtgtaatttaacatgtgaatgtgattatggttgaagcagtttcaccagtatcaggtggtgggaagggctcttcctacccattccgatgagcatcctaagatctaccgcatgaaactctgggccaccaacgaggtccgtgccaaatccaagttctggtatgtttattgttcatctctagttcaaatgttatttattcgtattcgtactaattcaataataaaatgcagtcttttctatttctgatttattgttattattattgacaatgttaatgttaattgtttcaggtattttttgagaaaattgaagaaggttaagaaaagcaatggacaagtgctagccatcaatgaggtgtgcacttctcaattttactagtatgtttctgttcgtctcagaaatatcaattattgcactacaatgaattacttttgagcgctagttacttgttaaaatgattttaatgaggctagatttctacgttgaagaattctagaggattttttttttatatataaatattatacggctgggcttaacttgtgcattaaatttgtttaagttatgtagacatttgaagaacggtagacataatgccacatgtagagaccctgttaggtgtggatttgactacgggaagtcatttatgcttaactatctgttgggtagatcacattatttctctttttctgtttttatttttattgactatggaagcaaatagttttcttgtcaatttttgccaccggtatgatgcaatctagtggcgtaggtgtaggactgtagataaatggagtgtactcgagtcatatggtgcattatttctgactaacaacctaacattagcacacaggaaatggtaaatgaggtgaaaggttttgaagtttggacatttggtgaattatgatcttatgaaagcccttttaggaaagaaatacttgaacaaatatttgtattctaggttcattgctgtcttattggacaatggacatggaggtttgagtgtttgtactgattgcagatttttgagaagaatcctaccaagattaagaattatggaatttggctgcgttatcagagccgcactggttatcacaatatgtacaaggaataccgggatactactctgaatggtgcggttgagcatatgtacactgaaatggcatctcgtcatagggtgaggcatccatgcatccagataattaagactgccaccatcccagctaagctgtgcaaaagggagagcaccaagcagttccacaattctaaaatcaaattcccattggtgttcaagaagattaggcctccaactaggaagctgaagacaacatacaaggcatccaggccaaacctgtttatgtgattcagttcatggaatttccctgcttgttgattcattaagtataaataggaagagcttagaggtgatccatgtagtgacaaacttcgttgcctgcaacatagtttgcattctttcaagctctgaagattttgtttttggaagatggtgttttatttaattttatatttttgcagagtaatctattttactcattctgatgtattcgataaaggttgcttttgaatttagcgattacttttggtttatcacttgttagttgatatgttctctctgatttttggtaataaatattttagaccaagcatggcttataaaggacaaagctttaagtgtacaaccttgagtgttttttgtgtttttaaaatcatattgaactttgatctcaaatttctacattgatttttaatgcagactatttatgttactgaagtgaaactgcagaaaacatgaaacaccttagcaactgcacctaagttttgtttgtcaataaacttgatttctttggaagaaagataaacaaggcatgtgttaattcagtcattgccgcttcggttttcattttaaacttcacagtagggcctcacttcattactatttattatctagcttattaaggtagaagtaagaacatgaaatttaatgttaaattttaagtaaaataattaaaataaatgattaatattggattttaataaactattttgttaagttgtatgacaaggatttaagttatcttaaaagtaatcaatattgtaggctggataactattataaatttgttttaagattcttttacgtacatttacgcactcttcatctgtatcttatgattagtgtgtaacttcttttaaacaattaaacgggtatactttgtgcttgtgcatactcctgattgatgacgaactacatcatggtcttagtcaaaattaaatcgtttcaatttgctcactggtgtaattaaaaaaagcttttgtattattagtttattaacttttgatttttattaaatgacaaaaaaaactcacttggtaacttgaactaaacatgttattacttgctgcgcaggattatcctgtcgctcgtaagcgaatttacatttactaaggaacacaaattgaagaatgctataaaagtaattaactaagttagtaataaaaaaaaagtaaaaataaactaatataagcaacggtgaagggttaacatgagggaccacgtgcatctacaccttttacggttcagcattaacacttgttcattattctattcccagtgtgcaagtgcagatataattttaactcacaatgacaaataggttatatgagttgtgactgtcttatttacagtgttttccatatcccataatcatatttgtgacctaccattgtcatgcagatgcaagcatgagataaaaatataggaaaaagaatactgaaaaacttctaattgcaggtctggtaataattagagggacaacgttgaagttttggctcaaaattttaaattatgtgaaatgttaagcgtaatcacaaagaaagggctgatgtataatttccttgagatggattggtcgtttaaaatatggaaaaatattaacctcgaagctgcatgaaagaaatgtgatttgatacgaacaagaatgccatgtctaaaatttaagaaaggaaataacctttggtagagtttgaatttattcacttacatttaatgttttgttcaagcatcttataataatgtgtgttgagcagtgggaaacagaagatagtgtttacctgggaagtctaccacgacccactttgtcttttagaaccctccatcgaaatctgacatacttttttcttttttctgaaactccacattctccaccataaacacaaaaagcttgtggaagttaaccccacaaccacaagtttgaaatctcatttcattatatatcccaacaccccactttcataaccatcatttttcatgcaacaaccagtgctatttagtctattattgtaactttaaacagaaatatataattttgaaggttaaaactctatctattttcggcttattgatgagttctctctttgcttcaagttggtctcattctctcctgatttggtctcaactttttagttgtgcaatctgagaagaaaggtaagagtgctatgaatcctcaaacacacatacacatatagagtcatgtagttaccttagccagcttgagaagaaacacatacaaattcaagaatgtcagtgtttctgccttgaagtcttattcactggcagtggagattgagttggccatcatcatattttcaacaaaagaagaatgagagttcagcaaaaactcagtgctttcctctttcaattaagtattgtttttatcatgtttctccttgttagcgcatctcaagagcacaagaaagctaaaggcagacattcaagcaaaaaagaccataacatcaaggtatttcattcctgcattgtattctttctaattttgatcaattaagttggtattataattttgtatattcttgtccttgtctacattgctattataatcctctattaagttttgtttgtgaagttacctttttattgtggttgttttatgcatgaagatgagttctagacttcagttcgaaatcacactagctacatgggtttctcttgtgggcttcaatggcgttcttaatgcctattgctatactagtcatcagactgtccaacagagaggggaatcaaagaaggattattattatattttatgttcatgcagttttgcaggaaaatctatctaaacctaaaaccgatcagttacattataattataaatttaaatcatagctcacaatttttttttttggtatatttaatttgtttcttttccctttacttggcaacccatatttgtacaattatttatatcgtttcagtttagtttagaagggtcagttgtcccactaattaacttctaatgatggtggaatggagataagaataacaagattcccatttcacagttaatttgtttgtcctaaagcttattagtcactacataaggtcaagtgaggggtattgcatctttgtctattggaaaggactataatgaatggtttgaagacaaaaaagaatctttaaaaaataatcttcttggttattggaagttccaagctttctttgtctcattttttaatagagcatgtgaaaagaactatgcaattatgctgttgtctgtatcattaatcaagttttagctcaacttataaaaaggccagaagtgaatgtacctctactattaacaaaagtaactaggtttattttaaagctttcttttcttgcattgatccttgccttttttattaattatatgcacgttttgtatttctgttcaacagaagcttgccgtacttcttgccactgcaggaacaatcatatccataaaaaatttcaacaactccttcagcaataatcatcaaagattaggggtagcattatatggtattatctggctgcaagttctaaatggtatttttcgaccacaaaggtgaaccaatgaattgcttgttattaagaaaatctatgcaatatattggattaggccatttagcatttgctaaataccaaacttagacaacgcagtcaaacttttcttctcttttaaatttattaagatttttcatgttctatgttcatattttctagagagccagctttattaacagctacagatttctgtttgcgaagcatgatgattagggtacaactgttttcttgttcttcgcaggggatccaaaaaaagaagtcttaggttctatgcacactggatagtgggaactgcagtgtcattactgggtgtgctgaatgtatttataggtttacaagcctaccaagaaaaaatatccaaaagcataacaacttggaatatacttttcaccgttcagatatctttaattgtgatattctaccttcttcaagaaaaatgggtctgcatacataaccaaggagtgatttgggacaactaactactgattcctacttgattagaaaaaaaagctagttcaaatgacaagaatgcaggcatgaaggctgagtcttgctaagaaagatgaatcaatgccttgccatggatgcaagtatttgaaacacataagaccacagatggacctcaattgctttccctaagataaaatatgtttgtgtgggtgtcttttttcagagaaggtacagtcattgaaaactttgtaatgtcttcccgcaagaaacatttttttttgttgtattctcctaacaatcaattctgatatttttttcaaaccttgatgtggacgctggaatacttcatggagatagatcaatatattatccatgatgtttttttcaatgtttgaggacattgtttgtcagtgtttataagcatttcaaaataaaaagaatttgctaaccaaaggggaaaagacagacaccctatcactaaaacaggagaaaacaaataaggtaagaaattctattagtatcacattgatatatcacttaagaagtatcgctaactatagtatttcaaggaaaaagctgtacatagccggttaatagagctattcctagtattataaaaggtggaagaatcacaaatgctcctatggttccaaagaaaactgaatcattcctttgagacacttcattgaggtaagcttgtctcctgatatttctcttttgtgagatggtgaagaacttcgcactcactttcttcaagtttttacctaggggtatggtgaaatcatcattcctttctccaaataactgcacgagctgctctcggattgtaagtttgcttccatcactttcataacctataaaccagaaaggttcaatctttgtaatccttttcccaatattgaaaaaaaaaaaaaaaaatacaagaggttataaacagacatggctataaaatttctattctttcacataactcatgagacaaacatccatatcaggagtgattcataacatagagataaaaggcatgggagaatttcaaaagttatgcaagatggggagaaatagacatatgatcataccaaaaatatggactttactcttctaaagtgagaaattaagggtgcatttacaattgatttgaatccaaataacttgtaaacttgagccacttcaaactaaggataaatacatccttactttctcactttacattttttcttatcttagcggagtcaaatatttactcaattttcaaactttcatgctagctatttacctcccatacagctactactgctaaacacattatctttgatgaacaaatcatattacaacacccaaattctaccatgaatttggtctatgctgagtagtactatgtgataccaacgttattgtttctactctaaatgtttatactatgcggccataagggggaaagataaggtaacatcaaaggcaagctctttcatagtatcattgaaattttaatgatatggcagcagcatataatcttgtaacttgtgatttcaaaggcactactcttgctttcaatttttttcccattaaaagtattaaaacaattacattctccagccatgtctatatcttcagcatatttcatttaaactaacaagttaacaacaaaacagagaaggggtttctcacagtgataaaatggccttacaaaaacagaagacaactaatctgtctcccctacacatatcattgatttaaagaggagatgttagcttacgtaccactattaggtgagcttgtagatgtaagttgttccaaaagatccagctgtgcacgagaagaagataaagatcctaacaacacaaagtccccagaagccaagttcagacatgaacgagaacctcatattgtaaaatttagaagtatttggtagaaatttaaactggtaagataaaaaaaattaagaaaatttgagacagtgaagaaatcaaacacatgactttcctacaaatatttcaagtttaatagaagttctgattcatttttccacttgtaaccatgtggatgcaacaaatattaaaatataactaacataatttctcacttttctaaatatttgtggtcgggatcatcaaagaaagaatatattttttaatatataaatcaacaaccaatattttttgtattgggtcggagacatgcatatctttcaacccacatgatttagagactaatcatactcacgacacgtaattactaaatcattgatccaaaaaaaatttacacacagaattaataaaatataaattcttccgttaaatgaattattttaacatacacatatggttaatcaacaaatatggaaattcatggttatccccataagcccatatttgattcaataatagtaataataataaagagtgggtaggaattgttagcgtatataccattaccagcagaagcatcttcctgtgtaactccagtgtcagtcccttgtgtttgagcacatgttgtgagtaaagaggaagaaggatggtagaatttgatgaggttgttgtgtttatgggtcagaaaagaaggcttggagtggagagaagcagtgctgctgagattgatggccataaagtgaggttttttggagttagttgctaatgccattcattttggtttcagctttgcagttccaggtaggtattttacttggccaagggcggcacttccctgccacaaataatatctgtggaggattctagttctatgtaggaccacaaaaaaatcattcttctaaatccccaccgttcaaaaatatttttctttcactaaataaagacacaaacaatgtcaagttactacagtcttttgtcttatgggtttattattatttagtcacttatgtttactttatatttaacatagtcattttatgtaaatttataattttttactatcttatactaatttattgcttaatatgttgtacactgttaaaatatatagattattacttttttttctgaatatatagattattactaattgatgtacaatttaatcataactgcattagtaaactttgaattaacacattcaccaatttaataactaattttaaaaacattgctaatatggatttaagttttgaattaatacattcatcattttttattaagtcaaatgtaattttttattattggatcgttcttataaaatttaatggaaaagttttttgaacttatttttaaaaaaaaaaaaaaataagtgttcatttaaataaaataaacatttttatgatttttttttactaatatcttgatatatagagagatagaggtagattgaaatttatctgaaaaaagatagttaaaaagacttaactgagtgttatatagattaacgaacattgtgttttagtatgaaataaaaaaaaattataagtttgttgaaaaatagactcattattatttctatattttagaaaaattatttttagtcattttcctttttcatctctctcctatttcttttttctttttttttaatttttttatatttatcattggattcatatgtcatcaactctaattaacttagattaaaaatattttgatatgtatgttaattcattcatgagattctaaacaaaaattaaataaaaattattcattaataagtattgataccaagtatgaaataaaggcacatctctgaagtctgcaacagccccagcgcagtggtactctaagttgtatatcaccttttgtggggtgtttattggatcggatttatctcatgaatcccaccatcaaagtcaaattaaatcaattaatttgaattttgaatttattatttttcaattcgaactaacttcaaccaattcaaaaaaaaaaaaattaaattaatatattttgagatagcgtccttttaacaggcccgtgtcaactgtcaatcactcaaaacaccaccgatgatcagagagctgccttcaaatccttacctgcggtgagagacaacaaattaacacattaccataagctttccaatactaattcaagttactccttatcaattttgatctacacctttggacgctgtcaagtctatttttaactactttcatttttaactgtttctctgtgtcatctattttttgcctttacttgtatttcgaaattagtgtgtgtatgagatgatatagtcatatatccccgtttatttaaatttaaatttatttgttaatttttttaatataataactagttttctgtttctttatgtttgtctaattcacctttatttttataaaaaaagaaaattttgtttttttaataagtaaatcttatttatttcttcaaaaatcataggacagctatacattggcaatgattataaaagtgccattatcagacaaattaaaaatgaatataatacatcttaaaaaaacgaatttaatacaaattaatgagatcatattgcaaaccttaagtttggcagattagcgattccaaaatgggcggcaatggaacctttacggtatgtctttttttccaaaattcatgcagttgacaattttaaattgtaaattttcaacagagtaaatcaatagtgacaaataaaagactgtttcaaactcaaaatgacaatgaagaatgagtttgaagattctgaattatgaaggaaaacaaataaatcctagaaggatttggatggaagctctcaacgtgatttcccttcaatgttaatcgggcctccttcgcaatttcttttaattttattttaagcttcattttaacatttaacttcttttataaatttaaattctccaacttatttcgtgttaggtttatttttgccgttactttttattatgcacaggtgaatattgaactccctcaggtccacagactgaggtactcgaatttttatgattattggcaattttacggataaaaaatcttaacaaccatttcatttgccgtcattatttgacagcatagcagttatattacccatcataccttgataggatcttctagtttacataaaagataaatacttcaattttaacaaaaaagagagattacaagtcataacgtgaaataattacataaaatattgcgaagctgcaacaaacttgtgaaaaaaataaattaatgaattagataaagatagtttacactatacatgaagatattggcagacatacgtaaggcatgatgaaataatcgtttacatgtctattaatcatggggagtatactacaacacttgtttctacattccatcaaaaggctttatttctctacattgaaaagtaacaacaaataatcaagaaattcgagattaaccaataacagtaatttcatttaaaaaggaaaaaaaaaaaaaaaaagggaaggaaggaagaagatgaatagaaatgaaaaaaagaaaaaaatatattaaatcatttaaatgtttgtacctcatgcttgctagcagaagtagcaggcctcttcctcatgtttccaagcaaactcttttcaataactttcaagaagcaatatgagaagtagcagatgtggtttaatttgctagactacaaattatttactggatcatgactttgaggaagtctgatctttttcaatcaaagaagaacccaattgaagcataagaggataaacagggctaaactccttatctcctctgctcctcacatttgcagcataatcatcaagtgttgctttgatgcccttccagatttgatcctcccattgagaatctagccacagtgaatactgcaatggtgttagtttgttcctttgcagcggtgactgcaattcttcaggagcacgggtatacagatgatgaagtatgacatttggtggcagatcttgaagaagtggtgatgatgcaagctgggacgtttccaagaaaataagcggacgaaatgctctaagtgcacgatatggtgcacccagttgctcaacagggaacaaattttggcccacagctagctccaattcagccatatctctagccatcctcaacttgcctgattctgaaagtggcctcacaagagatgcgtgtcggatgaagaatactagaacacgtgaagccatgctctggacaagcctggtgcatatgttctctgtaccaggagctgttgaattcctggaaggcaacaacctagaaagaaactcactgcgaaagtgaagaatacacttctggagttcctccatgtaaggtgatgcattgttgtccatagcagcatccattccgagcactccaaagttatgatcatgtatttgtaatatgcaagactcaagacgatccagcattgcctggaacaaagctgttacagaatcacaggcaacaccatatatggcacctaatgaagcagacaacacatctgcagcaatactgggcattcctttaagtatagatgatatctgtgtatgaacatcttgcagatgctgacataatgtaaagttcttgagctgtgctggtgttgcgggaccatttacttgacgtgattcaggaccagtggatatctgtcataacaatgacattgaacaattaaaagattagaaactatgcttctatagtagtcatcctcccttcacttgaataaaatggactttgggattctatatattgcaaaactcatacacgaagaaggggaaacaaagcctttaggttccagataaaacatacagcaacagcacttcaggtagtaattatctatctccagtcattatgtctcaccataccatgacaagtgacaacacttcaggtagtaacatcggaaaaatattatataagtctagcaaaaatattaattactcaacacactgaaaaataaaatgagcaagcaagttaaatgattgaccgttgctgatcactacaatgtgatacagtgcaagtccaataatacaatacacatatgaagtataaactcctcaatgaaagaacacgatattctttatgcatgcagttaacaatgccatgatttactgtgcagtcaacaaaactttccttcttctgtgaatccattctttccttgtaataaaatattctttattccaaaaatattagtagttatataacagctaactttatagcctgccatcctgaaaacccatgatctagatagcattgaattcatttctaagccaataaatgtagcgcttaaaacatctaataagcaacaatgccttagatacaataacgtcatttctgtttacctggtattcagctcgttctgcaagaagaattaaaaccttgccaatttcacgcaaaacaagaagagttaagcgtgcatccatctgaacagtttctatctcttcctgaatgcgtgatataattcttgatatttgttccttggagggaacactaccacgactggacattggaaatacagaattcactagatctgaaaggcgactcaagcaatgagccaaaaatgcattctggaatatttcgacagctgaaattatcttctcttttccagacgaattgatagctggtaacactcctttgacatctgtgtcatgtgaaattctttcaagtagattctctatcatggagtaaagctttggatatcccattgtaaaaatctctttaacaaaacttgatgcagtgaaagcagacttcatttggcttgcaaaagcctttgtaatggcctcccacactcgatctgttagcataggatcaccttcctatgccgcagcaggcaacatccaaaaatgagataaaaaaatccaatagaaaataagaaagtgcgaacaacagtagttagaatatgtatgatctgatgagtgttccttggtaagaactcaatactgtaaagtataatagatcatgaagacccaaatccctaggaaataggaagtccattgaatctgtttatttgcacatggttaagatcacaattttttccaaaatctaggataaaagaccttactaaaaaaatcaatgcaacttcttcatacatctaacatattgatcactttattacactctgaatacatacagaggagatgattttcaaaagattgcatattgatctcattgcatccaaaatccatctagcggtgtttaatgcatcagaagagaatggacaggcatgaacttttacaatttctctactctgcatcctatactactcttttgaagagagaaaggtctttgacagtataatgttgcataaagctggaagcctattaaaataattctacacaaaagagaaacaacaagcaattacccttgatctccttactccctcttcacttatgcataggtaatatagcatagcacaagtcaccccttggcatctgtttacagcataccagaggaaaagaagaccacaaaaaggaaagatttggaaggctggcaaatggtttgtattgcacagcaaatacttgattgatactaaaaaattgaaatattacagtcttgccttgtggtctctaacatttgtagatctattaaaccagtgcaatagattcatagatcttgtcatgtcagtctcttcaaaaccaaatgaaaacacacgtaccgaaactagcaattaatgactcaattcaagcttctaatataatcctcagattcttccatttgggaagagtgacacacaaaataatagctctcaatacactaataaaatcgcgtgtgaaaaactaaaaataacctgtttgtgctaacaatttccaaactaatattcaaacaccaaagtttggctggccattttgcataataagctaaagctaagccacagggtattcgttacacaattatgtcggtaaagtaaaccaattcctattttgtcgttacacaatactatctatcatctacatatcaaactatggcgttcaaaggacaaacaataatttctattgtcgtgtgatggatgcagaagagcatatatgaatccaaggaagcaacaacataatttccttctgatgtaaacaaacaactaaaacaaaaacaatgagcctcacctgaatgacctcatcaagcaacaaaacatgtgtaaagggatcacgttttttagagagcaccctctgcaaatgccacacagcaacagcaatggaatgcaactgatccatgcaatttcccaacctatgccagagagcctctctagctttagcccctcctccaatgtggggcgttccagagcccctaatcccaccaggaccgtacccacttccacccgaaatggtcttcatgtccaacgccacagtgacactcttagcacccaaacccttatacttattcaccacctgctccacagtgcccttcaattccccaagattgtagaaaacctgcaacccggtcccaacctctgcctggttcaacccttccattccgcgttccagaaccttcatcgcctcgctgcgaagcagatctcccgtttccctgacccaactgagctcttcgtcgacggcgtcgatgccggcgaggtcgtactcgtcgcagaggctgaggatctcgaagtggagctgggcggccttggcgagatcgagtttttcggggtcggcggcggccatgaggtcacggagcttcttggaaaggcggagggcgcggatggagtgctggaggagctcggtggtgcggtggaggttggagagctgggcggttttggcggcgacggagcggtgagggtcggagagctcggagcggaggcgacggacggaggactggatcgacgagagcgcggatctgagggtggagagggcgtggtccgcgtggtggagggacgagagctgcgagaggaggtcgtggtgccgcgagaggacttccgagcggagctggttctccaggaggcggattgcgtggtggagcttctccgcggtggaggccggggagccggaggagagcgcggcggaggagaaggaggtggaggagaaggaaggggagaggaaggcggagaagatgggatccgaggccagagagtctagggcggaggaggagggggtggcggcggtggcggcggtggcggcggaggaggggtttttgaaggtggagaggcgttgcatcggagatgcgccggtagagaccggcgtcctcgccgacgctggtgacgccattgtgattttcgttttggcgagcgagcgacgaaggtcgtttagtctagtagacactaggataggatagttactctattacttttgttttatgtaacttcttgcttctgtaattgttttgtgtgattgtgtctcattatttttttttaatttacttaccattcatgtgattttgattttgttaatgatttttttttaaaatttagtatcctcactttttaataacatggattttttttaagtgttgaagataaaatgtttataattttttgatttttggataaacggataaagtgtgatattttgattagcaagcttttaagtttttttttaagtttgctgttataaaaaaaaaaaagtgaaagtaagtttaaaatgatttaatgtctgattgaaattaggatagtttaaggtacttttagcatgaacatgcttcctccaaagtaatactcatggttttgtttgttttaactaataaatcgttacttttgaaatgacacttcgaaaatcataaaacctaaaaataacgggttcacaaacatgttcttcgtatttttttgactccaatgtacctttagaggtatttgaacgatctttcagacagactaaaatatgtctttctcattgtgtacattaaaatgcatatttttgtattgaattttgtaaaaatatttttgtaacattaaaccaaacatagcattaagaaattcagtttgcaaatttttgtaagaatatatataagaatttgatgactttaattagagaaaaattaaatggctaacaaagatcacatctaaccttatgtaccaaaacccattgctcctactcatatgtcgatcacctaaccttttaacgtgtcaaagatcaaactttttactggtgagaacttctacaagtgacaagaatgcatctattgatctataccattctaaacatgcatgaaattgcatcggcttttacggccttccacttttgccaatcctaaacaaattgaagactgaacttatgccaacaagacatgtagacacaccattatctatactttatctaatgaactctttgatgtctactatttctacaaagaagtgaaaaagatttgggactccatgaccttgaaattcataactgaacgaacattttccccccgtaaaattggtagttccataactgtaatttcactcaaaatggtaatttttgcatttacaataatagaaaccagtcttctcctcccagtaaataaacaaaaagcagacagatcacctcaagcatattagttcaccaaacagtttctcgcactcttttatacaatggaaaaaaaaagtacgaggaaaagccaaaattgcaatgctagggaaaattgttctccagaattcatcttttatgctcttcaaattattcattccaacctataaacgtgcaaacatgtcaaattatatatataatatatgatcgttcatcatctcatatcttccaatttggtgcagaaaattaagctttcaaattataaaacagagcaagatgggagtgtcaagaaggaattgacgctggttaagcaaaaagatgaaatctataatgtaataaagcataaaagatatcattgcaagcttaatttctatgcctattctattactaacgagaaaacaggaactgtaaataaatataatttttttattcaggaatcaaagataatataaaaaaatttacaacaattcacacacgttcaactaactaactgaattagaatctctcgacaaataaatacaattgaagcaaagtagtaatgataaaaaaatgaatgaaataacaatatttggacaatttttttctataaatattttattggagaagaaaataaaaaataaaaaatctttttttgtggtgaaattagctaaatcatattttctgacggaacaagccaaagggtggtggtggtggtgatgattcagaagtggcagccacagcaaaggtaaaagaaacagagggtggagacaaggactacagcctcagccgcgtagagtatcttgaaaacgacggtgtccatgatggtcgtttgaagatccagtcgtttccaccgaaacggccacgacaccttcttcaaccacagcttgctcttcttgttcttcttcttctcctccatcaaacttaaacacacactctattatgtaattttggacaaagagtatgagctgttgtttgtttatatatagaatattgagatagggttgcatgctttggatgcttcaaagacaaggatgtttgctggcccatgaataggttgaaccgttgaaccgtaaacaaatgctagcactttatttatgaactctacttttgtcacatttctcaattcctgctccttccgacactttgctctcactcattaaaaaattccaccaatcttgttcccgatttttagtttccgttataaattgtaatcgtagataaccagatttaaaatttggtaatggttacaagaattgtaaaaattgtgagataatgataaattgatatctaaaaggtaaaaaatttaaatttatttttttaaatatgtataaagtgtgatagattaattgtgtagataatataatagtaaattaatttttaaattttataacttaatgttaaactaatttttaaaaaatataatttattgttaaaatgattaatcacattttttcattcgaaaattaaatttaaattttttatcttattaaaataatttgttaccttcttatatttttaggtatcaaaatgattatatcaaagatatgtgaaatttctatgagatatttatttgcttttcattaaaaatgagttttttttttagagtttaaaccctttaaatgaatcttaaagggatttgtttcttactaagtttggagatacctaaagttaaaaaaaaaatgaaaatattggtaaaaatagtggagttgttgattctggtgtaaagtttcatttgatgtgtcgtaaatttgtattggagagttgttgggggaatgagagcgcgtatgagatttaaaagcttgttaaagatgaagagacatataaaagtcttcttttgttgaataactaattctgtaacaatttgatttgatatagaataccatatatcatgtgccagaaatgagaaagaatgactggcgtattagtctgattggtttgatttttatttaaaaatcatttaaaataaacttaaaaatatatttagttctgtttttatttaaaataaaattcaaatcaaattataaactaatattttgacggttgatttggtttgtgttttataatttttactaaaatattatttcattaatatttatatatattttttatattttaaataaaattacattaaaaaattgttcataataatttacgaaacttattaatatgttaatcttttataataaaatttttaaaattttatttattttaaactaaatatatcttaaaaaagtagtatgaaaaataaaataatatgtattgcataaattttgtatacataacactacaaaatattatgaaactcaagtaaaatataagtcttagtataagtgttacattttgtatcaatttcaaaaatactacaaaccaattagtttgagtaaaaatcatccaaaaaaatcaatttggttcgatttttgatcttttgaacaattttcaatttttattttgagtttatttgagtttgaacactcctaaaaatcaatgttatatgagaaagaaagaaatgtgatttttatccaatttttaaaaaatgagtatttaaacttatacatattactagagggaacatatcatatgagttattgtgagtaataatgaaagcattcaattacaattattaggttcaaattatatagattcctcatatacaaactgatacatttttcaagataattaaattaaacatatactgcccgttagtaattaaagtcgagatttgaggataaaaactattaatataaaaataaattttaaaatggttaatagtttgagaattttaaaaatacataaatattaaattatgataattaaagtcatgttttatcctctaaaaaattataataaaaagatgttcttatatttaatgagagtactgtaaattcatataatataaaggttggtaaatgaattggatcaaagcgcattaagttatgtttgtaatattcctcttaaatgtttttagttgctgaaaaaattgattttgattttagttcctacgatttttattttatttttgatatttcatttcatcgatatttatgtttgttgaaggattaatacaattctcatcatttatcaagatttagggtcaattattaaatcatatacacaaaatttctctttattgtttttatattttaaattgtattattattattctattaagtgatatgatgtgataattaaaaaaaatgtcatcgtttaataaaatgaaagtagttaatgaaaataattaaaagtgtacatgtacataaaattgtttaagacccagaaacatatttaaatattttcttacgtattgattatttacgtatgtatgcaaagaaaattgaaatgtaatattcccttacaaacaccaaaagtaatgtgattgtgatctttccagccaatctcacctttgtagaatatataattatatatgcctacatagtgcatatatatactttttatgaatttatttatacacaaaatccctcaatccaatattttgtataattgattttgtttgtttataaattaagacaactttgttactaatagaaaacatttttgcagagatatttattgttttattttggttgcgtggagcaacttgtttcccgcattgttgccgtgcactgcatgatgatgtagacttgacctggcttggtaacaaggctgtctatataatataactagcaagtctcaaattaacaaaaattcaacaagaaggggaaaaaatgaggggagcgtttcattttttactgattacaattctgatacgttgataaatataatggaggtgagaaaagaatatccggattacattttatgcattaatgatcataagaaatatataagaaaactgatctgtatacaggaataaggcatttttgtaatctttgatttattagaattacatgcattgagtaatttatgaatcctacatgtgttcataattatttcatctgaagatggtggtaaatatgatgatttaattttttgtcatgtgcaataacaacacttgtgtgaatgatggatgaatgactactaattcttggttattaattgttggtagctgaattagcaaatgtatgaatgaagatcgattgtattgaaagagttgtttgatatgtaactttcgacagaatttctgaaggattttttcgttaataatttccgacagatggactcataaaaaattacgactgatttttctgttgaaaattaccaacggatatatccatgaaaaattaccaaatgaataatctgtcggtaatttcggacataacttatcgacggatatatttgtgctgaccttgcagacggatccgcaggaatttttgatggacaaaaaaatccataaattaattttgcaatgaacgttttactgatagatttttgtccatcagaaaatttgaaattaccgacggaattttgatattaccaacgaattttggccgtcagaaattccattttttttgtagtggtatattttaaaacttccgacttttattaaaccatccttaaattaggaatacgtcctaatatgcataccttatttccttgttaaactgttcctactttttactcaattaaaggttgatataatctgatattaatttatgaaagacatgcctagaatatcataatattcaattgttattatgaagtgagtttgaataaaatcaacttataaaaaataaaattgaattaaatgtttttatgaattaaaatcaatataatgatcatttaaatgtattatataggagtagatttgtaagcatgctgcaaaagttcatatcatatccaccgtaagagtttataaaaaagataaactattttcataatttttattaatctcttcagaattctctttattttataattatgaaaaaaataagttactatattataataaagataacaatgttagaaaatatccaattctgaaaaaaaaaatccaaagatgtcttttcttgagaaaaatcttcaaatatctataaaatatcttcgagttttatttcaactgacttcggttcagtggaaaaagcttttattatctgttactcgtatatattatcatgacatcaaacaaaatattttgaaatagttgttattgaagagtttcttaacaaattaataatacacaattaagtgaaatatagaagaaattaatgaaataatccatcaaaattgaatctgatatcttttattcatttcttctataaatttctcaatatatattaaattagctcaggaattggacagatttgaacactttgtgctttattccatctcataatttcttttatttgcattgaaaaatggaattatgtactaattggaacaattttcttttgttctccgtgtaaagtacaataatatttctctagttattattaaatgtagtaatagatgacaatagtgttattttcattgaaacaacatcgtgtgaaatacatgttatgtgttggatatcctttctacctttgtccataactttatctatcaagtccttttttcttgtattttcagcaattttctcattgcagtgttgtcaaaagacaaattgacattatttcattgattccctaatttcactttggtatggtccctccaaaatgggtcaatcaagtggtcccagatactcatgtccacttatgcttaggctttagctaatcgttgcttacttggtttctccaactacatatgtccatttccaattgcataatggctactcaacatcaacaggagcacatttaattcaaattaattgaagttagtgataaatgaacctaaagataaatcgaaaaaaaaaaaacaaagatatcttttggatttaatgactaactacctattcataaacgctataaaaatataatatatcataaaacccttcaagctttattgtaccaaagccaatgacgtgtggtaagaaattcttttgtgctaaatatttttgatgaaccgagtagaattaaggagataaatgatactttcatttccttatttccaaaggttgacatggtgcatcggatgaaggatttcagactcattagtttatgcaatgtggtatataagattgtgactaaaatcgttgccagtagattgcggaacttgatgtttcgtcttgttttgccattccaaagtagttttgttccaaacagacatgcctcaaataatatttttgtggcataggaggtgctccattcgatgaggcacaagaagggtaatgttgggtgggtaaacatcaagattgatcttgagaaagtctataatagacttgattgaagattcgtgaaggagaccttggaagatatccaaattcctgcaaatatagtggatattatttggcactgcatatcgtccccaaagatgaaggtgttgtggaatggagaggttttggaggattttcaaccataaagaggtattagacaagaggatcctttaccctcatatatttgttttatgtatcgagcaacttttttcaacttgttaatgttgttgtggagaatgaattttgggagcccattaattcaactttctagaggtggccgaaaattgtctcatttgggttttgcagatgatattttattgtttgcagtgattacaaaggagcaggtggagactatcaagacaattctaaatttgttctgtgagagctctggtcagaaggtcagcaatgagaagaccagagtatatttttcaaaaaatgttgcatggcaagcaaaggaggagattagccaattattagggtaccaacgtactgaagacttgggtaaatatctaggggttcctatccttcataatagagggaccactcagacataccaattcatcataaagaaagtcaacgaacatttgagttgcttggaagtgagaactatatctgtgcttcaagcactttcgtcgtatgtgatgcaatctgcctggctacctaagtctatttgagatgcagttgatcagaaatgtcgtcagtttgtgtggggtgatattgatgaaagtaggagagtgcatatggcttcttagaaggatatctaatgatgcgtaaaatatcttaagctctcgcaaggaaaagtatacctacacaatagtaacaatgaatttaaaagtccaaatatcaaacccaaatgattattaaactcacaggaaagattattaaaatatttttatgactttgctttttataagataacaaataaaataatataaagagagattttgaattataaaaaaagaataatcaggattatgactcattagtatcaattttttctcaatcctaatcataatgaaatttcaccccctagttaattatcaatttctaaaatcaactaaagtttatgatcaaggtaagaagatgttctttgccttaaatcaatacaccaattatcatggatctattaacttaagtcaaaggataaaatcaattttaaggatgattaattaaagataactaatatataaagattatccaaatagtttgatcatgtaatttggtacaaaacattttctatataaatctaccaattacatgtcgatgatcattactatgcaatcgattgagtattagaatgacttgtcccaaataaatattaaaagaaagaaagttaattaacataaaccatgaagaatttcattaaaaacaatgaaagtgatacagttggacaattacatcataactttcggactaagaggactaactagccatgatcagagcaaaactaaccgttcaattatataaaaagtaaacatagacatcaataagaagaaacgataatcataattcgtcctagtgatgttgttcacactcttcagctctcaaaagccctcaagattttctcaaatttgtaaaaaaataaaaataaaacttaaaaataaagataaaacaagaagcctcattctttatttataatattgtggggagggtctccttgtatctttttttaattaaaaaatattatcaagtatgatttaaattaattatcgccttcgtacaaaattatcatgaatgattagcttcaacaaattcatgatgtttaactattttttatgaaaattcttaaacatctatctttcacaaacttacgctaaaccataagttttgtcaaataaaatatatcaaaatgcattaatatgacatgaaaacttatataaaagtaaaatcaaattcggatttatcatttatcaaccatgtatcaatggtgagttgggcttaagagaaatgcgtgtggtaaatcaaacttttatgctgaaaaatggatggcatctagttaaaaataccgactctctttgggttcgctaggtccgatcaaagtataattgaggtcacctcaatattcctcttaattgatgcagggaaaaggggatcaaatctttggcagggaataaatgcggtttggccaaaagtggataacaatcttcgttggaaggtaaataatggcagaatggtgagattttggttggatctgtggattccaggtatgaatagtattgctttgtctattaatagtagtattgcggattcgaaaaatcaaaagatggtggctaactatgttggtgaggatggtacttgggattatcgcaggttgaatgctttgttacctatggatattgttcacaagatccgtgctgtgtgtgcctaatgttgattttggcaatgatgtggtggtctagaggggttttatggaaggtagtttctctacaaagaatgcgtacttatctctgattcaagaaggagatagtatgaatcaatggttgtataaggctatttggaggttgaaggtccctgagagggttcaaatgcacatatggttggtggccaggaatatgttgctaacaaatgttaatcgtttcaaacgtcacatgtgtgactctaatctgtgtccagtttgcttggttcatccagaaacgattattcacttcctgagggactgtcaacgattataaagctgtgggatcgtgttactggtaaccaggttccaactgggttttatgtgggagatttggtggattggatagataacaattagctaaacaaattaagttaggagaaaattgggtgatatgcccaaaaacactcaccactacgccaaaacatcaagttgtttaactaagatataactcttgacatatatgcccagcatagaggcaagctattaaacatgagcagctagtttgaacccaacccatagactctaatgtaccttcacgaccctttttgaacacgtcattcccctctctattggagagggtttgccctgaaccttaagatcatcagaaacaagtcgaacctggaattcaaacccatgttggctaactttgttaccaatgatataactaagaaagtccattatactaagtttaagctattagtaacagcgtaactcttgacatataacatcctatataagctgcagactcttgcatatttaagtcacgttaatcatgggccaccatgctaacccaacatgcatcctctaggcaaatcattaggtttgttcaaaatttaactatttagcaaagggataacatacagccacgtaggcctagtgctttgtagtaagtggaaaaaatcagctagctgcagcagacaaaccaaaggaaaaaaagtgatatcccctaatatcaaataaagctagatcactttatataacatccattgagtatacattgagtgagaaaccatccaataattctgagatgttcacctcaacaaattagcttcataaataaagcagatcaatcacaagaaagagtttgccgcatcaaaatagagcgaaagcaaacaccatatccatattgggtcaagcatcccattgatatagaacacgtgcattcaaagataggatatagaacaggccaaagaacatttcataaaattgcaaatgcagaactgattacctgctaatatttatattataaattactattaaagcaaaatgtatgaaatacataagaaaattaagaaaataataaaaacttcggaagaaactggatgtctacacagttctacttttggccatcagtgtatcatcaaagaggaaaatcaaactctataccaaaataatgcagcaacttatctactttgaaatactttaactgttcagacatcacacccaccctcaatttttactgcactgtgcatatcattaatattgcaccaatcgcataaaacacattacatccaaggatgaacaattcatccaggtcagaatccagtgattaaaaagatattcatacttctcgtaaaataaaacaatgatccagaagcaaattcccattctttgtaggtgttggtgataatcaaaaataaaatgagtataggatgcaaacacacaccaataagaaatagaagtaactatcttttctttatcaacatccttttatccaatttgcatcagaaatgaaaataatcatccttaccattcagttcatccaaagcaaggcaataacagttcattaataggtaacttggtactgtaaatattcatcctcatttactatcatccctagtaattaattacaagtagcagcatgcatcgcccaagtggagacacgctgctacaatggtggcataaaagatcacaaagccgcagctatgctggcactgtggtgcatcacaaatggagctccagcagaagctggatgccactccacacacacacacacacacacacacacacacacactaatctatagtgcttacaattaactactgtgctcacaccaccaagtcatggtgaaatgtaatcaaccatcataacaacagttaaaataattcccagcgacaaaacaataaagacactgaaacacaacaatcaatcttgttattgttcaaggagtgtcaatattaaccaagacagcaaagcaaaaaatcatgtctaacgagactcaataaatctacaacaagtttgcacaacagaattcaaccaaagcttactattttttcaaactaaaagccatatcaattctttctatcatgagcaaccaaaccaaccattaaatcaggtggctttggcaggatgattccccttggcctccccggaacaacagtcaccgtcatgctggtggtgatggtgatgatggtggtgctgcttccccttgagctgcttcctcatgtcataagcatcctccccgtcggcataatacttggcctccacatcatgaatcttgtatcccagggtcaccgtgtacaaattgaaggccgcgcggttgctcttgcgcacgtgcagggacacgtactcggcaccaaacacctgcagcgatcaatcaaaattgaaattgaggggctaaaaacataatcggacgcggcgactaatttgtaatttgtaaatggaaagaaatgatgggatgcctgttccatggcgttctgggcggcggtcatgagcttggtggcgaggccgagcttgcggtgagtgcggaggacggcgagggaggtgatgtggccgtggcagtcggtggtctcttcctccatcttggcgaggacgtagccgacgatgcgggcgttgtagtcttcggcgacgtagaggaggtggggccaggagaggatgtgatagaggtagtacttcatctggtagttctccggcaggcagaacaggttgcacgcctgcatcgccagtaggtcattcaccgtcgccttccttatgcacaccattttttcccctttcctttcttctctctcacgattagggcaaacacgcaacgcaacacctaggagcagtgttttaagaactggggagccgattatcgaactgctagacttattaggttaatgggtcacgggtggaattggagttctactgggttaatggatcttgggtcaaattagagtctcacttctcgaatcaatttaggaccaacaagcaccacaacacttaggagtagtgttttaagaatcatatacaacatcgaatcggttgagataatgacttaatgagttattgatggaaatcgaagtctcattggattaatgaattattggtcgaatcgaattaggaccaagacacaatgcaatgcctaagagcagtgttttaagaactagacccatcatccaataagtgagacattggattaacgagtcattggtggaatcaatctcactaatcaaatcaatttgacttagtatatattaaaacaatataaaaataaataactaacataatttgattaattaatatgctaaatttaaaatgatcatcattataagttatttaatatctcaaataataaccaatattcatgtcaatagaaattcaagaataagtttcaaatacaaataaatatccaatgtcttaaaaatatacttttttatatacataataatttattttttaatatagatccttagttattaattaaaataaaatattatctattattttaaatttaactacatatttataaaactagtactttcaattattactttttataaaatatattttatagtactgaagattcaagtgaagattaattatagatttgtttttcctatttaattttactaattttactctataaatttcctttaattcctttgcaatgctataaaaacttgttttctgtttctgtactgctcctctgtattgtgtcacttcttggtgttgcatcgttatgaggtctcacacaaaaccctatgagagtctaccatcctagctttgttggtgttaatatattttttcttagttattcaattgatgttttattagtacgtaaaaatctcacctttaatggaccaagtttttttcttcaaaatacataaaattcttaaccaaattaaaagaaatagagtttaatcatataaaaataaaaaagtagtgtgtgaacaaaatttaaaccagataaagtctaaaaatagaaagagttgaagattgaacataaatagaaaagttataaaatcaaatagctagtttatcacatgtataaagagagagagcaacacacttctatgaattcggaagtgagactactgaaaatagcattgtaagatagacttggtctggcaccataaatcattcttcttctccgtcaacattctatactctgacaaatctctcattgtcaatcaaacttcttctctctaactacttttgttctcttaccatgaataatttgaactttcattcttatctttcagtgtagctataacatgttcaacatccaatagatcttgccacggtaaattaatgttggtgtatataatttcatttacatttcttgttccattaatttctcttcaggaatcatcaccaagctatttatcaatcaaaatggaaaataggctagcactggaatacaatatacatgtagattttgttgattaattactagaaaaagtagtaaattatataggtgtaggtgtaaggtgtagcaattagaaacaatgtcatccattaataggcaaccttcgaagaaatctgcacgtagttctggaggatcaacatctcaagggtcacaaaactctagcgggccaagtgttaagtttgcgagaagaacttcaagtggaagatatgtgagtctgtcaagggatgacattgatgcgtcctcagacttatcaggggattacatgaactacactgttcatatacctcctaccccagacaatcaacccatggactcatctgttgcaatgaaagctgaagaacaatatgtttctaattctttgtttaccgggggattcaacagtgtcactcgagcgcatctaatggataaggtcattgattctgaagtcactcatcctcaaatggcaggctccaaaggctctgtatgttcaatttgtgatggcagggtcatgagggatgagaggggacatgatgtcactccctgtgagtgcaggtacgtgttattattaggtcctcataatcctaaggacattatttaaggaattaaaaagataaaataattattgtaaaaataatatgaaagtgtaaaaaaattatgtaaaaaacataattttctgtctctgaataagaatttttctcttttttaacttcttaactaatgtctcaaggatacttgttagcatttgtcttatcatcatttcttaattttgacattatttttatttgatttcttgttgagaaatgaagagaaactaactaagttacataataataattcaaatttaggtacaagatttgtagagattgctttatagatgcacaaaaagaatctggtatgtgtcccggttgcaaggagccatataaagtcggggaatatgaggaagacctcacagatcagtattctaacaatggggcattgccattaccagcgccagatggttccaaacgtaacgcaaacaacatgtcagttatgaagagaaatcaaaatggagaatttgaccataacaagtggttgtttgagactcaaggtacctacggagttggtaatgcatattggccccaagatgacatgtatggtgatgatagtgatgatgccctaaaggcaggaatgctggatcaagagaagccatggaagcctttgagccgggtaataccaattccatcaggcatcataagtccttacaggttaattaattatatcaattatttatgctgcccatagtttgtaattataacgatcataataataaggtttaaatacatttttcctttatctaatttaacattttgttcattgttatctttgtatttttttattttagttttttaaaatgtgtttgttttattttttatctgtaaaatgttttagatgacaaattttttatagtataattcaaaaaaatatttttgtactgtttaaaatactatatatttctttaaagatgaaaaatacatattattttacgactaaaatgaaaaaaataaaaaaataaaaataaaaaaatactaaattgcataaaaaaatgtatttaagtctaataataataattacatgaccaaatctatgtctatgtatctatttgcaggttacttatcttggtgcgacttatagtattgtgcttttttttacactggagagtggtaaatccaaataaagatgcagtatggttgtggcttatgtcaattacttgtgagatatggtttggcttctcatggattctagatcaaattccgaagctttgccctgtgaatcgttccactgaccttgaagtccttcatgaaaaatttgatagtccatccccatcaaatcccactgggcgatctgatctacccggtatggacatttttgtgtccactgctgatcccgagaaggagccacctctaaccactgccaataccattctttccatattagcagttgattaccctgttgaaaagcttgcatgctacgtttctgatgatggaggtgctctcttgacttttgaagccatggccgaggctgcaagttttgctgatttatgggttcccttttgccgaaaacacaacattgagccgaggaatccagacacatattttagcttgaaagttgatcctaccaagaacaaaagcaggacggattttgtcaaggacagaaggagagttaagagggagtatgatgagttcaaggtacgtataaatggccttccagattccatcaggagaagatctgatgcatttaatgctagagaggagatgaagatgatgaagcatatgaaagagagtggagctgacccttctgagtctgtcaaagtgttaaaggccacatggatggctgatggcactcactggcctggtacatgggccaatccttctggtgaacatgctaaaggtgaccatgctggaatacttcaggtaccacacctacctagaaatttttatttttttaattttgagaagagtttagcttagttgaattcagaaactcacatagaatcagagtagaccttacatattatttaccaacaaggtttatggacattgaaaatcgaactcatgtcttttttacgaaatgagtatgttagttatcaactggaaccaacctttgttggcacctagctagcagtttctatttttatttttgaaaaaagtttagcagagttggatcacatagtattacagcttactcttaatatattatacaccatgaaggttctcacgttagtaacgaaaatcaaattcatgttctttgtgaaacatgaatatattacttaattggatcaaccatgtcaactagctagcaatttgagtaaccaataaaataaaagagatatgacgtgcatatccaagaatcaatttaacttaaatatatataataatagtattttaatccaacttttttgcgttaatgaatgtaggtgatgctaaagccaccaagtcccgatccgttaattggaagtgcagatgaaaagattctagacttcacagaggtagatacacggttgccaatgtttgtatatgtttctcgggagaaacgaccaggttacgatcacaacaagaaagctggtgcgatgaatgcattagttcgagcatctgcagttttgtcgaacgggccattcattctcaaccttgactgtgaccattatgtctataactgcaaggcagtacgagaagggatgtgcttcatgatggacagaggcggcgaggacatatgctacatccagttcccacaaagattcgaaggcattgacccttcagatcgttatgccaaccacaacactgtgttctttgatggaaacatgcgagcccttgatggtcttcaaggtccaatgtacgtgggaactggatgcatgtttcgacgatttgctctatacggattcgaccctcccttcgtggacaaggacgccgacaagaaagatggtaaaaagattcaagggtccgaaacgccgtccatgaatgccagcgagtttgatccaaaccttgacgtgaacttactccccaagcgctttggaaattcaaccatgctggctgagagcatacccatcgcagagttccaaggacgtcctttagcagatcaccccgccatcaagtttggacgtccaatcggtgttcttaggacccctcgcgagccactcgatgctactaccgtagccgaagccgtatctgtcatttcttgttggttcgtctttctctatattaattagaatagttatcttgaacaagagttttctctttaacaaaagcattttattttctcaaaagagttcttaaagatttttcttaatttattgtctatgtataataggtacgaagacaagactgaatggggagacagagtgggatggatttacgggtctgtgacagaagatgtggttacaggataccgcatgcataaccggggatggcgttcggtgtattgcataacgaagcgagatgcatttcgtggatcggcaccaattaatctcaccgatcgattgcaccaggtgctgagatgggccacaggctcagttgaaatattcttctctaagaacaacgcattcctcgccagcaagcgcctccagcttctccagcgtctctcttacctcaacgttggcatctaccccttcacctccatcttccttgtcgtgtattgcttcctccccgcgctctctttgttctctggttccttcattgtcgaaaccctcagcattgcctttttaatctacttgctcatcatcaccgtatgcctggtgatgctggccattctggaggtgaagtggtctggtgtggagttagagcaatggtggagaaacgaacagttttggctcatttctggaaccagtgctcacttggctgctgtggtgcaaggactcctcaaggtgatggcagggattgagatctctttcacgctgacgtccaaatcggccggggaagatgaggatgacatgtttgcagatttgtatctagtcaagtggagctcactcatggttccgccaattgttattgctatgaccaacatcattgccattgccgttgcgttttccaggactatttacagtgccaatgcacaatggagcaagtttattggaggtgcattcttcagtttctgggtgcttgctcatttgtacccttttgcaaaagggttgatggggaggagaggcaagacacccactattgtgtttgtatggtcaggtctcattgcgatcacactttctttgctttgggtttccattagcccgccccaaggtgctgaaggacaaggtgtagggggagattttcaatttccatgaaataacaatgttattattgctaatgcaaggccaggtgggtgggtgtgactcatgtttttagtttttctttttgtcttgttattatatgtacgtaacagtcatgtatttttgtaaaccttcaattcacatgtcttaagtacataagtaggaaaagaaaaactagtcttagatcgaggtttttttcttttgaaaaaaaaggtcaaagcaataataatactattaattagtttatacatgacgacatgattgatgttcataatgtgcatctgtgttagttgttactgtcattgagcattccattttttccatcctcaaaagcattacatgtttatgttgtttgatttattcagtagagtagatgaattgttaaacatcttagtaacttaaattaaagtgaactaaaggaaaaatgaagttcaaatgaatctgaaaacggactaaccttcaattgtttcactggtcaaattggtgccagaagaaaagggtttggcaagccttttacaggtacaattcataattcctcaaaatttaattgagcttaagtacttaaaaaaaatggtaatcaatttggcaaaatattataattaattcttcttactgtaatcttacaaattacgtgctgcttaagcaactaaacatcagtaaagtaatcaatttgtttgggtatttgttgtagctctaattgctaactttacttacaggaatgggctgccctaataagtggctcgctgttatgggctatatttttatttctgggtacatatgggctgtctaatttttgtatttacaggatgtgccaatcctacgacaagaaaagaaaaagaaggaaaagaaaatagtggaaataaacaatatcaattattttaatgtatggaaatttttacaaaatataaaatgaattatgtagtatatgatacgcagagcattgagcatgtgctatgaaattttcgacgagagtatggatatttttaacgatttacaaaagtctcaagatggtttaaattttcaatctttttgaccataaaaatctcaagtaactagattgagccatctcggagaaccctctcatttggcttttggtcttttttaaaattttacgaatacaaaatttatcacataattctcattgttacgtgtaggagaatgttaattagaacacttgtaaaaaaaataaaagtgaaaaattgttattaaaagtaataaaattgaagattattaacatctttatgcattaagttttaatgatgcttttatttttttaattaatatctttaaactactcgtgaacggttcctaaattttatcaaagataacaaagaagaagcaagacaacaagcaacgtgtttctttttttatatatcaattggaatcgattcagtgaatcagtctaaaacaaaaggataagtgtgacgaagtaccacaaacactagtttgtctgcttttgccaactctcacccaaatagctaccttctttgtctgattgccaaaggagagggacgtgccaatgaaatcaatcgtatcgaaactaaaatttggtgcaatcaattcaatgcattactagctatttcggaaacgcatattttgtaaaagagctctaaaacaatgaagggaaatatgttaagagaagagataaagtttggttgatggtggttaccactttgagggatgatggctcacttgccacaaactttcgcatcaaacacatgggcgacaccttgatttttaaccattttgttcaaacatatcataggctttggtgagtgccagacaacagaggcaaatttttaaatatataaaactgttcaaaagtatgaattttatgttataatgcgtcatcacatttatttaatgagtttttttggtaatttatttatttatttaataagtttgaaaatacataagatatcaattttattaaagtctaaaccatattttttatccgtaagaatcataaaaattaattatcaaaagattcacaataattcacatatcaaatctaacaaattaaggtaattaaactccattgacaaagcataaaacatatattagatgattgtgcataactttaaaatctgtatataaccaagttgatgactttatcttgcaggaagcaagtggagttgtataagttgcatatcagcaatagcatggagaaatgacaaagatagatagtgaaacataccaaaaaaaatggtgctagctagtgagtgctgaggacctgtagttttgtgtttagttttttcaaggaaaagctgatactagaacttataagagggaggatataagagaatgaaaaagaagccgataaaaaaaagagagagagagagagagaatgaaaaagaattgtggaaatttaatcccacactcaattcatattacctaactttataattgaccaacctttaattgctttattatgttgtatgggatatgagtacaagaaatgaatatcatatgtaaatacgatgtttttttatcataaaaaaataggatataagtatattactgtatatatgttataatgtttaagctaaatgtaattatagtaatatattttcaatattttattaatttatctgttctttttttctttatattttcttaatttgttattcatatgcatttttatcattattgtattatttcttacacaacttatgaggaaagtattgtgtagccaagtttaaataaatatgttataactcaagttatggtaatacatgttttaatttatatagaattgttagaatataaaatattcaagttttgatacacagtcactcttataataacatattgatagtccatatatatcagtatgacatggataagtaatcaattttgaaatatggattactactagaaaataagcttttaaattggttgttttcgactttcaacatcgatgttaacatcagttttcaaaaagtgatgttaagatacactatacaacattaatttttaagaaaatcatgttgtataataagaaataaatcaaaaaatgtaaaatatataaaaatcaatttcgatatttaaaaaaacaatgttatgatatacttgacaacatcgatttttctaaaaatcgatattgtgttgcacacgacaacattgattttcaagaaaattgatgttgtcaagtttaccacaacattggttctttaaataactgatgtggataaacactttctacatcagttctgccaaaaccaatgttgaatagtacttacaacatcgattttgttgaatagtacttataaaaccgatgtggaaaatgattggtcttgtcggtctttgcgaacttggagaagagaaagagagaacaaagaagtaggaaagcacaaagtagcaaagagtaagcacgatgttatggtaaaaacatttagtcacttgagttttaatttagtaaaaatccaacatcggttattaaaaaccgatgttaacaaaaatcgattaacattggttttttataaaactagtgttaacatcgtcatgttaacatcaatttttttaataactaatgttaatattgtcacgataacatcggtttttgaaaaatcgacgttaatatcactacattaactttgatttttgaaaatcgatattaagagcgtcacgttaacatcgatttttttaaaaactgatattaacaaaaccagtttatttataaaaaaaatgttatcgcccttttgttaacatcgattttatcaaaaatcgatgttaaagtaagaatattgaaagcattctttctagtgcatgcaccatattcaatctacaaagtggacattcatacatattactaacttacttaagacaaatattacaattttgaaaatttagaaaatagtttaatcttaaaataaaattttaaaaattgcaaactacaatgaagcaaaaagttcaaaggaagaggcaggtttatacatggagtaatgtgatttacacatcaatttttttacaataaacacacaagataaagagagatgagaagagaaaaacaaagtgtatatatatatatatatatatatatatatatatatatatatgttagatatataatatgaccttgagaaacaaaaaaaaaaattaacacttccttattatttaagatttaaaagagagaaatagatacaagaaataaaattattataataataagtaataaatcctccgcaaaacaaaacaatataaaagtagtattaatatcctagtaagcaataacacactctttatcaaaacatactaatcttgtgattggtgttctttaatgaataagacacacgtaaaattcagtttattaattaatattaatgagtgcatatcatgaaccacacaagacaaggcaagacacacaaataagaacaaacgaatgaagaatatgcggggctcatcattccgtacctaccatgtggtctggttctcttcatctccatttccatttccttctccttctttctttcctcttcaacatgtcataataaaattcccactcatactcttctttccaacacaaccaaataatctcttgcaccttaattctatcgcatactctgcctcttgattgcataggcacgtggacggccatgtcaatgaattcccacgtaaaattcatgaaattccccacgttctaaggttttgaagtgtgtttgaagacaacactgcactgcactagtgttacacacatatatagacaacaacacaaaagaaactttgtgtgcatatatatatatattctaatggctggcaatgaatggattaatgggtaccttgaggctatactatccactggaactggggctggcaccgttgatgagcaaatgcaaaaagcagtggctccaccagaaagtgcacattttagtcccacaaagtactttgtggaagaagtggtgtccagtgttgacgagtctgaccttcaccgtacatggatcaaggtggttgccactcgtaacaccagggaacgcagctcaaggttggagaacatgtgctggcgaatttggcatcttgcccgcaagaagaaacaggtaacaatcatatttcatttagtgctaattgcctaaggttttgtttgggagttaggagaggaagggaaggaaagagattcaaggggaagagaggggaaaaaaagggaggaaaatgagggaagttccttcctccttatttgagagttaaaaatatattaagagagggaaattgagagttaataagatattaaatatgaaaattatataatttaaatgtaaaaatatattaaaaatatattaaaaatatatttttgaatatgtagctgaggtaagataataattttaattacttttccttctaaaaacctccaaattgggagaactacaatttgtaggctttggcagatttcagataagttttaaaaatcctcaaatcttttccctcaaaaattaaaactctcaaacaaagagatgtctttacctaaatctttctcttctctctcttcccctctaaaatccctcttccaaacaaagcctaaggttcgaaccctgcagggagagttgtttacatttagtgtctgacaatacttcaaacaacaaacaagattggttctgaagaagaatacttgttaggaatgaagaaaaaaataacactaaacatgacaataacacttgatttgaaagtagaattgatagtaatatatatgtacatgtgcacgtaagttttttaatgtttatttgtttgattttgttgaatgctatgcaatagaatctcgagtggccaagcaaaatgttgtttggtttaaattgtaaattttcatttttgttgtatttgctttttcattcgatgaatttgggggaagtatatatatatatatatatatatatatatatatatacatataccagagtgattgttagtgaaattaatggggcactacttgtagttggaaggggaggagctgcagagattagcaaacagaagatgggagagagaacaaggacgcagggatgcaacagaggacctgtctgaagagttgtcagaaggggaaaaaggagatggcattggggagatgatacaaattgagacatcaaagaaaaatttccagaggcagatttccaacttggaagtatggtctgatgacaaaaaggaaaagaaactttacattgtcctcttaaggtatattaattcttcactttctcacaatcattttgcattcaataaatgtgtttagccaaatttcttgattgtgttttactaaggtatattgattgtttgactatgacccttgtcgtttgacagtttgcatggtttggttcgaggagaaaacatggagcttggtcgagattctgatactggtggacaggtattagacattgctacatgaataagctgtgacccttccatttagtgtgtgttttgatgccagttggtgagagaaattattagatggtctgagatgatcattgtcctattaatcttcacgtatatgacaagtaatgaactgttattaattctttttcataaatgaaaaaattcgagtacatgtcacatagattagtcaaaactatggataggtgatagttctaaattatctaataatttcttggttgaagtagcttaaaaatacttatactctcaaaacgatcaatcttccttctcattttttgtcttggaattcaagaatatgaattggaattcccaaaaacatattcccaacttttatcaaacatagccttaattggtgttcaacaatgattcaatttcaaccaatatgttttttccagattaaatatgtggtagaacttgctcgtgcactagcaaaaatgccaggagtgtatagagtagacctcttcacacgccaaatctcatctcctgaaattgattggagctacggagaacctacagaaatgctaagtgcaggcacagatgaggatgatgataacattggggagagcagtggtgcatatatcataagaataccctttggtccacgtgaaaaatatctacagaaagaacttctttggccctatattcaggaatttgtagatggggctttagctcacattctcaatatgtcaaaagtattgggtgaacaagttagtggggggcaacctgtgtggccatacgttattcatggacattatgccgatgctggagatagtgctgctcttctttcaggtgccttgaatgtgccaatggtgctcactggccattcacttggaagaaacaagctagaacagcttcttaagcaagggcgtcaatcgaaggaggatatcaactcaacatataagataatgaggagaatagaagcagaagagctttccctagatgctgctgaacttgttatcactagcacaaggcaagaaattgatgagcaatggggactttatgatgggtttgatgtcaagcttgagaaagttttgcgagctcgagttagacgtggtgttaattgtcatggccgattcatgccaaggatggcggtaagaatgcaactagggtcacacactcacactcaatgtttgaaagtcttttatttcttaaaccttggtgaaacttctttggaaaaggaaacaactatgtaccaactttttcaagggatggttatatcagttactttatttggtgttttcttatgcaccttagcatgtcttaaattctcaaatttaagataacgtgttgtatgaagtactaatggttcaaacttatgtaggttatcccgcctggtatggactttagcaatgttgtgacacaagaagatggccctgaagttgatggggagctcacacagcttactcgtggtgttgatgagtcttcaccaaaggctttacctacaatctggttagaagtgagtaactaacatgtctacatatcttggattacattgagttcttcataaatacttataggagaagaaaataagaaggtaaaatgaattaaatttctcctataagttaaaatcactttatgtattttaacttttttttattgaagttttcttatgaaagaaatttgattcattttgcttattgttttcttccttagttcctttataaatccagagtcaatgactagccttgtcaagttgtaactgataactttgtgcaggtgatgcgtttcttcacaaatcctcataaacctatgatcttagccttgtcaaggccagatccgaaaaagaacataaccactttgttaaaagcctttggagaatgccgtcccttaagagaattagctaatcttgtaagttgacataattcaactgctcaatacttggtggaaactatggttgagaacttgtaaaaaggactaatatgttttcaaacagacgcttataatgggaaacagggatgacatagatgaaatgtcctctggcaatgctagtgtgctcacaacagtgttgaaattgattgataagtatgacctgtacgggcaagtggcatacccaaaacatcacaaccaatctgatgttccagagatatacagatttgctgcaaaaacaaaggtataaaatttattgaagttttagtatatgttgagatctaacttcttatgtgataacaatgatggccagctaactagtttgaaatttctctcagggtgttttcataaatccggctttagtggaaccctttggccttactttaattgaggcaggtttttaactaactagccacttttgtaatattatccttattttgatgctgaagtgattattgaatgtgcttaaactcatgcaggcagctgcccatggacttccaatggtggccactaaaaatgggggacctgtggacattcatcgggtaatttaagaattaagtttagatagtcagttgcatgatgcatgctaggaagttcatgaattatttgtcaaatggcatcaaagcattggaaaaaaaattgtaaaccaagatttgaattcccactaggagagttactcacatttagtatctgacacggcctcaaatatgattgtttccgaaggaggaaaccaaaaaaaaatgcagtatgtagtgatttggatattaattgtacatcccatatttgctttttcttgttttatttattttggaaatcaaacaggatgaacacctaattaggtctagctccttttgaattgtgatgttaggccctgaacaatggtttgcttgtggatcctcatgatgacatagcaattgctgatgcattggtgaagttgttgtcagagaaaaacatgtggcatgagtgcaggaagaacggttggaagaacatacaccttttctcatggcctgaacactgtcgcacttacttgacccgggcggctgcctgtcggatgaggcatccacaatggcaaaccaacaatccagaggatgataaagctgttgaagaagaagagtctttcaacgattcgctcaaggacgaacacgacatgtcccttaggctctcaattgatggtgacttgactgcagcaagtggaggcactggtctagatatgcaagaccaagttaaacgcatcctaagcaagataaggaagacagattctggctcaaatggtaatggtggtggaaatatcaatatgcttcttgacaatgtaactagcactagcactaacactaacactagcaaatatcctctattgaggagaaggcgtaggttgattgttatagcacttgatttgtatgacaataatggagctccagagaagaacatgattgagatggtgcaaaagataattaaagctgtgcaactagaccctcaaactgctagagttacagggattgctttatcaactgctatgccagtgatagaaacagtagagttccttacatcaggcaatgttcaagtgaatgagtttgatgctttaatttgcagtagtggaagtcaagtttactatcctggcatcaatacagaagaaggaaagcttttgcctgatccagattatgaggtacatattgactatcgttgggggtgtgaaggtcttaagaaaaccatttggaaacttatgaatggtgatgggaacagccccattgaggaagatctgaaatccagcaatgcacattgcatctcatacaaaataaaggatcttagtaaggtataaatcaacatgacatttaccattatattaagttacataatggctagctggaggcactaagagataaatgataatcatgtgtattaaattcaggcaaaaaaagttgatgagttgaggcagaagcttaggatgcgaggtctacgttgtcatcctatgtactgcagggggtcatctagaatgcatgtgattcctcttcttgcatctagagcccaggcactcaggtaattaacacttcatccttaatttctaactaattttttcaatcaattcataatataaaacaagtaatattgagtacattattgatttcacgttgagtcatccaaaatcacattaaaatagtatcaattaacatgcattttaagtaaatgttcatgtgttcaatttcacgttgaagaattgatagcatgttatgatctagttggtttaaaagttgcatcaatttcacacacacttaacataaaaagctaagatagatagtttccaaatatcatgggcatgttctttgtgcgagttttctctcgaggaatgtcaaatcaaacgcaacatgattctatggctagaaccgattttagttaaaagtaatcttatttcgaaattttatacaaaattttattacttggttttaagaataaaaacacccaaacttaaatatacgacttcaaaatcaattatatttagaatcaatttaatttgaaatcaatttttcaaaagttagcctaatcacaaacagaatgtttattatttgcttaaatatgttaattaggtatctctttgtacgttggagattgaacgttgcaaacatgtacgtcatccttggagaaaccggggacacggattatgaggagatgatttctggaactcacaagaccataatcatgaagggagtggtgtctaagggttcagaagagttactaagaggtccaggaagctaccaaagagatgatattgtcccaaatgagagccctcttgttgcatccattactgaaacaacacatgaaaacattgctaatgctttgaagcaactttccaaatctggaggaatctgaagtgctacgtactgtatattaagtgcattttctttgctctctcttctcaaaacaagtaataaaattatgagagtggtatgtgaatatcttcacatatgtggccactttaatatattacacacttcatcaatatctattatttttctgtattttttttcttcttatcggatcatttcacttattatatatactcatatttatatattttttttctctttttctctctaggtgttaaccagaagattggtccaccaatcttttcctaaatttatttaccaccacagtcaaaaagaaaaaatgaattgatgtaaatgatttgttacctaatgcatatattaaatgtggctaaagtgtagctagatcatgcttttctttgttacaaaatgtttttcttgatagagcttcaagaagttatatataatttctctaaaatacgaataagaagttatatataatttctctaaaatacgaataaattgaactcgaaatttttgtgcaatcacccgagaattgagatagttaaattttactaaaatagtttcattagcacccgaagtattataagacaaaaccctccaattgtagcagcatccgttaaaatttgtctttttatatatttacctcggtgttatgtgtgtttgagaaaacagagaaatttatgtaatgagactttcctatttaatgaactgaatttttggtgattagagttcactccgtaatcctaatgtaataatgtgaagtatatatatatttttacatttggagatcaaatagaaacttgatgtaaatttgagagatataaaaatacttaatttaaaaaaatgttatttaattaatttaatgtgtatattgttgacgtggatgtcattaagtagccacatcaacaatgcgtttaatatatgctattatataagagggatgaaaaagtattttgcaaaattggagaattaaataaaataatttttaatatggaggaaaaaataaaatgatacaaatttgagggaaaaaacatatttaaatttttatatcacttgaactaatttactttttttatccgattaagaactatctatgcactctgtattagaaaattcacagatgttgctttcaaaaaaataatagtattgttagaattcaaattataacaatttattgatatattacatgtttggcccacaattaaactaattgaataatatatcttttcgattcacatcgttaattataaaacctcatcattcccgctatcacagggggaaataattacttttatctttgtgaaattataatatttgattaaattgctactttatacatttggatattttatatttgttgactatatatttttatattaatataaaaatgttgttccctatgaatttagacttgatgaagttattattgaaatactaaatccctatatgcaagagttgagtacaccggaaaaaaaatgcaagagttgaaccatatatataaaataatatctttcaaatgtggataaaaaggaataccttgacaatagtttgagccaatagtaattttaagctcatataataatagataataaaaaaatagtaattctaatagtaattatttttaaaaaaaaaaagtgaggaaaagtgcaaaggttttgtccggattatctttaataaaaaattatgcttcgaatcaaagtatctatttcttcctccattggtggctttttgtggccctctaaacccatactcagaaaatgcacagtttttaactcaagctttcgattttctctcaggaaaggtctgaagatcaagcttagtcaaaacgtattgacaaaattacctctctcactatagtcacccgaattttatatcatgcggggcatagttaaacatcaaggcatgccattatctattaagggcaaaaaaacatacctttcagcaagttatattcgcctaatatatgtattttcaataagttggcaactaaaagcttctgactttgacccatttaatctaatctgaaagggaaatttagccattactggtagagaattaatttcttataataataataataataataataataaattatatatgctattggttggtttacaactttatataaaaaaaaagttttttttcttaaataaagtggttgatctttattttcttaaccttatttgactaaatttgagttgattaagaaataatgcaattttattacttcacttttttccctccaccatgtttttgtgtttatatttgctggtttttttcccataattttaaaaaatgttatttcttactagatattcaaatgttgtaatttttccctctctctctctctcaataatatgaaataattagtctaggattgaacatatcaagctctactaggaaaaatattttttttatatgtgatacatatagaataattcattcaataatttatacagtattaaaaatacaattttctttgaataatgatattttatttaatttaaaaattaatttctaatattctttttattattattttgattttaagattttctttccatcttggttttctatgatccgttcaaaacatagagttaattttgggatgttcaaaaaccaaaacccaaagcaaattgaaatggcatgtgaggggaagcatagtagcatggtgccaagtttcaagatttgcataagatttttccctttcacacaaataggatagtttggtgaacagacatgacatcagaggaagcctagatttggtgctcagctcgtctgttggattgaggttgactctctctcccctctctcttcactttacctttcttccttactcattacaattttccatttttttttctttctttctttctaccagccatccataaacaccatacatacctattcatttcacatttgctttccctttactgtttctctctctccctctctctctctctctctctctctctctctctctctctctctgtctctgctttccttcattgcaaaccaagcttcctttccagcttggtctggtcctgccctcagacacaacacaatacccaccaaccatttttaccacatttactctttctcttctctaattagtaaaatacaaccattctctctctacctctttattttcccatcaaaataagatttttgtctggcattcccttccattttcttatattaatattttttacattttatttttttgtttaagtgtggcccacttgttacctactgttgtgccactacatcttttgcagcatctggattttgctgtagggtatgtgtgttgctcatcctcaggtattctttgcacattaagtctcttgtcggttccaaatgaggtgtgaaacctgttgcttctttgggtagaggattcagaagtctagctaccttggatcaccacaaaggtaaatgctttgtctttctcaatcactttttggataatatacatttcactttctcttttgtttgcttggatcataagtgatgctttcctggtttcctttctttttttcattagaaattgttgtgcttatcaacatgcatcaggttattttactttcccaaatgaactgtgaattcattcatcatgcctttttgattgtgttggttttgaaactgctgaattatatatgctgcttcttttattaattggattatgttttattgtatgccattgccaataaagcctgagatgggagtctttcatcttctaatttagcttacaggaaattttgtagtctgagattaccttaaatcatgattaagatgcaattagtgatttgttaaactcttgctttggttgttgtttatggcattgttgcaagaactgaaatgttggctgtaaattagtatgttcagatgtgtgtttcgaagtcttgagtaaggggagtacttaacttgaatcctgtacttgagtgggaatgtcttggttctaccagctgaagaacttgtggggacgatattgattgactcggtgcaaccaattatgtcatccaacagttctttgaatatggaattgtcaaagaagacgtcatttttgggtttgaaacgatgggttttgattgggataggtgtcggtgcatttatagtgctgattttgtgtatattatcgatatgggcaatgtttcggagaaagtctaggagatctctggacaagtattctgtatcccaaataccaaatttctcaaaagatatcgatgttgacaaggttggggtgcagagttctcatgttcaaccagaaaatgtggttattcctgttcatgacaaggcaagtgacaacaattcagataatgtatcagttcgtttgggaaatagcaaatctggtgatcctgataatatcagtcagtgcagctcaatttatcatcatgagagaggattgagttcaatgtcagccgaagaaggaagctctgggaatgttaagaagcaatctacgttgtcacatggagggctggtcactgcctctcctttagttggcttgccagaattttctcatcttgggtggggccactggtttacacttagagatctggaaatggcaaccaatcgtttctcaagtgagaacatcattggcgagggtggatatgggattgtttacaggggcagactgattaatggaactgaggtggcagtgaagaagcttcttaacaacctgtaaggatatttatttattattggtgtaccctttaattttttttcttctgccactttctgacactacacataaacaattacttctttttaatcctgttatgtaattgagttctgcattgaattcctaggggccaagctgagaaagaattcagggttgaagtggaggctataggccatgttagacataagcatcttgtacgccttcttggatattgtgtagaaggagttcataggtaaaaaaaaaaaaaaaaatctttgttttcctacattagtatccactacactttgtattatatttcacaaattcattctcaataatagtgccagctttgggtttatgatagtcatattctacttagtccaaaataggacataagcttttctctatgttatgtctctttatctgtcataatgaatgtgcttcctgattgatattcaggctgcttgtgtatgaatatgtgaacaatggtaacttagaacaatggttacatggagacatgcaccaatatgggacacttacctgggaggcccgcatgaaagttatacttggcactgccaaagcgtaagttcagggtgcaacttaaaatatataccatggtaatcatttgtatagtctggtgccaaatcactcggtataattatcataaatctctcatctctgaattttgattgtaaaaatgtgttcctttaattaatgttattactattagtgttttgtgcgtgtcaaaatatatcataaatgttattaaatgtatttatgtttcttgataatattttgttatagactttatattctcatatagtttgcagtatatttaagcccattaggtttctagtctaaacaacaatatgcactctgcccatgggaccactgactatcttaggccatatttggatttaaattactaacaatgggtggaatgtgatggaatgaaataaatttaccgttgcattgttttaatattttatgatggaatggaattgaattagaaaaactggttacacccagtacccccaaattggggggaagaaaaggagcagttttgggtggaatggaatggattccatttcatttcactccattagttcaaacaacttagtgaacatttgacctattgtagtttaaatattttacttcttaattagttacaaaattatttttatggaagattcgatgatggaccttgttctcccgattaaccctctattgtactgtgactggtggcaggcttgcttatttacatgaagcaatagaaccaaaagttattcaccgggatataaagtctagcaacatattgattgatgatgaattcaatgcaaaggtttctgattttggtttggccaaacttttggattcaggcgaaagtcacataaccactagagtaatgggaacgtttgggtatacagaaaatttattatctctttccttattttttacttaaaggatttgtacacttaggaactcacttttgttttggatttcagttatgtggcgccagaatatgctaacagtggtttgttaaatgagaagagtgacatttacagctttggtgtcctcttgctggaagcagctactggaagggaccctgtagactatgcgcgtcctgctaatgaggtggctaatttttatgaactctgtctgcttgccagttctaaccatgctttccaccgtaagtgatcactgcccttcaaatagctgatgagatattgtttatcttcattatgacaggttaatctagttgaatggctcaaaacgatggtggggacacggagagctgaagaagtagtggactcaagccttgaagttaaaccaccactgcgtgctttgaagcgcactcttttggttgcacttaggtgcatagatcctgatgctgaaaagaggcccaaaatgagtcaagttgtgaggatgcttgaagctgacgaatatccacttcgagaggttcccttcaatatcttgtcttctcatacataagttctactgattagttaataactttgatcttgagtcttatatcacaattttgcatattttctaccttgtgtgcattcttatcattattctccttcgtacatgtattggctaacctaccaggctaccaccaactagaaagaacaaaatattggatgaactcaggaaaaaaattgggggtaaaatatgtttctgtttcctacaaataataattgttggttttagtcctcataatatggcatataggtcacattaatgaacattctaagatggcatgtgacatgacatatttagatgcatgttaagtcatcaataaatcaataaatggtgatagagactattttcaaaacttttaacataaaaactaaaactaatattttttttttcaagaactacaaccaaaagtcgccatattaaacccaaaaatttgatattcttcaggctacacaatttctatttacttaattagcacctcagtatagctcaaaaacaaacaaacaaacaaagcataatgttttgtgtttatcataacatattagtgggagtatgctgtttaattctacctacttagcattctgatgcattatattataaagagcatggtcctcttttgtatgcatgtttttgggtgcttatatactaaatattgaagtattatatgttgacaacaaaacactaaaacgtaaggtagacaactgattgataataatcactttcaggatagaaggaaaagaaagagtggcactgccagcatggaaattgaaaccgtgaaggatatttctggtccatctgatgctgaaaagatggaaatttctgaaagccacgttgaaggataggattgacaaccccatgacttagcctgcatgtacaattcccgttatacacgttatatatagtaacttatctataccatattgaaatatctccaactttgtgaccttattaagaaaattttgtttcatctgaggatagaatcagatcagagtgagcccgtttggataatgaaggttttgttttgttttgtttttgtttttaattgaatggttgccattgaagatatgatacactagctagccttgcaaagagggtagaatcagtatgggtgctgtgagtgttagtgttttacagatgctacggggcctatcttcttacatgattgttgattttctttcttaacttccttgactttatcatatcctcacatagtcactcgctgctggagagtggcgatagtaaaaacgaatacttggcttcgatttccatgtcaagtgacaatatatttttcaagcatcttaaatgggagttccttatgagattcttagacttaagaatcagtttttatacaatttcaccattagagtcaataattgtgattttgtatatggataattcatctatatcttgttcgttctaacaatattttccttttgaaagggtaaataaaagttgtttttttatagagatatttttagtgttttactaatctattttaaggtatttaacatattgatacctaatgatttttagcaaagtggtgaaaatgtagaactcatgtaagaattttgtattttaaaaaaaaaatgtaacattaaaagaataatttcttgtgtgacttattaaaataatataaacatatgaaataacttgtgagatttgttttaagtttttaaagttttagtgtgtttgtatatctgttaagttcaacataatgccaatccaaggcctaattgtgtaaaaggtctgttggacagcagtgtaaatgtgtaacaactttccaaacacagccttgcacattgaaaattttaaaacttatgtggtaatagggctgatataaattaagaagttaaatagcttgtggagatgttcttatgcagtattttggcttatttgtgttattttctcaacaattagattccttatcattactactgctgcttctctccccctccaaattattgggcttttacggttagatatagctaaggtttgtctctacagtcacttatgtgcttattatacgtgtagaagcaatgtccccatggttcaaattccaacttgcacaaattatctgacaagaaatgggcattaatttttttttcatttctaacagtatagttaattaagttttcgtttcaagatggccagcaccgaatgatgcagtaccccagtaatttgtaaaagtggttgctttccttcacagcacataagcacattgttggttcatgcactaaaattgtgaatggctaatctagttatgattatcttttgattctttttaacataatttttgttccattccattgatgctagtgtcataaaggaatcttatctttcacaaataaattaaattgtaccaaaaattttgtggatcttagtgaaataatgagaagggaaaaacttttaaatttgcatttgttatttcaatcctttgttgattctcttatttcacccaaacgaaaagagaatctaaacatgggagtttcttgaggaagcacttatttggcagacaggcaaacaaatgattcaagttgaaggcttcaaacggtggaagtggaatacataattattcaatattctgataaagtagacctattttcacggactagcatctaggcttcttgataactatctttctcttctgctacgtaccactttacaagctccatggggaatgcggcaagttggcccatatttgccacagcttttgacttctccttccttcctttcataaacgtgttatttactgcatgtatttaaattaatgactttttgactataaagggtaaaaaatatcagtaattaccatagttttaaaattatttaccatttggggtaagttgtgtcaggtggtacgacttttaaatcagaaatcgtaccacctgtcccgacatttatatttttcattttttaaaagtgaagtcgtaactttatttacgattttactgtgtgtatttttttttttacgtttaaaagttgtaactgtgtttacgaatttaaaatcgtaaatatatttaggactttcaaactacaatttttttactatttagtttactctcaatagtcgtaaatatatatacgcgactttaaagtcgtatatatatttacgactttaaagtcgtactgtttttattttttgctttttgaaccccaaacgacttttaagtcgtcatattgctcacgactttaaagtcgcctacattaaatattactaaatacattccctccactgttttttataagttttttactaaaaaataaaatttgctaattgcaccccaagtatattccaatcttttcttttaaatcttaaatattaaatgataatatttttaaaatatatcccaaatagttacgatgatagtgttaaaaaaagtataaataattacatttgtaaaaaatcattaacaaaatcaacatatttaattagaaaaatcaaaataaatatatgttatttcatattttacaagttaaaattattatcaaaatattttcatccaacaataaatctctaaaaatttaaattttaacattactacaaaaatttacaaaattaattaaaatattaaatgtgatccaaagtaattataacataaattactaaaatacttaataaaataacttaaaatatttacaaaatattaaatagttttacaaaaaataaaattactttcatttttaaacaataaaattaaactactttttatctatttttaaaattaattaaaaaaaactcaagaccaataaaaaacttcacaatgaaacaaatgaaaataataaataaaagcaattataaaatatttaatatatatccatatatttaatataaaattaaaaaaaaacaaaaataaacatatatatatatatatatatacttaaggaaaaataatatatatatatagctataaaaaagaaaaagaaaatagttaaactagaacaacttttgaatgtaaagaaaaaaaaaatataaaaatataaaaaattcagtttaaaagtcataaatatatttacgacttttgaacgtaaaaaaaaattatgcacaatgaagtcgtaagtaaagttacgacttcactttaaaaaaatgaaaaatattaaagtcttaacaggtggtacgacttttgatttagaagtcgtactttctggcacgacttactctcaaatggtaaataattttaaaactattctcatatagtaattactgatttttttttacccttttatggtcaaaaagcctaaattaatactacttatatgttaacataggctttataaattacatacatttactacttatatacaagcaatgttaagtatgtttggaaacatggtagctaggaacaaaagaaaaaaacgcatctattttttttaagacatggaagctatcagctactatttattaacttcagagataatatagaaatctacgaataattaagctgcatgtaagcaacacatgctaattaattgtacatacaattttcattagtaagactctgtctagtacatgtgaaatatttaagaaaagaagtgaaggggatagaaatgcaaagaagtgtacgatgtaacaccccgtgtgcacccggtgtattaacattcataatatcagaatcgcgcttaaaacgttatttgaaaactatacgaaagcgattgaatcgtatttcttgattacattatgtatgggatgtataacacagcacacacacactcatcagatagtatatcaatacagtacatgcccctgctggtccagtttatcactcatcatcataggcagataaccaaaccatttcacagatatatactcaggaggaaaaacatttatattacataaccaagttctatacaaatatatacatcaatttccacaccatacatgtggtgatacaaaagaatgtcctccctcacacgagggtatataaacatatacaatatatcagatgggcaaacacgccctacagccctctacagggtactaacaagcatccaatcacatccaatcaaaatgagctatctagctctctttctgctatctctatccatgcatgcaatgtctctgctagggcctcctgccctgagactgctctcctctgtcagaagagtcacctgaaaacatataagccccacacggggtgagatacacatctcagtaagctcaaggtccggggaggtatctcctccaccctggcccactctccatgacacaaacatcaagcggtcacaatcaaattggtcaccctgcccggcctcccggccctcataacaatatgagaaagtcatcttgctctatgtatggcggataaacatcaacgcctaacctcagtgtgagaccggatctcacacccgtgccatcccattgggagctaccccttatgcatggacgcacgtatatggtacctccgagaatagaaggatgttcttgacccgtctcctatctcatctgagaatagaaggatgtccttgaacccgtctcctatccccttcgtcttgagggatcatcgatcccctgggatatcatcaaccaagagcaaaccaactaggaggaatagccgtctcctagggaggtccatatccatcttactggccagaagatctaataacaggcatcatacatttttcaagcatagatgcacatgcatatcattatgaggatgcaacaaccaaatgcatgcatcatgaatgtaaccatcactcctcccggagtgtggtggggcacaaacaagcgagaaatcatctccagggaccaagaacttacctggcaaagccgagctctgcagttctctccctgattcgtggcacccgccactgacaccctcggtgtcaagccctaatccaggcacatatacacatatcaacatcaattcaagcaatccagcaaacataacataatcaaaagtcctctaacttagggttcatcatagcccagcacacactaggctctcacagacccttctaggtccagcacagcttaatacaacgctttagggtcatcacagattccacacaagccacaaaccatcagctcaaagctctcatcggctcaatcaaagtacctgagtccacacagactctatacagttcacatatcatgagctcacagctccatcaaggcttagagtcactctccagactcaatgtaagccaacatagagagctctaaactctgtgcagttcaatatctcagaatttaaatatagctggaatggtctatgccttactcaaggcaacgttcatgtagcctctcaggcatctcacagtcacattctaaggctcttgcatgtcatataaccatcagctagtgactcagcacaagtcactcattcataagcagagccaagaatcaaagttcaccaaatccaattctgaaagctaatccttcatcactacacaattctaagcaagtttctctacaggaccctggactaattctagccccaactcagatggatcactattcataggacacccccaaatcaaaatttaaccggagaaacttgagattcttacctcagaattggcaaggaagacttctgaactacttctcctagccccaatgttcttgaatctccgtagttccttgcctagctcaagttccacaattcctctaaaaaaggaatctctcagctcaaggtttcaaggggtttggatgaatgattttagctttctaggtgttcctcacaagttcaatggctaatggaagtgatttgggctagcaaacaaggttctaggaagcttaggcactcaaaaatggtggagggagctctgaggaagaagagaaacagtgtttctctccagaaatcgcgagctttctatttataatggtcagcaccgacttgccacgctcctggcgccactttggcgctgatggcgccaaaatccagcatctgtggcgctcctggcgccaacttccagcacctgtagcgctcctggcgccaaactccgtcgctaaatccgtcactaaggcttttgcgaccgaattttataaatttaaatttttatttctttttgcaaaaagggttattatatacgacttccctcgattggtacacgtgaaatatacgagaaatatttaaaaaaaaaactattggtggagtccatagtcattaacttccactcactacatagaagttttaagtgaaaaacttgaggcaactattaataggtatgaacaaaatgaagatcatatataaaatgcaaaaaagttaaactacaatcctaactaccataactatttttaaaatattgtctttttaaggtaataaaattcaaattatattattaaaaaatagaaacaggccacgtgtaagacaattgggtatgttgaagtttcagttttcccttaattcgaattcagaatatcaattaaaaagttttaagtttgttaacaatttgttacaaacaaaaacattaatcagaaagtgtaccgaattctttatggtccaaatcaacgacagactcatttacggggtgaagtccaaatattgcaatatctcacaatctttttatgagaaaaaaacatttctttgtattggaaaacacaaaacgctacttttttgccttaactttgacaacaagctctttggtagactatggagtatggaagaggcacattgcagaggcaatttgaaatttgaaattgtaaggacatatccaatagtgattcttagaaggaaatattaacttcaagatctgatctttttaaaattcattattggagttggcaatcagatctctggaaatctggttcttccacaagaatcaccaagatccgcactgtttcctaaaaaaaaaaaaaaaattgtcactttgcccagcagaaacccacgggaatcaattaccacgtcgaaggaaagggaagaaaagagatgaacaatagaaccagtacaaatgaaataaaaaattagaaaaaaaaaaaaaagacaaatctaattttatgagcaccatatctgtctctacatgttgttgatgagaataaagatggtggtagcgaagggaagggaggagagtgtgggagggtagtgtcggagggaggagagggtgagggtttgttgtgtagcggagggtaggggtggggttcgcgacgaggggaggtgaaggtgggggtttggggcggagggagcagatggtggcagtgggattcgtggagggagggtggggtggggaaggtgagagaaaacagaagggaaaagggtgaacggtggggaagcgtgagagaaaacataagcagaagggtgaatagtgtggggggcaccgttgagaaggaaaatgggaagaacgacgaggtttgacattcaattttttttttaaagggtaaatagtcatttttatctttaaaagtgtagagtgttgataaatttatttttaaaagacgaaaatttgttgttatgatatttctattgtgattatattaggcataggcagtgacaaaatcaaattgaatctcatttttttataatgattaacttaataattatgtaattttatttgattattatattttaggtaagataatgttacattagaaattttagaataatagataaattatgtttattaattaatattatatttattattatgtttattctaacttatgtttattttcctatttttttaaatacttattataatgttctgtttgtaacaattaaaaaaggataaaagataaaaattaaattatattttgattaaatagtcattttcatcccctgaatgtgtaaaacacagaaaaattcatccttaaatgcatcactaagatctttcattaattataacgagcataagttaacataagaataaatttgtcatattttttcacttttatatactaaaatttgaattttcatctttcggatacgaatttgtcaacattctacgcaatgacgaaaataactatttacccttttttaaaatattagaaagtagatatcttgtgtgacttgaaaaaaagtaatgaaacaccatcacaacaaaaaatgtttgatattgttcctttaaattttttattttttaaaaattaatatatcagactaaattgaatatttatcctaaaaaagtaagaaagtttaatcttttctataaagtatgaaaaaacttttttacttaactcaaaataaaaaatttaccttaattattagcttaaagtttgaattactcggaagaaattacgttttattattataataatttaaaattaaaatattatcctcttaattactatattctgacttaactaatttaattaaatttttatttaactaataaaattttaaatttctctagagtaattagttttcatttaattagattagatgtcataaattaaatttcaattaaaaaaagtagttaaaaaaaaagtccgtgcattgcactgataataaaactatcttcgtttacaaaaactgaccctacagtcctcatgtcttcttcttcttcctcttttactctagctttccatctcgtgttgttggtgtcttcttcttcctcacaagctccagtgttcgatctccaacataatcactcgtgtattcaacataacgtttatgttggccaacaataaaaaaaaaaataatacattttctttgtgtaagtgtaaaatgacatattttagaaagatttaaatatgtttttgatttaagtaagttattattttttaattttggtatttagaagtttttattttatttttaattcttagaagtttatgctttttttttataatttcagtccatttaagatttcaaaattttaatttccataagtttgcgcttacatagattaagattaaaatatatatatatatataaactaaaaataaataatatattttacaaggaatcaaaattaaaaaaaattaaaatttacaataattaaaaatgaacaatttttttacaaagactaaatttgacaaaaaaatatttaaatatttaaaaattattaaatttcttttcttttcctactttcatacctaacaactttatcttatttttactcaatttcccttctatttttctcaaataaaataactataattttgttatactctatttcttatatatttctcttttcttttattatttacttgtttatactccctctatttcctttctctctatcaaacataaccgtttttcacataattttatatatttattacaagcatactactgagtatttggacttctaaaatagagtagtataaatctatgctagtttccatattaacgagtataattatttcaaatgttgtttgaagagtatgtaacatgatcacaacaaaaaattgttcgtgtgatcatgtccagtatcaacatttgggtgtatacaatcactctataagtctttcctttccctcacttctcattaagcaaattaattttctatacattagcttataaccagatgtttcttataaattagcttggttggaccctagttctaacatggaattaaaaaatgtaaatccacattctgctactcttacttttgctttaacaagttggaaatattcaagtcacgttgattatgcaattggaatgtgatggaaaattgccgttttaaggcattgctttgaggttggaacttgcaagtcagacaaaacaagtctatttcaataagcaatagccacaagcatgtcactttttcaaccacggaatcgattcaaatatcaaaagtagagggactttgctagattgtcgttgctgcttcaatatttctctagttctcctactcttttgccagatagatgcaacacttcttctgtctgcatgtctaattccacgtcaactgatattttgataaatttttttcaaggctaatgttatataccataacaaatatttttaatactttataaatgaaagtattaaataaaaaataactctatatatttaatgtttaaaaatattactattcactaatattatttcgttggtatgatgaaattagacttagattcttagttaaccaagatattgagtttaaatttttttaatgtgaaaaatataattgagatatgagactttattagagttgatcggttaaattttttaataaaaaataattattactaaaattcttagacacttaacatttatgacatgataaagaaatctaatgtacaaataactaaaaggatttagtaggaaaataatataatttactcgagggattaaaattttatttttataatgaattaattttaaaattttcacaatcatttataaattttaaaaaactttaactgcattgtaagtttatttggatttttttaacatgttttttattcataaaaagattaaaaataaaatcttacatgggatactacttcaataatgaaattatttctacaaaataggataatttttactgtcccacattaatgaaacacttcccttattgtataaagatataccttgcatgtcactcaaacttttattgggcaacaactttgtttgtatccgtatgtgactatgtgtagacaaatgaaaagccggtgttgtaaacaagttggacaaggacaactggttaaaaggggttaattttacaaaccaattataaaagtatatctcttttgaaatattttatcaaattgtggtagaaaacactggaaaactctaataaagtgtcaaataatatttaaaagaaatattgatttatcaatgctatgtacttatgtagtgtccatgtgagacactacaataccagtatcattgttactattatcgcagtatcttatgtaatgttaataaatcggaaaagtatatgtgacattgtttaattaaaatagagtttttttagtattgattgtctcaatttggtgaaatatttcaaattatttaatactttatttgtaaattaaccctggttaatccgccttcatttttcaatagctaggtatcttcaaagtgaactacaatctcaagttagtctctatttgttaataaattaaaaagagtccctcaaaataacttttgtcttcctcattcgtcttttattataaataggtccctgaatacagtatcgttaaaatgcaatttattccttacgtataagtattaaataaaattgtattttaatgataacatatatcttaaatgtgtgagggagaaaaaatgtgaaagctataaagtagttttagggacttcttaatttcacgtaaaataataataaatgaatatatttttggatatgtatgtgttaaaaaattttaaaaaatattgtgtataatattctatttaactcgaacaaaattaatttattttaataaaagatacatataatctatactaaaaaaataaatgaagatatattagaataaataattgatcttgattttttaaagtagcaaatattttgatgttgagatagtaatgttgtgttgactaatcgttgataaatttaggataaactaaaagcacacgagactgagaaactgttaaggattcaaattttgtcgcgagaaaggtgaagcttattaaaaagcttctatggcggcagagcaaacgataaatcaataatggaggcactcaatgattcattcatggaattaattaagacggtttggatatggtacaaagtttgttaattagttccgttaattatggtaaaccgaatttttagccataatgatttggacttctgcgatctacaaaagttgtgtgggaaaaaaataaatcagttttttcactttttatttgtctcgtgatcatttagaatttttttcctcattttttcaaagttgtcaattatcgaaatgaaattaacagtaaattatatcatttttttttatatttttaatgtttatatattaaaatgttttaaaccttggagcagccctcagctatagtcagccccgttagctccacctgctttgactttgtatgccatataacacccccccgtgtgtcaaatttcaaatcaacattctattgtattttaagttttttttttaatgttcagtactttaagatattacttattagtaaagaaattaatgtattttttaattaaaatacaatagaaattaataagttctcatgtatattaaatatatggataaaaaagggaactttgaaaattataatgtaaagctttgtacaatatagaaaaaaatactatatggttacactaaaagattgctttttgagattactattttaaattttacaataatataattatacgtaactaattaagaaatgatatatactattaaaaataaattccatatataaaaattacccataactttattgaagcgttgtaagcatcatcaagactttattgtcttgtcttttgaatacaaatttgtaatgacaaaaaatgtccttttaatttagggtgcatttttagaatacatgtacacaaataagataaaaataattatagataataatagatctaatattaaatttttttatgttcaaataataacaaattagtacaacatcgcagaaaaataatcaacaccgtaactcatctcaaaaagataagagcgagacaacttgctaggcaaatataattatgaaaggactgaaattttaagcaacttgctttttcctttttaagtatgatttgatctacggaaaacatgcatttaagattttaggggcccggtgtttgaatagttacacacaaaaaaaaaaaaaaaattgcgtatttaatttttaagtagaaaataaataaataaaatatgcccattatagtcatatactagtatacatttataagttagaaccagtgaatgattttatggatgcattatttttttcttataaaattctgaacttggatagctgtatggctagttggattatcattaattcatcgtaatcaattaaacaggatacaattaattgtgaaagtaattggtaaacgtcaaataattgttcaataatgaacatggaaaagttaagggtaactaaacctcattttatagtgtatgagatcagatgaaaagaagggaagagaagaaagagactgagaaacaatatgatgaaaaaggaataaagaaatagataaaaaatgaagtagaaaaaagaaagttattttgcaaatgtcacagcaatatttattctagtccaatatatacataatttcagctaatatatttcaatcacaaattcgagtttgtatctaaacatgacaacgggctaaacgaggatggacaggcagggccttaatcttcaatcttgactcttcaacatatcttaatttatacgggttgaaatttattatttcattacttaataaaattatattaaaaatctgattttagaaaaaaataaattaattgttacacatttatttttaactatttttatcaataaatttattgtaatacatttgtctacaaaaatcgtcaacaaaaaaatattatattatataaaaattctaaaataaaattaacaagtaataaataaaattaagattaatacatttatcttccttgattctattgttttttaaggtaaacaaaatacaccaaatattaaataacataactcaaagttatagacactaacccaatattcattagttcaaattacaccaaattataaataattagaaaatgaaaacaatcttcatcatcaaaataaccaccaacttcaccaaagatgccatcaacatttctttctggaccgatatttataaaatcaaacatcatatatttagattttctttcaaatcttaaaatcgaacatcacattagtaaataagtatagttattactttactaatcaacaataatatctattgatcttgcaaatgttgaggaatgctactgaccaaagatccacctatattttaaatttttttaaaatttaaactacaaatagtaaataacaatttataagttttaaaaagataaatgacctgtgtgttgtaacttggaatctaaatgagtgaaagaaaaattgaaaatcctaaactaaagtaataaaagagaattttaataatttcatcatctatgactaggggcgggataatgacattccatccccgaccccgaccccgaccccaattagaaaagccaaataatctccaaacccaaagtcatacccaatcaactcaaatatttcttatcaaagtcaaaataagttcaagcatatacccacaaatacggatttcattctcatgcctacttgtatcgaattcataggttggtcgtatatactcgtattagtataaagctcgcgaatcaatgataaaaaaaatttaaagctcgtgaatcaagttttttttaaacaggaaaattaatccaatagtattagttttggaattctaaaatgataatgctcctgaatattgaaagtttagagcatcaattttgcaacaatgacaaaacaaacaaatcgagaaacgagattcgagaagatgcctgcaacatattgttcttaatcaagaagaaaaattgtctcactttcttgcttttttttttcgttgtatatatttttcttggtttatttgcgcttattttttaattattgtcttcgtattactttaattatcatatatatggctggcatggagagaagaggtacataccatttcgccatgttgataaagaaagagggttttaattagaatgtcatatttacacaataataagaatttgtatacttatctcaactctttttaaaaagtatattaaaaaaaaaaaaagccttaacatagagagtgttaatatagcctattaactgtgctagtttaggtttaagtttaagtaaaatttcgaaaaaattgtccttttcagtgaatcatctgactaaattcaaataagttaaagtgaattatgaatactgaaagtctaaatcaaatagaaaagacagtcttagtatgtataacctcgaaagtacacatgcacacaagttaaaactacactacaacataaatacagagaaaattaatattttaaaaaggagccaaaaaaattataatttatctaattattatgatattatgatctatattggtataatattttttttaaaaaggaaaaaaatatgtaaattacaatttcaaagtgttcatttatgaatatggcacggcatggatattattttaaattgtctaaatttcttaagtataataaagaattttcatgatatgtttggatttttaaaatatatgaataacaattatggatgtactaaagggtaaaacgaacagaataaaattactttcctttgaaagactaataaggcaattaacaaaaggaaactcatttgaaacagaattattgtacttattaattaatctattaaaaaaaattcagttcccactttcaccctagttttaagggcgaattaaaataggttatttgaaggaaagaatggagaaataaaacctccaattccttttctttcattcttttctatttttaaatcatctggggatctaataataagcaaaagaatgatatgataccattgcttcttcttttttaaaataatcaaataaaagagaccttgaattaatttctaaaaatttgtttattataattcttaaagcaaaatagatcattaattttaaataacttcatttcgaactagtagaccctgatatacaaatggtttagttggtaaagatttattgctaattaatttcagcttgcatttgaatcatctggagctatattgattcctccatttggtttcacgacaaaacagaaaaaagaagataataaataataaaacggtagcttaagatcatatcaatcttaaaagttaggtatttatccacaaccaaaagtatagttacacacgcaagcacatacactataactgaaacgtcgaaatatatatatacacggtcttaattccacgtacctatatagttcttcattaatccccccataatttgaaatatatataaaaactgtaaaatgattgacatatatatcaaattatcaatgcaaaaaaataaggaccataaataggaattaatcaatagctacgttaccatcgtgttatattgaaaacttctatttctagtagcgtactccttgaccactcttttaactgtgttagctagtgatccaagaaaccttcactaagtagtcctatcaatatatgtacctttcactgagaaagatcaatcatatatggtacgttaatcgtcttgtcaaaaccatctttctccactacatattcgcaacttgcaaagtactcaaatgcaaaacacaccgcccatctctgacatttttgacaaaatttaccaaactatatttaagaatattaatcaagatcagtttcatctgcagtaattctaaatactcatttaatgctcttagatccccggccattaccatatagagacctgtctttcatttccatacaaatctaggtacatatatatatgacttaaagagagaaggagctaattaaccaaggggaagctactgcttaattactacacatacttatatatagacaatgtgaaaatacactgcaagctccaccatatgctaatagaaatgggttaagtgcatgtttaattctgtttatcttgaaaagataattattttaaaaaaaatcctagaaatatatactactaaaaattaataaatcagtgatcaaatttagtgatagaaaattacttttccttcaccagttaatttcgggatcactaaattttagtaacggatttcttttaaaacatatatagatcattccgttactaattttaatttttctaatagtaacataaaatataaaaccattatttttcctagataaaataaatcaaaacatgcactaggtttttggtaagttcatggctcttgtttgccagggaatgatggtagtaggtcttgcaataaaccatagtcacgagggagttggaactgctgctgctgttgaggctggggatggagattatgggaaaggttttggtgaaacattggattttggtgatcattttggctataacttggaagcaactgagcaagaaaatcttggggtaagcttgacgccatataagaggaaccaaaaaaggaaggtgatgacaacatgcttgcagcactgccccttagtgttgctggacagtgatggttgtgttgcccttcatatgttgtgatcacgattgttgggtcctggaatgatctctccacccttttctttacaccgcacttctgactcgtgcatctataatagctcctgcattataaataaagaatcaatgttacattcttacgtgaaatgtgcaattaattgatgagaagtatataatttcttgatgaattaataatttcttggtattgttgaatatatacacgtaagtgtaatattatggtcatatttacaatatatatgtggtatgtctccaatttcatcattagatagtgaataacaaaaacaagcctcaataagtacttacaaataagctgttacacaaccttagtatgacaagaatatgaatcattacatcgatatggcaacaaataaataaataaatagaagactttgtgtgtcaatatgtgatgattttggcacaccccaatattccacaacccttcttaatcatttttttcggctgatacaaatacaagagccctcatcatttttgccttaaaaagttaatattaatgtacaagaactagattagaaatttcgaaattggaaaaaataattaaccttgggtatggactattcttgaccgctttctgtccatattttctccatctgtatccatcttcaaggtgatcgatctcacttttagtcaagaaggcaaagcgaggctctcttggctttttctctttctttttgggtttgttcctgaaacgctccaaaacatcagtcaaattcaccgcaagatggcagataatactcaccaaaccgataacaattattttagggttaagtgcctataattgttccacactctccaccattttagtcatacacacaaaaacctacacacactggatatagtataagagagtagagacaagattgacaaaattcatttcataagagacactgaaagtcataaacaactgaaaagacacgaaatgatatatgggcatactataattgcattagtaaatactactaaatagtacattcaaagaagaaaattcaaaattctacataccctctagaaaataacagttaataattaataagataatcagatcctattcatgaattgttaaaagaagaaaaagagaaagtctatgaggaaattaaaatcttcttaccctccattgatctataagaaatcacaaagaaagagggcaaaagaagaagaatttttaatttaaacctactctttcttaggcttttcatctccttcttcacacccttttggctgcttatctttctggttcttggttgagtcttcttctatgattgcttcagcttcattggatgatgaagacacagatgaattaggtgttgattgttggttcccactgacccccacagactctcctcctgcactaggcttcttggggttttcatcaatattggaggatatcacttcagaagatgaacaaggcatgtcaaaggctcttgagagggtgttgtaatccatggaaccatgtaagcagtcagtgaaagtggtgtgatgatgagaagaagggttattatgatcatcaaacccttgaaagtttaattgtgagccaattggtgctgagttgttgttgttgtccctaaagaatggaaagcttgatgatgagtggttgagttgctgatcatggtggtggttgtaatgaaagggatcataaaaacggtccttctcattctccatggaagagagaaactgaagagatgggagaatgggagaaggagaaggttggaggaggaagggccagatcaaaaaataaaggtagctttgagaatgatatttcagctaagacttaaattcgatgtggttgcttgttatgggaaagtgagcttttggtttagaactttgtttttcttcttgcttttattcccttctacttttgcacctcactttagtgtttggagctaattggggagtgtttctctatcttaatctttctaaagtcagtgtgtggttcattttttttctaaagcaaatcaatttttcttctttcaaaataaataaaggaacaattgtttatatcacttgtttctcgatttaatagtaatacaccgtatattctcaaacaacatctaatcatattttacatatatcacttgtttacacacactttaatttgtgttgaaaaaaatatcttgtataattttttttgtcttatgagaacgttaaagttgtcgtcgcatgactttaagcttaagagttcaaatcttaaaaatagtaagttgcattatttttttttctgttcatatattatgcaatttgacatattttaaagggtgtaaaaaagtatataaaataattaacatgaggcaaatattttaatcctcaaaaggcaatcgattcgagaattattagtcagttggttgaaagatttattacctatatagttgatagcgacttctcaattaattgaagcactcctttattaatttatttgatcgttttgaatctaatcaaaagagaaagaaaaataacaagttgaataatgcttgcatgctaagatgtttctctttttatataataaaagataattgatgttatataagaaggcaacaatgctatgtattttattagaaggtttttggcttgctttgtaatgtttaagaagagaaaaataataaaaacctcaacctcaaatttacattttgtgttcatttgagctccacgtatatggtttggtttggtaggatcttatatgatagcgtgattgattatccggggtccttgcattcgtatgttgacaaggcacaataccttctagctagtatatattattacatttctaaatacaaataattaatatgtattattacataaacaaatgaatataaataatttgtattcatgtacattatcattactatcattgttggagatagtttttgacagagaagggaagtggcatgggggggtcgtagtcacgttgttaacaagggagtggagttagtcaagaattccgactataagcattttgtttttgtaattttggaggtttattcttacacgtgtcatgcgattgggcaccggcatttgaccggagagtgacacgtacgagagattcgttcgctgctattgttgattgttcagctccaacgcaaattcttcggtatttaaaaagtagtaagaaaaaacaatacttctatattatatattaattaaatacatgaatccatttagatataataatattaaaactatagtataaaataaaataaaaaacataatgtataaataatagtataaatttaataatgcggatttttattctttctataacaacaagaaggaaaaaaaaaaacttatgctgttcctcatcacgcctagctatgtctatgactatggctatatattgtgttgctgagtgggttttcacgtcacattccttttttccctttctttctgcccgaagtttgtgttgggtaatctcggaccctcaaatatcaaattgcggaagcggaataaaatcaaaaaggggagcgagagagacaatcaaatagctttacgtgggagaaaaccttcttcaacacgaagaggaaaacccacgggaccaagtccagatcaaatattcactataacaataatggattacaatgaatcaaatacaccaatgtggtggtacactcaacctctccaacaatggtggtcactcaaactccctagagtgtttcactcaaactctctctagagatctctcaaatgcatagcacaaggcttgctcaaatactgcggaatctctcacgcagtcaaatatcaaatagcggagtatctcaacgctctctcaaatatgcaagcatggaggcttgctcaaatgtgctctcaagattgtcacttgaggctctcaaatttctgtgtattttgccttcacccttgctcatctatttatagggtgaaatgggctgggtttaagccatcaaatcaaataagattatatcttatcaattaaaagatatctattatatcttatcaaataaatatcttctcaaataaatatcttatcaaataaaaataagattatcaatcaactaaaaacggaaattatccaacaaatctcccccttccgtttttcagtgagacctgggtcttcaacttcaacaacccggccttctttctcggcttcaatgtgccgaattcatcagcccggcttcttcacagcaatcttcaaattttcatgctggtaccggcttggtcaacatatcggaccagttcaaatcggtgtgcactttgctaagtattctgcaacgtactcggcctcggtcgtccatagtgtcacacacttctgcaatcttgattgccaagagactgctcctccaacaaatctcatcaaatatcccgtcgtcgattttctcgagtcggaatctccccctaagtcggcatccgagtagccttgcatctcggccaactcataagtctggttttcatgcagggaattcatcacgtcctgcatttccttcttggggtatctcggttgttcttcttcaaccgttgtagaactcggttcatcaccccggttctcttcatcaactcggacctcaatatcttggtcctcatcagcttcttgctggagatcatcatcttcagtttctccccctgcttcagtctgcacaagagggacgggttcttcaccacggtcacgagggcagtcgggttcttcacgtctgacagtaacccggtcttggggcttcgagatatcatgaagagtctcatcttcatgaaagatcacatctcgacttctcactatcttcttcttgataggatcccacagtctgaacccaaactcggttttcgacgaaccaaggtagatgcattccttcgtcttctcatcgagctttgccctttcatctttagggatattcactaaagctcggcatccaaacacctttaggtgatcataggtcgctttccgacctgtccagacttcttcaggaatgtcttcttcaagtggtcttgatggtgacaaattaatcaagtcaactgctgttctgacggcttctccccaatatgctttcgacaatcgagcattggatagcatacttcggaccttttcttcaatagtccggttcatcatctcggcaagtccattcaactgcggagtctttggaggcgtcttctcaaatcggatcccggcttgtttacaataagcatcaaagggaccgcaatactcaccaccattatcagatcgaaccactttcaacttcttgccagtctccctttccaccatcgcgtggaattctttgaaacattggagtacctggtctttggtcttcatcaaataaacccacactttgcgggaatgatcatcaacgaaagaaacaaaatacagagctccaccgagtgatctctcagtcatggagcatacatctgtatggacgaggtcaagaatcctcttgcgtcgtctgggctgatccggtctcacaaacgaaacccggtgctgtctttcagctaggcagtgcgagcaactctccagcacttggtcattcaacccggtcaatagttctttcttactcaacatctggagtcctttctcactcatgtggccaagacgcttgtgccacaactccaggcaatatccatctcggacagaattggtttcttcaccaattgtctttccttgcatcacatacaaggaaccatctttctttccacgagccataaccaaatttcccttggtcagcttccatatactttctccgaagtagtttaccaacccggcatcatcaagcttgcctaccgagatcaaattcaaacgcatgtcaggtacatgcctcacatctttcaacagaagtcggcacccgacatttgtggtcaggattacatcaccgacaccaacaatcttgctggtcacctgatttcccatcttcacgataccataatctcccttcctgtaagcggagaagaatccctcatgtggggtgacgtggaacgaggcaccggaatcaacaatccaggtgcagtcatcatgggctatgttcaacattttctcactgaggaggaatatctcggtattcgggttagtagccacagctgtagtgctcgtatcattcttcttctggggaacaatctgatctggcttcacgcagccattctgttcatcattttgcaaggcccagcagtccggcctcttgtgtcctaccttcccacagtagaagcacttcaaatcatgttttggcctagtccggcctctggacgtatctcgtccacctcgacctctgcccttgtcacgaccccggtagtcggtctttcctctgttctcagcaacgttagcctcaaacgtgctggatacacctcgttctcttctcctggcttcttcattcaggagactgtctgtcacggcatccatcgtcagttttccttctggaaccgagttgctcaaagtcaccaccaaagtatcccagctttccggtagtgaactcagcaacaacaaagcctgcatctcgtcatcaatcttcatgttggctttggacagttgattcaaaatacctttgtaggtgttgaggtgctcaatcatactcatgtcgtccttgtactcaagcttcacaagccggcgaaccaggtgtgctttgttcctgggagtcttcttctgaatcatggattctaacttgttccacaattcgtacgcgttcgtgaactcggacacgtgctcaaagaggcttttgtcgatatatttcctgatcgtggccacggccttccgactcaggatctcccactccttgtccgacttcccagtcggcttttcttcaagaacaatgggatcatataaatccttgcagataagatgatcctccatcatcgacctccagtagttgaagttatctgcggtcaacttgaacatatctccgtcatgagttatgccactggtctccatctcggctccttcagaacccttgaacctgggctctgataccactgttgggtaatctcggaccctcaaatatcaaattgcggaagcggaataaaatcaaaaaggggagcgagagagacaatcaaatagctttacgtgggagaaaaccttcttcaacacgaagaggaaaacccacgggaccaagtccagatcaaatattcactataacaataatggattacaatgaatcaaatacaccaatgtggtggtacactcaacctctccaacaatggtggtcactcaaactccctagagtgtttcactcaaactctctctagagatctctcaaatgcatagcacaaggcttgctcaaatactgcggaatctctcacgcagtcaaatatcaaatagcggagtatctcaacgctctctcaaatatgcaagcatggaggcttgctcaaatgtgctctcaagattgtcacttgaggctctcaaatttctgtgtattttgccttcacccttgctcatctatttatagggtgaaatgggctgggtttaagccatcaaatcaaataagattatatcttatcaattaaaagatatctattatatcttatcaaataaatatcttctcaaataaatatcttatcaaataaaaataagattatcaatcaactaaaaacggaaattatccaacagtttgtggcacgcatctggttccatttccctcccttatgccttatcatatgctcatatgctcacactatcacattcacatcaaatcaaaagaggaaaataagatggtcaaatgtgatgtatatatccaacgccaaccccatttccccactcttctgtatttgtaaacttctcacttgtctcgtatagttgcatacactatttttaattaactataagcaagagaataagtctaagcagatccaaactaatgtttatgtatgtgcaataggactttatatacatgaagcatatcaatgtgtgtgtaagcattaagtttgttttattatgaacttttagactttagctccatatataaagtttcctgtcctcttttaattaattagatgtacatacaagtcaaaaaattcaatctgaagaatagatcgaggtaaagaggagatcaatctgttaatgaattattaattaacttcaggcgtctcataagacgaatcaaagtctaccatttgtcgaaataattagatccttactatgttatttaggtcatctagctctttatattttgttattcattcacactcttccataactcaattagcacttagataataatatattgccccttcaagtgtctcctaacccgaatttacgatggaaaagatatctagcattgaatgatttctaggatatatgataaaatagtagaaaacgcctttaatttaattttagtctgagattttttgtacatggctacctttttttatttcctttttctttttcaattcacattagaaattaaagacttttttccccccactttagtgtagactaggagactctaaaatagtatttttttagataataatatatattgacaatctgcaccgtataagatatagactgtaaagtttattatcaagcctatattggtgcaaatcttattttgtcttgtcgttataaagtagctaggcagtgtattgatgtcaaaaggactcactatttctttatttgcttaagtttttaaagaaaatatataaataatttaatttatatctattgttagcgttaatttaaccaccacaccattcttttaattaatatatgtgatgattgggtaaattcctattgtgtaaaaatatgttgcaatacatataacttaaactaaaaaaataaattattaattagattttgattatgatatagtatttgaatataagttatttaatctgattaaaatatgatagactcatttaaaagcgaatatttttacaaaacaagaattcataactttatttgaagattaccatatacaatacttataactacttaaactgttaacaagtgacagtgtagcaaaatataatcggaaaaaaaaatagcataacaagttttagctttttacaggtaaagaagtgaaattcgatcgttgaatatataattaaactttctgacattcattccttcatgtatagtaagctgaaaacaaaaacctcgattgaatcctgggatgttcactaatgaccagaccctcaacttaaagctaaagccgtttgttacaaatttacaataatatttaatcgcaaattaaacatgaaagttgagacctctttttaattgaaaaggtccccttttggagacaaaccggtgaatgatcccttaaaaataacagatagggttactgaataatatatatgtctgctccttctcaaagtaagacctcccattcccaattcccatatatctaatatctctgagaagaaaagttggtaaaccaaagacttttcttctgtttggtgggtgcaaaaatgcaaacccaacaatcagagcaccgcccattcaacaatcagagcacatcctaaatgtccccaccaaaccaagctgaaaggaacgtcgataaaaggaggatcaacatctttttattcttgtattcatttttaagtaattaggattcatgaatttattttcaaaaatgaaaaaaaaaaaacatagttcatgatgttatactatattttaattagtggtgtccaatataattctttaagaatatttgatgtgggagttttaaatatgtatatttagctgttgatttcatttctcatcgagtttttttagatttttataattaattaaacaaaaataaatgataaagtattttaaagcatataatggttagcgagatttttatttacgtgatagcatattagagtatgatgatggtaatttatatcattcggcgcaattttatcaattatcaataaatataaatttgacaaacaaatatatttttattagtcaagtataaagtaatttttggtacaaagtagaatataaagtattcatatatattagaaataaagagaaaagaaaactaaaatagaggttgtagcattagcatcattgctttgcctttcccttgacttgactccgctgaccacggaccacaggattttattacaagctggaatttttagtttaactacctgagttaattaagctcaaataataatactacattagattttattaaatatatagttttaaattatcaatgaattatatctgttcacttatgttaaaaaaataattaaagtgaatatttgttattatgattatatgatatttctttatttatggattatttaaataatcttacattataacaaagttaattttcttttaatatatatgttgtgttgaccaaaaaaatcaaaagaaatggatggcaagcaagatttcctgggttcatgattatatccttctttctctgacaactgaaaactctttacgaggagcatgaaattgttgacatatttgaatgcttttgtgatggattagacttggtaacttcaatccgatcgacttgctggcattcatcccgtacaacgttaatttgaatgctaaaagcaaaaaaataattagatccaggatgtgattctcttctctctagctatctagatttcttttttgaatgatctctatctagatttaaaatctaagttttcgatgaaaattgcaaaaatttcttgtcaacaataagatattaggttttttttaaaaaaattatttatcgtaatcaggaatatgatggaggcgaacaaaaactttaaaatgagttaataacaaatgagactcatcaccaaaatttatttaatttagaaataacattgatgaaacccctttttaaaagaaaaagaaaatgttttcagaaaagaagtttggatttaggagctaaatacacaaggaaaagtgataatatcgtattatgtacgttttaaaagaatagttactcttaaccaaatgtgtaaaataatgatgattttattttacttccatgtttttgtttgtaaaaagaatgaggaagaaactttatctatttatttaagaaaatggatgtatatttctagttaagaatctcgtgtgattttgaaaataaaagggttgtaatgtctggagtctacgattgacgtggcgagtaatacgataatgagtatttcttgtcagccgtccatcttaatcattcttgggccacgagcatggatgttctccatatggccaatcctaggcagttcctctgttacgaagttgtaatgcggttacaccttactaaagtcgttgttatgctatcgtaacaacctctaagttaacaatctaggattttcaaccatcattataaataatcaggtcttatatttactttaattgaactgttctaatatactattccctcaaacactcacttgagtatagaattccttttgcaggtatcttttgtcattcctcaagtagaggatactagcggattcaatatcacgaagatcactggaatcaacactcatcactagaattaatactgataattattaactctaatgttagatccgttccaaattttggtaagtacataggttaaattttgaaaaaaaattagcttgacaaagagaaatgtcactcttaattaattaaaaacttatatagttacctggtttttttcttcttttttttaagattgtggtttgattattattttttatttgattattctaaagacataaaatgttgtttcatatcgaattagggttaaaaaagttgcaagtggactaaaaagtttaaactctaaaagttaaaaaatatataaaaattaaatataataagtaattaatttggtgaatcagatatagattagatcagattctgaaaattaaaatttaagattccatcggaattaatcaaatcaataatttttcaatctaatttttatcaatgatccgaaccattcaattttttttgttgaattagtttgggtttcatcgaattatcagattgatctagatttgtgatcatccacttttaaatacaagatatttaggtatgaaataccaagctatcaattctatttaaagcttgacctttatctcatcgtgtcttccttgatgtccaataatccatgcgtgtatttcttcaagtgacttcaataagactttatcataagctctactttaatggtttaggcgttgtattatttcatgattctgctctactaatacaaactagatctttattgtcattaatatcagcaaggtatgtttcctttattgggtcatggagctggaccaagatctttgtctttatcatcacattctcatcagattttggctcccttaccgtatacacttgtacaatctcacattctggctccttctccaccaccaagtgttgtgcattctcatattctgacttcagaaagtcctacaaataatctggttctgactactacacattacacaagtcttgtacctttaccttctcagaccctatacatccaagaagaacttggcagcaaggagattttcaagatttgtcatccgacggattacatcgaaattggccaacaaactaccactgacagcagcttactttctacctattatcttttttctatatttctttcatttttactagttgcagagcctaactattgaaaatatgtttcaatattgaaaatgaataatttagtttttaataacttactaattataagaacagtctcttatttaattaatgacatcttaacccttttaaaatatttatgttttctatttctagacacgattttgaattttttttataattatttcaatgtgtaaagtgtatttcattggattcatctacatgaaaattataagaatcaactaaggacttgtttatataagcttctttaaaagtacttctaaaaaaagaaaataagaagaaaaaaatgaccataaacaaaaataagttcttcattaactaatttttagatattcaccaatatagtttctctaaaagatgagatgacatctacaaatttatagtttgtttgaaatagttttacttaatttaattaattagttttgatttaaaaatttgacttgcattttaaaactacaatctagttacaatatatcaaattgatgagatttattttttctaagagtattgtcatcttattaaaatttaatttaaatttaatttttatatatcacattaaacatacacaaagataatatatcttgtttcaaataatttatttccataattccttccacagttttagtaatcttatatctttaatttatttactatatattaataaaataaagtgcctattttaatactaaaggcatttttaatatttttttcttcatatgtgtaaatttatcatatttagtaacatgatattttccttacatgttttaatttaaaaaaaaaaatacttatactttggaaatatttgtgcaatgcaccaataatttgtttagtatgcttagaccacatttgttgctacaggagcatttaggcaaacaatatgaccattgaccaatgagctcagttgctggaaaacagttaacaaacagtaacatggtaagactgtggaatacaagaccagacttggatcatgtcaagattccaaaagcacgagagccttctattctcccagtcttctctacagttatgcataacataaaaaaggctcagatagtttgctagagacactgtgaaacaaaggctccaaacatgttggaaatgccaacaaaggttagtacagttggtaagaactgagttcatattccttaaggatatataagttcattctattgtcgatgtgaaaactttggtgagagataatctataagcatctttgtaagcgtttttttgagcctcgagacctccctaggtcttggtgaaagccggtagtttgcatgattcaccacctcttcacctccctccggttcctcaacctgtccttcaatgcattatccagcaaagttctttaaatctcaggactcagcagacaccgaacaagacctcgaccagaaaggagaatttcaagatttgtcatccaacagaggccaggaagaacttgattgccttggaagccattcttcttggtcacgcttcctctctgtcccctcatgaactcaaaagcacaaataagttcattaaatcaaagttccctagtggaagaatggtacagtgcaagaacattgagcatcaaaactggtcaagaaatcactagcagcttagtattttccacatatcactcttcactgtcattttttataattagttgacaattgcttatgcggcaaaaactgtttgcagtgttagttgcagagctaacagaataattgcagtgttactgggccgaacagaattacacgctcaatgttctcttcaaattcccctctctttccctcttccttgctcttctttctctacagttgacttcttttttgtcacgagggagtgaaatagagtatttttgtcattcatacgtgcgtgagcgttcaattgtagatgcatcagacagaactgaacacgcatatcatgtttggaacaaaggggcatgcaattctatattattttaatgtgagaaaggaggtgtaggtggctaatattgcgaagtaaagcgtaataattatatgccatgagatatctgttggagaaggcaattgacatgagccaagttaggcagagttaggctgagtaatgcaaaaaacaataatttgtggttggttggcattacttaactccatcctacaaaataatcattcttttgggatcctataaaatttattgtcacaattcaactacttaagcaattctatgaagcagaaaagagcgatttgctctttgttactgcacattttcctcaaagtgtcttatgtttggtgaaatggatagtaagcaagaacaagacaagggaaactcaaacatgtctggcattgatgtagctctaatatctcccaaagtcccaaaagcagtttcaccagtttcctctgcagcagaaggggacaccttaaggcgaccacgtggccggccggccggctccaaaaacaaacctaagccaccaataattgtcaccagagatagtgctaatgcactgaaggctcatgccatggaagtgagctcaggctgtgatgtgaatgaaagtttgttgaactttgcaaggagaaagcaacgtggcctttacatactcaatgcaacaggctgcgtaacaaatgtaacattgcgccaaccaggctcagctggtgccattgtgacccttcatggtcgattcgagattctttcactgctggggtcaatccttcccccaccagcccctccagggatcacaggcctcacaatttacttggcaggtgctcaagggcaagttgtgggaggtgctgttgttggtgctttgattgcttcaggccctcttgtaatcatggctgcatcattcatgcatgctactttcgatcgccttccattggaagatgatgaacttgcttctgcaatgcagaatcagcattaccaaaatggacgcacccaccatcttgatatttctgacttgtatgcaatgccacaaaacctgctcatgaatggtacaatgcccccagagatatactcttgggcaccagggaggaacttctcaaaaacctgaaacgtagcatactatttgttagttgttgtctcacattcacaaaatgtactgtactgtagctatcaggggtcttccaaggttgacattgcaaaacaagatgataatgcttattctgatgtattaagaattattttagcaaattaatgggtgtaatgattttcaatacaataagatctacttttcagagttaatattgcatattgcagcagtttgtgttagaacttcaaagcaaacatgcatgaagcacagaagttgagattggtaagtctagcaaggtttgaattacattcactagcaaaaaagtaaactttagttatcactacactaaaccagctaatagtaaaggttgtataaatatcaatactaaatagcttttttctggaggcctaaagcaagagtttgagtgaccttatgcatggtttagccctgcagacagacctagattcaaatttatacaagcttaaatagacaccacgttctctaattaagttaccaatatgactggaataatttgggaagacataatataacataatgaaatggatttttgcatatttaaatttcatgtcatggccctgtgcccctatcttactctttctactttaggaacttttttccctaattaaactaaaaatcccagtgtattgacaaacaaattggatatatggttcgattgtgagatcctcatatattgtaactcttctctgtattaaagctacttccttacatacagattgatttttaaatttcacgagttcatcccttcggagataatcaatcttgaagtacaaaactggagtcattcagtaaagagtaaatctctcgagctttaggatgtagcctccccccagccaagaactcatgaacctctccatatagttctattgaactgcatcctggttccttctctgccaatctttctctcatcaaaattctttgctccattgcctcttcaaattggttggatgcagcctgaacattagacataagtaaataaccactggcatcacttggatttaactcacagactctttgtgcagctcgtttcgcaatttctacattcccatgcttcctacaagatgaaagcaaagccccccatataataaaatctgcctttagaggcataccctttattagttgttcggcttcttctagtagcgcagcttgacctagcacttcaaccatgcaagtgtagtgttttatcgatggctcaatctcatacttatccatcatcagtgcaaaatagtcccttgcttttcctattgctcctatatatttacaagcagttaaaacaccaatgaaacttacatggtctggctttaaatctgaggcttcaagcttagagaagtactcaattgcttttctctcataaccattcatggcaagtcctattataatggagttccaacatgataatcctcttgtgggtgatgcctcaaacacttcaatagcctttacaatagctccacacttgcagtacatgtcaataattgctgtgagaacaatgacattcaactcaaaatgacccctttttacataatcatgaacccactccccatgtttaagtgctcctaaatgggcacaagcacttaacaagctcaccattgtaaattcactaggctcaaccctttctccctgcatcttgcggaaaagctccaatgcctccatcagcctcttattcctaacataaccactaatcatagaattccaagtaactctggttcttgtaggcatgttatcaaacaacctcctagacttatcaacctccccacacttagcaaggcccataatcatagaattgcaagccaccaaatcaagttccagaagttcatcaaacactctcctagcctcactcaataacccactattagcatacatgtaaatgatagtattttgaataaactggtccttctcaagacccaacttaacaaccctcccatgaagctgagctccatcatagccagcacccagttgagcataagccttgaaaacagaagggtaagtcaagcgttgtggctgaactgaagaacacaacatatcaacaaaaagagatattgcaagatgtggggttgagctccgagagaagcctctgatgatggtgttccagcaataaaggtttgggcttggaatggtggtgaagagcaagtaggcatagttgatgtcaccggatgaagaggcgcagaaagtgaggacgcggctagcagcaacggtgtggtgagcaaggccggttttgatgatgtggacatggatcttttgaaggtctttcatgttggagcattgggtttggagcatggtgaggcatggttggtcggagatgaactttgctatggagggtgatgatgatgatgatgataatggaggaagtgcagaacaaagagttgacattgtcattgtgtgtggtcgggactaaggaaagatagatgatgagtggactctacacttcccttttgagctggaaattcataactaactagatataaatctgcaaactgtgggactactaaatatctaagaaaaaaaattatcccctctttatcaaattagaaaacaaattataaaatgttttttattttagtggattcttttaaataattcaggaatcaatacatgattataaaaatatgaatgttttaatattcaatagtttaaagccaaaaaaaagaaaggaaaaatatttaacaaatttgtttgtccaaaaaagtcaaataatataaaagagtgtctttatctatttcaaaattattagattagttgtgttttactttaaaagagtgtctttatgactttatcttttttttttctttagttttattttctaatatttttacaacattattttatagtattttcctattcaaatgaatgtaatttaatttgtaacgcacattgagtttgtgtaaaaagatatgagtttgatcttacagaatacatcgttgaaaaaatatgaataactttaaatatcagtatgtttgaatcaaaaattagtcctataattagcttaaagattcaaaatttgtaaaaatactgaggtttcagccaaagacaaaaactctaattactactattaaaaaaatagaatttttctaatttctgaattctattatcatgcatttttttcttcgaggttcttttgtaggctatttagcctttttcaagttgtttttaccattaagctccaaatgaattacatgtcaaagtatttaaccttatagttaaattgtgatatttgtggccaatgcgggttggcagagtggttaacaatccagattgaacttttatatttttcatgggtgtgggtttgaatctccttgatgtccctttctctggttggtgggcatccttcttcaaagagatcccttgacatcttgtaactgagtagttgcaacctaatagaattacttgaggatctagcatgtacaatattcctttaggtaataaccctcaattgacagtcctagcatgtctatgacattttatctagtagtatgtgaaatatctttccattttaccattttcaacactaaaaagaaaatgtgatatttgtataagaaaaaattgactaaaaaaataataagttgagactcaatcgcatttgatcatcctctaatatgtcacttactatctttcatttagcactttctaacatactaagtatttttaaaataaaaataagttataaataaattcatgtaacctttaatcaaaacccgaaaatactgtaataataataggctatgattttcatgatataacatataaggattggatggttatcaatcgtaaataaattctacattatcatattatcattaatattttaaattaaatgaccgttcaattctaagattggtgtcaatcaaataaaaaaaatcaagtatgattgtttgtattttaaataattgaatcattaattcttgacaataaattattttccgaattaattgtataattacaaaaataactttagttttggggagaaatttttttggctaatgtatattattttaagtaataaaagattttagattttatgtaaatttgaaaatgaaaactgaaaataaacattcacaccaagtatcacctaagatttccaccttttttatggaaaagtttttgtgaaaaaactgattaaaaaatattcttgggaaacatcattcctcatgaatgttattttttaaaatgcataccacacgtggaaaactaaggaggcttttggtagaagaaaaaaaatttcatgctcgaaaatcatgtttccataaaatgagtaaaatttgtttgtttgattggtcatcagaaatttatgaaagtgtcataggaattaaaaaaaaggtaatatttttactgtaataaaaaaaattaatctcaaaaaagtattctcacatctctcatgagaaagttttcgtaaaaaaatatttctgaaatattatttttcataaattttatttttttaaaatgatgatcaaccatgaaaaattaaaattcataatcaagattacctagaaactcaaaacttatccaaaattaaaattcctaatcaagattcctagaaactcaaaacttatccctatcaatgcctcttaaatttcttaacatatgatttctaaaaaaacaaaaaacttctatcataccaaatgctctccacaatgtctcttttctccaattgacaaaatgtaaataagccactagtaacttgaactttacgtatggtctatttgaatataagtcatgagtatttttgaaagtttttttaatagaaatataaaacattttcaagtagagaaattctcataaacacttctaaccttatatccaaccaaacttataatcttatacttccacaacaaagtactaacataatgcaagacatagtttagatttagatcctactaagaataaaggagaaaaaacaagagaagaagaagaaatagaataagtcatagacaacagtaaaaggggaaaaatagaaaagagaaaggcaaactgtacacatcagcaccatcattacaatcatcacttacaagcccacaaaccgagtctatattccaaacaattctttctttacttcgttttcaaccttcttccccaccttttccctcctttttgctccttctcttgcttcagttgcttgcaccctccaacactctccctcaccacaccccattttcgctttcttaaaccctctcctttgtctctcacaacctcacagtcttccactaccactatatatacttttagttgcatgattaacccacaaaacaaccatcttcctttttttccctctctagttcatcatatcttcctttctctttcatttagtcaaaggaaaaactactattactggggaaccacattaaaaaagaagtgagaaaggacaagcaagtgtcaaagaagaagaagctgaatactaagattaaagatggaaaggagtgtattttactatgtaatatttctcttaatgtgtcatttcctctgttcaggtaatcccctttgtctagttttttctatagttcttctatcttccttcttcttcttttttatctttggtttagctctgatggctctattctgatattgtttcttaattctcagtgtctttggttctcgttttccttctttttcaaatttccaattgcttattctttatctcctgcacatattctgtgtttttctctttaatttatatttttttggaccccttgaatttgttttgaattctgaaaccacaaaaactttttccttctctcaagtttggcatctcaattgttttattctcttctagttttttagttcaaccagtaccattatggatataaattttggactgattaggagaaaatcacttcttttttttagtttgatagtccatcttggcttctttctgttggaatatagtttactaattgagcttttcactttttcttgtttatggataataagtttcctagatcaaaatactgtctcttgtattattccattaaatacttgttccagcaattatagagccacaccatagaaaagtttaaacaagtccttttcttgctaatttttctggggtttcacatagtacagttgcatccaacctttctccaattccaccgtttcttgaaaagatacaaagggcccaactgctttgactcacatatgcctctttctacatagtataccctacctgtccttaactgactgcccttctagttgcactattccaagttgttgccttttgaaataatggagaggtctaagtcttaagggcataaatataataattagtttgaatcaaaatttctacaactattccgatgaatagcaaaacagattttgttttccataccagcatgaatgttatagccttataggcacaatttgaatccagttacactttttttgcatccctttgaaaaaggaaaaggcttggattgatttcaaatccatattttgatttctctcttcacatgctttggacatatagtacagaacaaagtaattcagttgttatttcaaacataggttcaagtaggacacaaaaggaagtacctgtatatgtgaatgtactgggacatgatcaagggaaacaagaattcactgcctcaatttctacagtccaaagggatattaccactcccatcaccaccattccaaacttagttcccaccactcccaccatttcaacatctccattcctgaatcctaattccaatcctaattccaatccagacacagtctgtccagcctccacaagcccatttaccactccaaccactgtgaattctccaatcttctcaggtgcaagctggtgcattgcaagcccaactgcctcacagactactctacaagttgcattggactatgcttgtggctatggtggtgctgattgctcagcaatacaacctggtggaagctgttacaacccacattccatcagggaccatgcttcttatgccttcaataagtattatcaaaagaatcctgttccaaatagctgcaattttggtggaactgctgtcatcattagcactaacccaagtaaggcctttgctattataattctcgttgcaactttttcaataacgtcacatgtattttaattttaaggcaagtccaaaggtatggtcaagtcgttgggtatattgaaaattcaagcaaaaattaggcttgattacaaaatttttccttactttttcaatttcacaacatctttcaatatttttttccttccaaatttgagtccattattttagttgtgccattttgatttatctgtttacttactaatatataatatttaatagaaatgttaacatgtcactataatgcattatcacattaatattttcatattgacataatattctattactatattattatattagtatttatattaaatattagattataagttgacatataaattaatgcataattaaaaatagagatcaaattcacaaataaacaaaaaataaaataacaaaatttgtaaaactaaaaaaattaaacttagaaaatagaagttgaagtttagtagatgatgaaaatataattataaaaggaaaggagtatgcaaactagcagaagaagtgtgtgtcacatagttttaaaaatgggttaggtgactaagtcatggcattaggtcattagatcagtggtcgaattggtgagtcattaattgactcgcatgattcggtctgtaataaaaaatataaaatttttatatctatcttaaaatctttctcctgaaatacattgaaattcaaaagtattaaaaatacaaataaaatataaagaatacaagttaaaaaatgactattatctctaacatttaacatcaacgataatatatattaatattcacactaaaatgaaatatagtcatatcacatcaatgtagattataaaatataaaagttcaatttaaagtttcaaatcacaattttaaaaaatgatccgagatcacaatttcacttgcaactcaaatacaattgtggtcacgtctaaatcaatttaacttagcaaaaaatgcaattacgaccacaagaaaggctcaacaataaatgaaaagatcaatttaattcaaaattacacacacaaactaaaataaaataaaatgaaaaagaaaaaataaatttagttggactcacttgcaactggagaacttacaaatgagagaaaagaatgagaggttgtcgaacacactgaatgagactacgagaagaaaaatgataggtcgataaagtttttaaaattaaaatgggtttaaatttaaattaactcattttgattataacaaaaaaaaaaaaaaataagtgaccatctctggatcgacgggtcaccgttcaaccaaaattccgaccgaggcttttgggttaaaaaatgtaaccaattgaacttatgagtcaatcctattcaattatcgaatcgtgattcaacttatcgggtcgatttgagttttaaatctctggtgtgccaaagagaggttgggtcccttgggttggtaatcagacgcatccctgcgcatgattgttgggttccttccattctgaaaagactacaaaaggaagaaacttttattgcatatttgaattgattatagcctgtcacttggggttggggatgcaggagctacaaagctgacatctgcgtgatgcaaaagtcaaacttttattcaacttttttggaagcagcatctccaaaaagcttcctttattggccaattggggtaattttttttcaaatttatcatttgaagataaaatttaaaaattaatattttaaaataggtaaattgtaggtaatttattatttttgaattaaaaattataacatgtgttattatttcttttttacatgaaaatcataaaaaaaatattttttattattttaaatacatcttaaagtagtaagattttttttcactcagccaattttaaagttgtaaaataacttttttcttttttcattagagtagtaaattattttatgtcttcaaattctttttgtacttttcttaattataagtaattttttattttaattatttaatgtatattttttagttttattttatatattttatatttttatataatattttatatttaatattatttattaatgttaaggactattatttattttgtaaattaagaaaaaatacaaaagagttaaatacctattatcacaaatagtatctataagtagctattcatcgcaatttttttcattaattgtgcttatataccttgcttacgaactatacagagaaaaataatattagccacttaaattcaaaatgaagtaacataatgctttgtacaaaatttatgaacttagtggttaggattatttaccgataataattattttttaaagattttaacttaaaaaattatgaaaaaaaaatttcaaaaaaataatgacatatatatacacttatgttagtttctttttctcttaattgaatgtcttgcttatttaaccaattataaatttgtaatattcattctcacctattaagtgacgattttataaaaaaaatttcgaatataaaaatattttgtgtaagatcttgaataaaaattttcaatattgtcaataaaagaatattgttcaaaaaagaatatttttttcctttttttccctaatatttcaaaataagatctataatatcttgagaaatcttcaattttacttttgacatgatattaaaaagtgatctaacatctcaattaagaatttaatattaaagatgttgtgaaaagtcttttattatctttatcttttacagaacatatacattaaaatttgatgtacatttttgttttatttttcagcatagaacactatgctcctccaatattatttaatttttggttgttgagaacatttgatgaatgcatttacgtgttttgcaggctctggggcatgtcaatatccatcaactaggtgacccaatcttgccatatatatggtttcattttttttaatatacatatactatgctttatttgttactatgttgcaacaattggaacagaaaatatcatattaattaacttaatagttggtacctaaaattgcagcactagtacatcagtgttgaacacaacaaactcaagcggtgccaacgtttttggttcagtgccagtgcctacagaaccctctccctatgctgctgctgcacctgacacattaaatagctttgcagatatttgtgtcgttctgtggataatttcaactttgcaaagaaattatctctaaaatggttgagagttggatgttgctgttctgagcaaataatttttgccccttttacagactttttgggagacacaaaagccaatagctacatgaccatcaacagcacataaatggtagaaacacatggtagaaagaaaaggcaatttaagatgatggacatatgtagagatatatactgtacataacttttttattttttttgtgttgctcatttttttacgttagaattgttagaacttagaaaaataaatatatctttgaagttgccttatgaccttatctttttagttatataaaccaggatcagttttgttgtctaagctaaggatctacatctaatctaatttttaacaaacagaatggattacactaaaaagatgtaaatttcttacatatataagtgaccaactcatacaaacaatttttctttacgttttgctttatataaaatatcattatagaacaatttgaaccaataaaataattgttgttgcacaatttgcaatataatgtatacatgttgatttaaaatataatttcttagatgtttatttttttccaacgtgtaattaagatcaatatgttggcattacaaaatatgtatagtggtgggtaccatcttttgattatgaccattggagtttgtttacatggcatgtactgaaggcacaggtcccttactcataaattctcacaacttcaactatgcaaaacaggaagagaataaacagtcccaatgtcacctacaacaggtttagggttacctttttcagtcactatacaaccaacacccttctttacccttcacaagtaataacctgaactaccttctaggaacattctaggaacatgtcactcaccacctattatgcttggagtaaatcaataaggtaaatactaatcatttcattaacaacactggttaagaaatttaaaataaaaatatttttattgagaaataaataattatactgtccataatttttattttattttttatgatttatataataaacaataaatatcctcttttaattcttaactaatgtctttaagacatcagttagtaaaactcattgaataaatgtataatatatagtgacctttaaattcacatcttaacttattttaaaagaaaactaatcatcataaaaaaaaaaactaagtttatatgaattattttttaaaataacttttgtaaaattaagtttgtttttgaaagtaaagataatttacttttttaaataaaatggagtgtaaattcatcttaacttattttaaaacctaactcatattaaaagtgtcttttgttttgtctcgaactttagaagtgtcttctattacagacattaactcttaatttgttagtatggttttgaattttgatagaattatttttcatggaatcgagtttgggctgttaatggttaaatgtgattaatatgtgtgtctaaattaatttaaatcacacgcttacattagaacgtgtatttttttattaaaaaaaagcatgaaaatgaattttgttactttagagcaagcagttacttaatcgacaaataagagtaatttagaagtactattaaattcatgtaattgaaaaaaaatgataactacactgaaggagtaacacgcaaggaaatgacaagttaagaaaatgtactataagaaaaattaaaattagtgggaaaattaaatatatttttttaaaaaactatcactaaaatttttgtggcgattaatgataaaaaaaataattttcgcctttaaatttgatcactaattcttttatttgtttatagtaaatttatcatgtatactatatccaactcaaaatatcttgtttcttttatacgtgaaaatattatgagatttctaacatgtatgatgtatctatcatttttctttataattctcatatttattatatatatatatatatatatatatatattatcaatcaattagaaattattttaagtgtgacttttaaagtaataattataaaattcaaacaatttatcatacatatcaaattataattaaatgatagtatttttttttaacaatatgagtgcatctagttaaatttaaatagtaattaattttaaagaaaataatatcatggatccttttgctggtatctctcttttgtttgatagttctctgcagttgcgtatcaaacagtaaacggttcctttatccaaacaaaaaacggtaaacggttcgaaattgttcaatggctaaaactcggagtggacttcgctattctcaactgggcctcttttttacaaaaaaaaaaaaaaaaaaactgtggattcatgattgtgtcattttatgaccaaaagtttaatgcattgttaaatttaatttaacaaaatgatgcttttaacaatttttataggcatgaaattattgtcaatactataatagactactttttaaatatattcattgttaactgggcctcttattcttattattgtccctcaacggctcaaccacacccaaaatgatataatagactacttgacagttaaacatacatttaattatttgatctactaactagctaatagcagaaaactaatttcataaatgggaaaaagacaaatatgtgtgcatgtgtataaaactctttattatttatttatttttatttgagtttaattacttatagttagtgcaaaatatttttgtacaaatatttcataacttatacgtgagttttgttaaatgtctaaatctgatgaaccgacattccatttaataaactcacatagtcacatacccaacaacaaagagtgttataagaatgttttactatttcttgtaacattaatactcatttacgtttgtctaaccttataagttttttggagagtgatattaaaaattggtaaataagttccttttataataactttatagaacaaattgcataattattttaaatttcatagtaaaaaatgactcaataaacaaagtttataactatcataaaatatgtggctgttccatggttttgtaagatctttatgcccaagtacagtcttgactttgactaaaacattgattcagtttggcccatagaagcaacgtgtcttcatatttaaagtcttgagcaaaggggttggtgtagtcttgttagtttagttggtagttcccctgaccctagtgcaatattgcttgaatatgcctaatgataataataggataacaaaaatatcttaccaaggctaaattctaaattcttctattttgttaacatttcttcatcatattgctaaaaccttcttttttttttttactttttcaatttaatttatgtcatgaaaaaaaatatgatgagttaattaatcaatttgtttacaaagagatattaagtactagcaattaattttgattatttgtcaatgtattttttttttgcaatatttatcatatagtagtattaaagtgcatacaatatcatttaatgaatattagattttagcgtagttaaattaactaaattcgtatcgacaaaaaattaaaagtctgtccacaaaaagtacgcggtgaaaattaacgtgtcaacatattaaaccccaatccaaatttgtcacattgcaaaagagagacctcgacccccgtgccatgaattttttaaataaataccaaaaggccacgggggtcaaaatatttgccggaatgccacgcggcctatttcgctgggcagtgacgtatttcgctatggtctgtagcgaattacgcgaccaccagcaacgcgccacgtcagccaacgtatttcgctggactgcccagcgaattatgccgcgtggcagtccgggaaatactttggcccctgtggcattccggtaaataattttaaaatttgtggcacaaaggtcgaggtctctgcaacagacaagattaattagataaatctttcccatgacacattaattccttgaatcaataaaattaatgtgtctatctacctgtcaacatcatatgcatatatttgtttgtgtttttcgtcatgataatgataaaagggggggaagaactttatcttagtttaaaataatcacttaaagattaaaaaatatacacatgagcaaagtattgatttattttattcactcagacatacaatagacatgacttgaagtgctcctcttattcttattataccttgccttgcatgattctctaatttgttgttatttattgtattttacttactatatccgtcagaatagacacgttccttgatataagtacacaggctgaacattttttaagatgtacaatttcttttaatactatctttgtccctgtaaaactcttctaactaatttacaagaattaaaaaaaaagtagttaattcaatgacattaaatttactaataattatagcatctttataaaattattttatggtaactaatcatttcattttttttctttgttcattacatctaattaattaatgtataaagaaaatagtggttatagaattatcttctccaatattcacaagtgaaaagaagaaacaatttacaacattttttatttattaacgaattaaatttattttgataaaaatattaattaatataagagacaatttttttattaaaaaaaaaaaaaactcttacaaaaaagtgaaatacaaatttggtgtaagttatgtaagcctcatattcctagtcaagtcctagttactttaaagaagcacagtgtacgtaaagtaaatatgcttgcttgacactgtcattccgttaatatcacaatcataaatgtcatatccaacaagaacaaaaaaaaaaaagaagaagaaagaagcacaaaataaggcaacataaaaataagtgtataagacaatatgacatttcaaaatatcattgaaaagtgaaaatcccatatatttttttcatatctatcaatagtattttctccgcttgtcttcttgcacaatcccttcattccctgccagcatcatgtacttatccctcctagtaagtgtggtgcactcaaatcccaaagcacaagccaactgttgctgtatatagtttgccacttcacagcttgaccttcctccagcacatgttagttccttgggaacctttccaagaacctcaatataatagctaggccttggattcatgagaaagaaaatagggtccaagcatttcaaaccgcttgctgttgtcccatagaacatgctcacatgactattaatagccacaggaacaatctcatcagccaattcagcaaacagtgagctgaaccttagtaaatatggttccctacaagttgttccttcaggacacaccactaaatcaccttctttgaggagcctttgcatggtttcaccatcttttcttctgtcccttgttagtctcactgtcctaataggggctatcaactcagacactttgcttaggctgtatgtgactgcagtcaaaggctttgccaaacatgtgcttaggaaaacaggatcaaggagagtcctgtgggagcatacaaataggacccctttgttttgctctgacttttcatcagggacattgcctttgacttgcagatttataccactccaaacccctaatgccattgcccatccataaggaagtagaatacccaaaaggattctataaatggctaaaagaattcctaatggaaaccacataaacatatatagagttgctgagggagtaggcaggaatgctagtcttccatcatggaatattaagggctttggatatttgtcccttggcaacactgaacttgggttgcccttgccctcttcattgttcaccacatatgcttcctgtcattatcatgtagctggaattaggcacaatacattaatagatttaataaaatcatgtctactaaattacaatctaaatcaagatttaaaaaaaataaaattatccgtgactgcaattttgaccgcaatgtcaactaaaactataacaacattggttacatttgttcgtaagttcctacaatattaaagatcgtgacacaatcgagacaatgactgcaggttaaaatcttgatataaatgcaatagatttataatatgctgtgctaacagaacatatcataaagggaattaaaactgttcaccagaataatacgtacaaggttatatgttgaactttcaactttgattagtctttgttttttcaatttaaatggttttgttttttttattaaggcgtgtaacaaggtctcaggtccttggtgttgtggaaacagtgaaaggttatttaagaacaatgaagtattgaacacgcaagagttaaacagttagtgaggtgattaaacagtggagctaactagagacttaccttgcaaagggagagaaaaagatgatcatgaacactagagcttccaaccccaatatcaggctttgtgtctccaaaatattccttcagtgctctgtgcttcacaagtaagccagaaccagaaaccaaaccactgaagtagcaaccaacagtgtgcaactctgtgccaacaacagcaccgacactcaaatactccctaagaaacccttccaccataactctaggcacagtagtgaaaacaactttagaccctgctgaggccagaacctcataagcatgaaggttgagattctccaaataaaacttgggcaaaacagcccttgacatattttccatgacacttgttcttagcccacaaaaggtgatgaaggtcatgaccctaagacttaactcatggtctaaaatccacaacacaggacaagacaagagcaagaggagtgcccttaaaatgctgccaccttcaaaggcaacaagcatgaaataaggaaagaaggagtgggacctcaaaaggactctatgaatgtcacaagcaacaagtgtttgtgaacttctaccctccaaatcacatttggtaacactagggaaagaagaaggttgaaggggtggtttagatgacaaataccccaaatggaatccataactcttcatttttcttgctgctctataacacgagttagcaagaagctggtacaagacccagtctgcaagcctcagaagcaccattgggaacaccatgctattttttttttctttcaaattggttgatggtgatgataaagagaaggagcaagagagtaaatggaataagaagagtgggactgtgtctatctgtggtgaagaacaaagtgtgcagagaatatttatagagtcattaaaagggtgcaggagaaagttttcatggtagcatttggttaaccacaccgctggcaataacttcaccttccactttttttttcttttcttttgataccatttttaagcattggccataatagtagcattttttctttcatgcaagtgccctctacatgttgccagataatattagcttggctactgctgacataaatacagtaggtaggttaaaatgttggtgaccgcttaagagagagtctttgtttgaaatattggcccaaacacacactgtgcttcctattttaaatgacatcggcatgtgtgtatcatccctttgaaaagcccttcgtcaaataaatttccatccaatacttgttccattttctcttgccacagtccaatggcaagttagatcacccacatcatccaaacaattgactttttaaaccaattacacaatcatccctagtcaaattgttcctatcaataaaaactgtcgttgactactagttctagttttatttctatattctgaaagaacattgatgacagtactgagtagtgtcttggttaaggaattaagaataatttttaattgaaatattatatttttcatgttttttctctctctatgaatatgtgatatatattaaaaaaatattttttattatttagtaagtgtccggtccggacgcgcgggttagtaagatttaattcttttatatatatatataactttttttattgttagataaaatatatgtgcaattttatttagtgaaacattgtatatatcaaagattgtttgaaaaagtatgttgaatggtagtagcattttttccttttattgggaaaagtttatattaagataaaaagaaaaagttgaaaagatagttgatagttgaaagttgataattaaaaattgaaaattaatatattaaataataaatattcgataaaattatttgttgaaacaattgaaaaatataaaattattaaaaaataaagaacatatgacttataaatatgtgacttatttagaaagataataaaaaaattggataaatatattcaaaataaaaataaaaaatataaaaaattataagttagaattaatattttaaaaaactttactttaaataacatttaaaaatattaaaaactattaaaaaattattaaaataatttatttatcaaacaattaaataaatttttaattaataaattttttaaagattaattaaaatattttggacatggcagactaagtattaactttgactctgttttgttatgttgttgtctacggctctatgcattgcattcccaaggctatttactgatcataggtgggacagttatagggtttgattttaattgcttaactaatctgttgtctgtgacgtaattatcgcaagtcccgtgattcatttgaaattaattgtttaattgagataattaggcccttcggcaaaatcatactttctgcacagtctgatatatctcaggagctacagtgacttttgcattatattattcaaattaaataatagtatatatctcattctataagtgtaattgtttaatcattttctctgcatggtacttcttttacattaaacactagacgcatgagtagacttatatgttttgactgaaaatattagttattcgtcacttcaacttaaatgaagccatatttatgatagtaatattgtgatgatttgtacttgagaagtgagaagctagcgtctgttttttccatttattgtttttgccatttccttcaagccagacaaggtaggtaaaggttgagcaaattattcaaaatgtaatgacatgccattggtacacaatctttgaaaaccttatggaacttaattatttatttgctgttctgtttgttcgtgtgacggttagaacaccaattcatgtcaccctcattttgtggtttggtgaacccttaatcatttgatatggctgttcaatgcacatagtttgcatggaatcgttaagaagattcacgtatctatggcttctcatttcatttctgttttcccttcttgcgtttcttgagtcaataaaataaaatacaagtttccttaaattatttgtattattgaaatatatagttataactaataacaaactgtaactcaatgcaaagaaaaataaaaactgaaacttacgagtaattgttgcccaagttgtcgggtcatctagtacacacacatgaaatatattgttataatatattccaggtgaattcatttggataaggccactacgcatgctacccctaattaactagtatttttcattatagctttttcattaattgaattaaaaaaattggataattaatttttatacaacaaaaggagagatgagaagagaaaaaatagaaacataattattgtgattatagaaataaagataaaaaaaattgtatgatatattctttatatgaataataactcgaaaaaaatagaaaatgatacttgtataataaattgtacaataatttgtacaaccaaaagagataaacaaaaaaaaattaaaatgtaataagtgatgagtcggagataaatagacacaacaaatgatgttatacaaattattgtcagtgtatatcatttctaaaaaaatataatatatatttaagcaaaagaaatacttgaagcatgtatgtgcataaataaatatgtaaaaaagaagaagcaaaaatcgagaaagggcgataaataatgggagaaggataagagtagccaaaggaataaaaaatcgaattgataaaatgatttttttttatatataaatatacttttttttccttttatattatctataattttaagagttttacattagtttgttcaagaataattctaaattcttcaaacaatgagatgttgcaaatagcatgtcaagcaacaatcccacttggtattgcttgcataattttccaagccatacacaattgacacaaatacgtcacttttctaaataaagctaaagaatatgcacgagacattaaaagttggctgagcttgcactcaagttcttcaaaaaaaaaaaaaaacaaaaaaaacttgcactaaagtttgcaagaagttcataaaaagtcttattaatttatttcatacttggttgcttttttgctttgattgtaatttctaatgtttttattgtttttttttcattttttaaatacttacatgtttttttttaactaagtgattaaatacaaatacaaatgattaatgtgttgataatctttgcttgatcattatttgtgtatcatattagttaaaatttattagaaattataaaatcatgaaatagaatcattaaataagatgtgaaacacaaaaaaatataaatttttataaatttcaactaataaatgataatgtattaaaaaatgtgtcaatgttattaccttttctttaaatgaagatgtgaaacacaaaaaaatataaatttttataaatttcaactaataaatgataatgtattaaaaaatgtgtcaatgttattaccttttctttaaatgaacatacaaacataagaaaagtcagatttacttgttgaatgaattgaatataaatacagtattttttataaattacttatagataaatactataaaaataatttaattataaattcacccaattaagttaattgaatcatcgccttcaattattgattttttttcttggaaagaggaactgaatgtggaggcccaatcaagtgatcgcctaaaacttcttacatttccactattgtttcctacacttcccattgtacttccattatttttcattttagaatgagttatccataatgtaatggaaagtgcaagaaataataatggaagtgcaggaagcaacagaggcctaggccctgaaagcaagtgaaatgggcaaaagaggcttaggcccattagcgtctcagtttcccgccacatatatgttgatcttcccgccatctcattcacacacaccaatcacttcgctctcgatttcttcgtttcccacttcgtgaacacaattctccgattgattcggttcataatttcggtcgcaaagcaaatgatcccacatcaagaacccgatttcaatctcaatcacctcaaactatattacggttcgttactttcaattcccgtttcgtctttttcttttaatctctgtaccaaattagcatgattttcattgtttcgtactgggttttaatcttttcaacgttttctattctcttcttttcgttttctccaggaaagctgtttccttttgctgatttggtcagatgggtgtcttatggcaacggtaataatatcgccaaatccatgcttccaatgggtgttgaatggcgatgcattcttaattttaattttaaggattaaatatatatttattccttgcaaataggaggttatttgttttttagtccctctaaaaaaatcgtgtcattttagtcgtccctttaatggatgttagggtgttgttttcgttcttcacaaaaattcatctcttttttggtccttggtagatgggaagcaccctggttgtgatcaatcctacattgggcgaagagagttttccttcactctggagaatgatatatatctgcgcttccaatctttccacaatgcccacgagctcgaaaactccatcaaagaaaagtgccctgttaagatagatattggacctgtctacactgttgatgtaaaatgtccacttttatccaaatcctctctacctagatttcattattatgcttcaagtcttttataattcatgcagctataatgattaatgcaaccagcgtttcttttctttattaatctgttccttgtatttggttcagcctgcaaaaaggaatgcctatgcacagagtggtgataataatgtctttgccccagttgagagggagttgatttttgatatagtaagattttttgcttcagtctttaagtgaagcctttagctattgtggccttcttcacatttgacacccttttgtattttgggtttctataggatatgtcagattatgatgatgttagatactgctgttcgggtgctgatgtttgtttggtttgctggccgttgatgaccatagcgatcaaagtgattgacactgccttaagaggtagtattttgcatcttatatgatattggagaagtggtgcaattttgtcatttatattgttcattacattgaaaaaacaattattgaaataataagatagcggtacatctcatataacattgaaagaccatggagttgatgtaagtcacctggcagaatcctcctaaaataacataagtttgcctcacaacaagtatgattctcccaattcataacatagcaggggaaagtgactttactggatttggtcatctctcaccatgataggtttatttttgctgaagcagaaagagacatgatttctacttgaaaatttatgataatagttgtagtctagggtgtatcttgtaggtttcattatttcaacataatttcctgaacattgttattcctgggaaatataaggcttcaacaatgcctaatatacctgttagaggaggctcaatgcttaagttagccttcactctgggatatatgtatggtatggtgttgtttgattttaattacacctattactgtattacatgctttgaggttcatcaagcatctcttctgcatttattttcttcccatttctgatcttttattgtgcttaatctttattcaatgactgagtttttttgtcctaattctttatggcctttggattgagatgctcttcatatatgaaaatggtcaaaatactatgggagggagggatatagaatatccaacatgcattaaaattatatttaatagcttcgtatatggcaagattgagcccatctagtggtgattgcataaaacaaatgggtgttatttgttttgggagaagggggggggggggggtctgcattttttgtaactgttgtgttgacttttgctctggggcttctgtttcagatgactttggtttcaaacacattctctgggtatatagtgggcgcagaggtgttcattgttgggtctgtgatggaaaggcaagaaggtgaggcactaaacagtaaacaatcaaaagttatcctttatctacttgtggctgtacagtcataaattcaaataggttgccttcactcatacaggttgacaaatgagcaaagaggtgctattgctgactattttcgtgtctacaaggtatagtataatgatgacaagtgggtttgtcaatacttgtataaactttttgttgatttcatatgctgtccagggcaatgaaaatagtcacaagaaggtttctttgatgggtgctgctcttcatcctttcttggcgtaagtcttaatatgaatcattaactttctgaaccagatctcttatttcatatgctaagcagtattttatttttccaggacatcatacactaatgttctcaaggactattttgagaaaaatctgcttacaggtcaaaatttacttgctaccgaggagagatatgagaagatccttgacatgattcctgatgaatgtactttgttttctgtcctcccttcatatgaaccttgctctttcactccctgctattatcttatgcaatacatgggttacttttgcagccattgcttctgaacttaggggaagatggcaagatagtaggcggtcttctagtgcaaaagaagacatcaatgttgttcgatgggaacagtgcaaacagttgctgcaatctggaaaacataaggtattcaagcttccttttaagaaatgtagaacaaggtgacaatacaggaaatgatgcaagatttgctgaaacatgtatcatttgatattgctatttattattaatgttttctaatcctttttgtaggcacaagggctgcgtcggtgcattgaagagattgtgttctgctttacctatcccaggctagatatggaggttcatcttttaactggcctttttcccatagccactgttatctttcatgctattaccatttctgcagtcattatacttcccatcaatgtctctatagaagaccaataacaccttttgactaattttaagtttagtctgaattttgttcattaagactgttcatgttttaggtttctaaacacatgaatcatttgcttaaagcaccattctgtgtacatcctaaaacaggttagtatataattatgcacaatttttattgacataaccagttgaattttttatgaggcttgagaattcactggtgacattataatcatatggttttatgattttatctttatatttttttttattttttaactataaaattgaaactaaaaaactatctcccagttaaatttgattgatagatccattagctcatttgactgtttagcattacatggtattattctttgttctaggccgagtttgtgtccctattgatccaaaacggtgcgaggagtttgatcctactacagtacccaccctttcacaggtatacttattctgcaatgatagttttctgatatgcattccagggagagaaaaactttccaaaacggtgcttagttttcaatagtgatgttttgtatttactacttctgatctggaacttgcattaagacacttgctcccttctccaacacattttcatgtgtgaaaaggaaaacacataaggatgctgctttctgagaatttctggacatctcttttgtttatgtgaatcttgacattgtgagttgtatgtaacattgcagctgatagaagagcttaattatgaagtctcaagagctgatgttgatggtggtatgttaattttatactcaatccaattttcctgttttataaaatcttcacattgccatcaccacgtgtcttggactctggggatcctgtttatgtacattgatatgttccttcaattctaattgcaacttggattccattacaagggaaagtgatttttaatgccttgtttgatagcagaattcaatagaacttcgcttggaaatgcaattacacttttcagatcgtcattcttacagcctttactaaaagcctgcaaggtaaaaagatcatttcataaatgttggtaaagtttagaaattttcccttaaacatcatttaattgcattaaaaaacttatgcaatgtaaaaaccttgatactggtattatgaatcatttggaaaaatctattccatgtgaaagaagtaatatgagaatactaggaatgactcattttctgtttctcatttatacgtgtatgtttttctttattacaattcaaattctttaaaacattggtgttgatcttaattatctgataccttattacagattcagtattcaagtattaccttacctatcataactattttaaataatgaatattgcaggaggagatagaaaattcctataacttaaaattgcagcagtcaaagaattcccttgcttggtagtgccacctattattgattggtcaaatagagctgtcttggggtcacattagttgacacaatcaaatgatgaaatgttcgttgtactgttgaatctttttttatattttcttgcaactacaaccgttctttctacttctggtgagagaaaggaagttgatttgaatctttccatccactgtataaattttggatgaaacagttaggtgttgcgtgttatctataaaggtatttctgccaatgcgtaggaatagtgagggatcaatttccattgaattcagcagtaattttaatgtaaaggactacaagtttattcattatatagttttccgggtatttgaaaatttgaaggactgaaaatattactactattgtcacagcacagcacttgcagtaacactacaatttttttttcatactttgtctggagttttgttttatagaaaattaggtacgtgaccatgctaggtcttattgtggtttcattaataaccgatgtagttactaaattcccactatacttaaagtagtccactagatcgtttgacattgcgtggcaactaaggaaaaatgttttgttgtgctgttactaacacttaagatgttaaagtctctcacgagacaaaagattatatagtaaaaattgttattatgtggctgtgaagcaaggtatgtgaaaatacaggaatagcaaacaaaacaaaccacaacatgacattttatgaagtccaaaatccaattggatagcaaccacactgcgagcagtcctatcagttgggtaggtccaaccgacatagaaaaggtctcacatcttacgctggtgttcatatggcaaccgtatattctcgttgcccctcgatggaggctaggaatatactcctattaacccttgatccgaactcaaattcttgagtatggttaggatgattttttttggcattgtctgttttagtgttcagtgatccatcactattttttttttagtgaattatgagagaaggctatttataaacttttcttgacttcaatttttaagccatatgaaactttttgcatgttatcgacgaagctgtgtactcatatacgactctacatgtattgcttccactaaattagtaaattatacttagttgtatttagacaccaaaacgtagggaaaggtcaaatatgtaaatatgcagccctgtgctaaagacaacaatccgtacattacgcccaagggttaatttttttttttcggctgcttatgattattatgtcaacctcaatcgttcatgctaatttttttttttttaataaagatgggcttgaatactgagtcagtctgaaacaagtaattccaactaacttggtatcattaattaggatagaaagaaaatacaaatcaaagaaatatcattaaaaaaaaaaaaagatatacaaaaagtcatggggttaatcaaacctcatgaaaattcaacttatctgttaaaagaatttataattagaaagacttatcttatttatattgtattctgatgtcacaaaaggaagaaatcaatcacaccaatagaaaaaatttaactatagttgcaggagaggtaagaaaaattgtataaatatcgtcttttatgtaaatatgacctatttgaaagttcatgctcaaaattaaggtttttttattccaaaaaataaaataaaaaattaggtttctgttttttttttttctcctcgaaagtaattatcataaaatataataaataaataaataaataacaactatctaagatgtcatgtctttttttgtgttattatgacgtgaattaaaacaaactacatgaaatgtttaatacaattaactttttaattttaatttttataaatacttagttttaagttaaattaaaaattaagcccgtagacctgacatcattttttgttttgattttcacaagaaaacattccacattttattatttacacgagtaaatggtccttctcgtgttacaatgatattagattttgtccttatagttactatttttcattttagtcactatgtgaatgaatttacacttcattttgaatattttttttaaacttttctttgttaacattttggttcgtatacttaacacactttttccatttaatctttataggaaaaatactctaacactattataactagggaaacagtgtctctaaattttttaaatgataatcaaaaaataaaagttaaatacaaataattaaaaacgtgacagaataaacaaaaaactaacaatatagaagtaatgaggagagttactataggttaggaaaaaaatgaaagtttaagaaatggtttaaaactatctaatgaaatgaaaggtggataacaaatggagaatatttaatttattattattatagagtatagataatgttaagaaaagtttgtaatttttttagaattaatagtgtatatattgaccgttcaaagaatttttacacgattgattaattataaactatcatatacgataatttgataattaattaacttttaattattatcttataaatcatataaaaaatgatttctaattgattgatagaataacttttttttacagataatacatatgaattaaacacttattttcatgtgaggattaaaatgtaaattttcatgtcaagactaaaatgaaaaataatattaagtgtgtaaggactaaacttttaatataaccaatatttttattagactctttacatttttttaaatttgattttaaaacacgaaatcataatatagttatgtttgttttgttggcttcttacttgacaaggtgggttttgaatgtgctatgaaattaccatattatatactcctctctctctatataatatgatatttgttaacatgaaaatatataaattcaagcacaaatttataacaacaaaaagaaaagttgtaacaccgtagtccatatgaatgtagaacacaaattgaattaacctgttactaaactaaatcaattatttatgtagatttcgtttaacataaattcattgattacttatttaattgacttcatcactcataagtcataacgaatattgcaacgatgtcacatatacgaacgaatgccaaaaaatttgtattttatcatgattgggccacatcactttacaacatcacaatcgtattttatcatgattgaggcaagatatataacaggccaggtaagtccccccttatggctaattcaagaatcttttttgtcatatattgactattggttatatatactattgaagaaaaatcaagaaatttcacatattaagaaaataaaaatagatcgtatttatggctcgaaaatctacatttgaaaaaatacacaagaataatttataaatgaaatcttaattagcaccaccaaaaacaaaacttgattgtttaaaatcaaattcaacaatacaataaagttgttggagaataaatatgagataaagtccaatatcatgtataagtaaaaataaaatctataaatctaaattttaagattttgaattaaagtatgttatcaaattcattcattatattgatataaatcttttcgatttatccccttctcaacacataagttgcagcatgaatgaaaagtgtactctttcctattttttccgttaattatttatgtatttaacagaataatttacccgtactttgcagtttgcacggtcagcagaacaatctaattttagtgaaaataaaattataaaattcttaaaagaataggagagagggtgcagggtattaaaatcttgatgaatgttatcgtttgttgtctataagaaatgcaacttcaatttattatactattttactgttgttgttacgtcacataacctccaaccatacgttgaaacctgaattggtgattattttctttgttttttccaagtcaatgtttgcattaatttaaactagaattgaatgagaagagggacacgaatgaaatggagatatatatatagaggggttgctgattcgccaacaatacgtttcagaacagatacaatgtccatattggaggttgtggacaacctttcatgtatctaaacacctagcttagtatattcttatgatgacttttttttagtaaattactacattattttggtatagcgttgtcctcttagtttttaaaattattttttaatataagtttatgatattttaagtttttttttttttttttataaatctttaaacttaaccatttactattatttatttgttaatattatcgttacattttttaagttttggactgtaatgtgattgacgaactgcacatttaaaaacttatttaaatttttcttactttcaaagagattaatataatagtgtcaacatttttaattaaaaaacacatcattttttttacagcttaaaaaaacccatcaatgacaaccatcaaactacgttttttctatagtatctcacagtaaaccatgcatatatatgtttcacattttatatatcacttatatattataaggttgagaggtcttatgattattttgtctttttttataagaatttaattaaaatatagtaatagtatatttatttgtttattatctagtcagtgtcatgtatgataatattattttttataataattattttaaaagttatatctaagataatttttaattaataatgttattttttttttgtaccgataacttattaaaactaaactcctttataataaataattatttatattctacttagtgtttatagttattaaacttaaaaaaaaaaatagacgtggaggtctagcaaatccaaattagtgatgttgaatcaacctaatataatgactttaactaaatccagaataaaaacaaatatacttttaaccatttcattttttgtggctaaatgtgactatcgtctatacgttggattagaattatacaaaaaaaaaaaaaaaaaacaaatatacactttgaaaaactatattatattaacaaattaattaggaaaatgctagcagacacaaaaactggttaagaaaataaaatagaaaactttattaaaattatacaaaaaaaaaaaagatcctttctgtttcagataattcttgattttagtaaataaaaaagaacaaatagtaaccaataatctaaaaatattattaaaaattatttaaaaatgtgttgttaatacacccttaacataatttcgaatatattcttaacatgattttaaatgaaaaaatttattattaatttcttacttagtattttaatggcactagtcagaagctctagttaaaagaaaaaacaacaatacgaaaccgtgttggttcatgagtccagatagcgtagcgtgaacgtgaaacacgcgttgcacgtgctacgttgcgtaagcatgctcatgctgctcctcactttaatattgctaaaatttacagcaaattaaagtatgtagatattgaattaaagttgagcaaatcaataatgtattccacatttccgctactaaatgctactccttatcacatcaaggagaaaagtatgtaatgttttatttttaataactctcaatgatgtaactaaaattatgtttgcttggagtataattttcgtataaaatactaaaaaaaatgtcaatgaaatggtttcaggtgctagtataatttttaagataattattataaataataattgtgacaaataataaacctataatatatcatgatttatgtttaaatgataatataattttttttacatataaatcatttactctttaaaattttcaattaaaactaaaaatcggagtgagatgatgcagaccatattggaacacctacaaatcctccccaacttctgagtcaccaatccttaaaatggacgatgcccacaaggccacaacgttcatgacattaatgaggatcgataccatctcatcattttgatatttttttgtacttttttactttgctatatatatagtacatttttttataggtacagtatatttttttacatattattaatattttttttagtactatcatttaaatatataattttgaactttttttttcatttctatgatatatgattgttaattgtttcatcacagaatatcattcttgcgtttgtattattaatgtcttattagaagaaaaagacatatttataaaatggtatattttcatttcaaagatatcattgtgtttgtactattaatgttttattacaagaaaaagacgtgtttaaatggtatattttcatttcaaatatttccttttcacagaaattcatcatatattttacctttgaataatggccgttcagaaaattgaatagcgacaaatttgttagtatatgttaaatccttggtcaattttgaaacattaattgaaagcataatgcacagtttttcgcttccattcacggtatctaaacaaactacactttcagaataatgcccagttctataaaacgataaaatgtatacacactaatgcaactgttttgttggaaataattttcatcttcaactatttttctatggtttatactgttaaaattttgtgattgggaagcttaaaaagcacttcttattccaatttccagcaagcagtatgccaatatgttatatacacacacaaaatataagttgaaattaactttagctacagattaaagagagcagatgacagactaaatagaactaattttatatattaatctcgatcacttggttgttgagtagatttttttttttataatctgattgaatagataatctcgtatatccttgttttgatttttgaaaacgattcactttgtctctgttgaatgtattgataaatcctgtggttaattaggatgtttggtattgttgtgcaagtagagtaagtgtaacggaaaagaaaggtcgaagtctattagtactacgaaatgtgtatttgtcatgcaatttcggcaaatataatgcagcttaggtttaggatcatacggggaacagaaaaaagagatgacaataattgatatatacttgtataaaacaaacatcttgatttgatttatttattatgttaatatgctcaatgaatctcttgggatatgtgtaaacaaagtcacattcttcctatgtgacgtgatttatttatttttgtgtagaagcctttaaagtgtacttttaatctacattattcggtcaccctgtgaacttgcactgacattaattaataacagtgaattttaacatgtgtttaaccaatgccgtaaaataaaaaaaaacatgcgttgaattagattatttttacatcatctagtatcatataaaattggtttatttgttctaaaaaagaataaagaattattttattcctcaatatataaacaattgacaatttaatatatgaaaaataaaaaatcctgatttagttctttaatgtctaaaatgtacgataatgcgtttacccttaatttttgtttatagacataacgaaacatactagaagtgaaaattgttatctttagaatttcaaatagataacatgtttggttttgtggtgaactttcaaaaagcgtgtaaaatatgtgaaaataccaaagcaatgccaatttgcttagcaatcaacatgaaactaattgagttttttttttttctctaactcgttgcaaaatcaaacatgagcagagtcatataattaaatgaaacaagttcattcttgaaatatacaccttacggcccgtgttattgtcactaacaatactaacaccaataatatttacacctaaattcctcaacaaaatgtcttgtttcatttcaaagacaataaaaaaaaaatcatatttctcgtgagcatcaaaagaacacattttttccaaaactagttgtaatcaagatcgaagtccaaagcatttcatattatttagaaatttagttgtttagtaattagattgaatatcaatatctttatcaacttaatttccataatgaatcagaattgagatatactttctcatcaccaggaaataatgatatatatgacatacttgttaattgaacttaatactctcaatataggagtcaacattgctttaacctaaaagtagtcaatatttgcggagtttttatcaaatttggattagtaaactttactaaatcctcaattgaactttctcacttcttcaccaacaaactttctgaaatgttaatatcagcttctccatcgtcgtagttcttaatttttcatcacctaaaattagaatccaattagcaaactctttaacctttgttttatattcaaagttacaaccactataaaatcacgtattttgtactgattttaacactttgtaatatacttccataatttcgaagagttaataattgtcaatacaattttcattttgtttacatttggaataactagcaagatatatttaaaaaattataatcataaaaatcatataattatacttttaatttcagctaatttatagaatattataagatgaataaatttaattctaacctagtataagtacatagtcttaagtttaggatcataatataagcaagcaagtggacaagttataatttagttttaactatagttttggttttctaatttggattatttatttggtcattttttttgaaatatttacaattttagtttcctaaagtttttaaagctaattacgcctcttacttttaaaattgaaaataaagtatttattgattttcttctacaacgaaccatattaatttttctttctaattttttaacaattttttttgggattcataatgaacttgatacatgaaataagactcaggatcaatgacaccgaatatctcacttatacgacttaataattttatgaaaaatacaaaattaaataatctaatcattatattaatttttataaaatatatgaaagtgtaaatatttattttcattcctgaatatgtagagcgttgacaattcgtccctaaaagatgaaaattcaattttttgtcccttaagtagaaaaggtgtgacaaatttattactccattaactttagtccgttatcgttaattgaaagagtctacgtgacacatttaaggacggatttgtcagcgttctacacttttaaggacgaatttatcagttctctacccaaaatataatttaatcttcatatttttccttttttaatcattacaagcataaaattataataaatacttaaaaattaggaaaacaaatataagttaaaacaaacataataataaacataatattgattaataaacataatttgtttattgttctgaaatttctattgtaacaacattaagtaatgacaaaatcaaattctgaaattaatgacataacgactgtgcaatttttatttgagtatcatattttgggtaaagtactctcacaatagaaatttcaaagcaaaaatatgaggtagtaccttatccaaaatatgagattcaaacaaattaaaatgcacaatcattaaattaatccttaaaaaaatgagatccaacttgattttgtcattatctatatctaatgttattacaatagaaattttaaagtaacaaacaaattatacttattaatcaatattatacttattattatgtttgttttaacttacgtttgcttttttaatttataagtgtttattataattttatgtttgtaattattaaaaaaaggagaatatgaaaattaaattatattttgggtaaagagctgacaaatttgtctatgaatcaacattagcggacaaaagttaacggatgattaaatttgtcacacttttttcacttttaaggataaaaatttgaattttcatttttcaggataaatttgtgagcgttctacacatttaaggatataaatgactatttattttatattaaatttataaaaaaaattcatgttaataagaaactagatgatagttcatcgtaataattaaaacaagtgatgataaatgttatagaatttaaaaaaaaaatgctatattgaaaatttgaaatttaaaaaatatcgtagtatgttgaaaggttaaacctgacacgtgtttggtacattccctgtgccatgtaagttggagaggggacagacaggtaattccacaacagtatctgccaccttacttcgtcacttgtctttcggaacctgaaatcacgaaaccaccctccacactttctcaaaataccaaatacgccccttcggtataataagaatcccaaatccgtatctcacaagcgaacgcgaagcagagagagagagagagagagagaagagccaccctttcttacaataaacaacaactcattctttcaaggcttcaacaacagaaactttcatagtttttcactccttctccctgtgtcggtgtgctcttcttctggggcattcgttttttgcttcttcagctccaacttcaaacgcgcttttggtggaagaagcttcactgggatcactatggtgggtgtgtgagagagggattacggattagtgagtttttgtcactaagttagagctatgtcatttcataattgaggggtggtagcagtttggtgttgggattgaaggtggggctttatttggattctgtgtttgttgaaggagctggggtaggtggggcaaatgtgcttgagttttcttttatgccaaaattgaaacttacctttctatgaatttcttctgtttcgtattggtggcttaatttggagtagctgttgcctcagaatgcagcaagatcaaagaaaaaaggtgaatttgttgtttgttctcctcatttccaagcattactctaattaattgctatacaaatcattactttttcaagtttttctctgtcccgaatgaattatgaaggtgccctttttgggactaagctgagtttaaccgaatgaattataaaaataaaatcttgtcttgtttagtgttggtgggttactacttgctaccgagaattttagattacataagtcaaagtgtgggagtgaggttctgctaagttggttccatggggctgtgttatgatgttagttagctctctcctaatgtttaatccatcacgtgacataatttatttcccccacgtgacatttggttgacaagatctttatttttttcaccattttttgggggggtctaatgtgttgatgaaatttgcatgatgcttctttgaactggttagatggcattcctagggttgatcttccatcccaatcaacccacccttttgcttttctttgtttctacgtattctgagatgtgtcttgcacgctttaggtgggttgtacgagattgactctccgaaataaacgttggtgaatgacaaaaaatgatgatttggcgaagaaaaaaaatattcgtcttaaaatgaatattggtttgtcataagaattgtgatgtgttgagtggttttaagtgctgtattttccccttcttttggctttgttaagctggggagtgaagcgttgtatggtgacaatgtgtttctttatgtttattatttgttatttttcttgtgttaatccaatctatgcagacatgatcagattactgcaaatataatttctactctctttctttgattctatgattcttcaatactgagtttcataatgtaaattctattgcacacacaaattttgtgttgtgtgtattaagcttatggatggatcatggattcccagatataaattaatttcccttgtaacatagcaaagaaaaattatttattacttttaatttctatttatcaattatgaaaatttgtttcccaattggtgctttagcttgatttattaacatttgtagacaatcaaatttgggcttgcctgattttcctttgcggattactttaatatctttggtacagggctcaatggaaatggaatttttctccgactatggcaatgtcagcaggtacaaaattcaagaggtcattggaaaaggaagctatggtgttgtttgttcagctatcgacactcatactggcgaaaaagtagcaattaaaaagattcatgatatctttgagcatgtatctgatgctgcacgtattctgcgtgagataaagttgcttagacttcttcgacatcctgatattgttgaaattaagcatgttatgctgcctccttctaggagggactttaaagatatttatgttgtttttgagctcatggagtctgatctgcatcaagtcattaaagccaatgatgacctaacaaaagagcactatcaattttttctttaccagttacttcgagcattgaagtatattcactctggtattcttcaatatttgatagttacttgttcatgaatatcttctttgaatgcgcattgtgttgctagtggctatagcttgttttctctctacaatgacatgtaattgaaattgtgtcattccttagcatttttcttacaaagatgtctggatcatctatatttttttctctaactattgctgttgttgacttttttttgcacctcattcctggatctccttaaacttgtatagtacttttatggttttgccaaaatgttttacttattcatttgtcctttttatattttactttgtctatttatcaacataaggttgctggcatcaatgtcaatattgctcaccaattacatttcaacacattgcagcaaatgtctatcatcgagacttgaagccaaagaatatactggccaatgcaaactgtaaacttaaaatatgtgattttgggttagctagagttgctttcaatgacacaccaacaactgtgttttggacggtattccatcccaacattttctctgtttgtttcataccttttcaacagctttgctagattttttgctccctcatatcaaaagtattggtaacataggggctgatgttttcttgcttacttaatacttttctataggattatgttgctacaaggtggtatagagcaccagaactctgtggatcattttactcaagggtatggctttttcaagattttcagatatcatataagtggtagagaacctaattatgcataatcttgactcacaccatacctaattcatgctcattagttttgtgtgtagaaattgtatatcaacccatgatacatgctttctgttatcttctttcccatcaatagctaaaagtaagacccaagaccaatctgttatttattcttaatccactggttttctgtttgtattagttttattttgtgtctgctgatgagctaacggtaaggtattgactgcagtatactccagcaattgacatttggagtataggttgcatctttgctgaagtattaataggaaagcctcttttccctggaaaacatgttgtccatcagttggatctgatgacagatttgcttggcactccctcgctggatactatatccaaggtagtttctttttttctctctagagggaaaactgtttgtattttcttaactaagttttactaacatcattgtttggctggtttacaatttttattctttgtgttggatgcaggtacgcaatgataaggcacggagatacctaactagtatgaggaaaaaacagcctataccatttgcacaaaaatttcctaatgcagaccctttagcactacgactactggaaaggttgctcgcctttgatccaaaagaccggcctactgctgaagaggtttttatattgttcgctatttcttatgtatgtgtgtgtgtgttgaaacattattctactcagataattaactgcttcttgagcttatgctttttctttggagtttggacaatagaaatgtataattgatgtgcaacaatatgtgaattccttgctttagaattctgaaggatttgacattttcaggcattagctgatccttatttcaagggactttcaaagattgagagggaaccatcctgccagcctattacaaaaatggagtttgaattcgaaaggagaagagtcacaaaggaagaaattggagagttaattttccgtgagattctagagtaccatcctcaactattgaaagactacataaatggaacagagagaactaattttctttacccaaggtttttatttttggtttattgatttatacttcaactgtttatcttcttttcctttaatattttttattcatatgttctaccctattattctctccttacccttcattggtgcatattcttcacagtgctgttgatcagttcaaacagcagtttgctcatctcgaggaaaatagtggtaaaagttgtcctattatgctacttgaaagaaagcatgcatcacttcccaggtaattcactaatgtaggtatctcattgtttcacttgtcattggttgtaatcatgggttgttaacaataggttactttgattatattatatttaagatatctcttcattagatataactggttttttaaaacaataaccggttatatcaaatcataacaggttgtacaaaattggttatggttatggttatggttatgataacaacttgtaatctggttatttagtagttatggttatggttacttgaataaccaaatcatgaacaacactaggcataactcaatcccacaaaactcacttgtaaggtgaggattatccaaacttcataacctatattaacatcatatctctagtcgatactaaataaaccccctcaaagctgcaattaaggcagcccaaagaggttgcaactaaggcacagctcagagaagccgcaattaaggcaggtcaaggatgaccgcaattaaggtgactttccaacagtttttacatagcataatacagtatcaaagtggtgtttacaccttgtagtcaaatgttgagatcttacatcgactagagacgtggatcagtagtagtgaagtctaagggttgcatatacccttcacttcaaacccgctgttgatatttatttgagccatggtttatattgctgctaattactttctatgtgccctttttcttaattcatacctcctgctaacccgagcgagcattcaaatatttgtcctacattcattcgtgaaggtacccctagtggattgaagaccatatcaacgggttttccatcttgcaaataaggcatatcctgtctagacaaattttttgaaacgataccttcatttccatgtctccccgccacttaatctcctactttaatttcacgtttctgtaaaatatatatacgaatcccaccatcctatttatctgctctttgaatgtcttagcatggcatgagatcaaatcgaccaaaataatccacatcttctccaggctgcatttgctgttacaactgtttcattcatagggagcctaatcagattacatcatactgaacttttgtttgtttgctttctcttttttggaatcattgacaggtcaacaattgtacattcaaatatagtaccctcgaaagagcaatcaaacattgcttcctgcataaaccggcaaacaactgaggaaaataataataattccagggatacagaaagtcctgcgccaaggtctattcagggtctgcaaaaatttccacaaggtatgtgactgttatcaattatcatcatgcctttgttaagtttgtatgcattattagtcatcaataagctaacattcttgtgtttagcaaaacctggaaaagttgttgggccagtgattccatacgaatatgcaagtgttgtcaagggtacatatgatccaaggacatttatgagaggttctgttcttccttctcaacctatgccccctacgaatcattatcaaagatcaacctctggaaaacaagaaaggtcagcaacagaagctgacaaggtgtctttacaatcaaaacttgctcagcaatgtggtgtgaatgccaaaatagcaccagacatagctataaatattgacaccaacccttttttcatgacacgagcaggagtgaacaagatagagaaggatgaccgaatagccattgaaacgaagttgctgcagtcaaaggctcatcaatatggtgggattagtaccactgctcatagaaaggttggacctgttcagtatggcatgacaaggttgttctagaagaatgttgtcttgtaaatagtttggccaggtggagccatccttgtggagattaagaaaaggttcttcatagtggagaagtagtagtctctggtggtgctttgtgtaagacgatgacgatgacatgagttagtgcttccccagaaagagccagctttctctggtcaaaccttgtaaacattggtttcagttatcaataaactgtacaaccgaatttgagtcctatcttgtaattcaatccacacattcctttgctcaggatatatatatatatattttttttaaatttcctgcaataactattttccaagtagaaataaataaatcagaccggtacatgtactactatacgagtaaaaatgtggaaaatgtaaagtgttttatgcgtgttatacacactggacgcaaaggagtttcattgtttaaccatagtgttttaaccccctttggccattatagaaacagattcctcacacgtttctttaacaactggattccatttaaaattatatcaaatggttcaaatgctaccaaattttcctcacctaggcacagtaacaatttatccttgaaagtaggtttggtgcttgcataatttccttctatttatgttttttttttttttttgaaagaagaaaaatagacacctcattgttttattggaatcaaacctcaaacaaatagtttgagcattggatcgaatacgacatcacagtatttcatatgattttgaaaatttgaacggacatgtgcccaccttctcccctcatggagccacattggccttccatgtggaggaagttactgcagctaccttttggaagctctatctaatacctagctatacaggataagattaactttatgtggaggcttgctttcagaatgtacaaccacttgtaagttgtaactcttgcttttttctacttcttacttcagaatagttaaaatgctaatggtggaatgtgtgatgcaaagagacttgtttaggttgttactaatctatcagaaaacctggtggaacagtcttgtcagaataatgttgcattgcaatttgcagcccacataatagaattgaagataataaaaaaaaggaggaaaaaaagagccactagatgcttggctctaaaatgtactgtaacattgtttgttgatttacattaatcattaatttaatgtcgtacattaaaaacattaaaagaatgacctagaaaatgaggtaaatccgaaattgagataatgcatttgaatgatctggtcgcttgtttattgtttggcatttaatgcatatgtaagctgcagaacacgcggggctcaccaataaaagtctgagtcagttcatgtgctgatcattaagttattatcaggttgagaaaaattctcattcctccctctctacaagaccaactgtgaatattcctcaccagctgcatgcatttatttttccttttcccttttctaaacctaattgctgatattgttgcaataagttttgctccagtgattttttttttttccatttacctacgcatcctaaaaatggatgctaaaacttccctttccttgtttgaacctttgtggtgccatcatgcatgcctagttcatttatattcatagaattttctttaattaaagatgattaattcaatgtttggttatcatcattcacaatatgcttaaataagtcaaatgttatcagcatgggttaggtctatagagaaggattagtatcttataatgtgacgaatcaaagtttaagttttcatgtttactatctgaccaacgattctttaagtaagattgtttctaacaaaaataaatgtgattagagaaaagttaagtgttatttaatattcatgattaaacatgttaaacatttattatgtgtattctttttttatgttttatatatctatgtcctcgtgacctactaggaggggaaataatggaaacatgccaataggtatatccctagaggcctaccatgtgagagcttcatttgtttgcaccgtaagatgattttggagatgttaataagtccaaaggtctgttaaaagattgtgaacagaaacaaaactcaggtaggatgtcgacacagttgcagttagattagatgtatgagattgaattataatagctctctcatcaatgatatatgtgccaagcaaagcaaggcccctatgtaacaaattgatttcaattttcgtacaagaaatggtggtacggaccccattaccctccagaacaaaattaaaaaaaggaaaaagaattacgaaggattgaaaaaaaagggtagtgtagtgtgtgaatgtgacaagaacagagggatccgagtgggtctgagcacatggagtcccatatgcccaacacaaccaaatctctcatacaatcccaatgacccaatccgccgattggtttccttcttggaaacaccaccacctcccctctctcattctccaccacactcactaattacgctcaccatcaccaaagctgcaacccaaatcactaccaaattaacaaacatatatatatatatatatatatatatatatatatatatatatgcatcaatcatcttttcactctctttatgagtatcatcacacttacaacaccatctactttgtcaaatttttaatctaccatttttatcttataatgttgtgtataatttattcttaccagtatttcttaatgaattgaatgcttatataatgatattataaaataattttataatttcatataatgatatattattatttaaattactttcagataattattttaaagttaataaatttattatatattataaattatgattgaattattgtgtaaatatttttacattttcaatgtataaccgtttacctgtttcttaattatataacttaaatataaataataaacggctataaaaaaattgtattctttctttctctctctctctctctctctctctcattttggtgaaaaatagttagtataatttactttcttacaaatatctcaagctttcatcacgttcaattttttcgtccttttatttatgtgttttttttaatttttactcacgatcaataatttttgtttttaagaacatgttcttaacacacatcctctttaattattataaaattattaaaaactataaaattagaaaaataataattaaatatagtatgagactcacaaaatctaaatatttttaataaattttaattaattaaaaaaagtgttcaaaagaatgtaataaagaacgtctttctatttttgtgtgttctgttaaatttattatctgtgcaacatttttttttattgaaaaccattcaaggcagttgatacctttcatttcagattattgaattttttttacaggcatttattattgtggatacgacataataaatcatttaataaacatattgtagtcatgtttctctttaattaagggagtggcgtattttgatacgaaaaagccacttaaatgcgaacttaacttctttatccagaaaaccaacttgtcctaaataagctaagcaaggagtatttgatttccttaaaatcccaagttgttagttgaatagggttgggattgatatgattctagcaatttacatgattaatttggcctaaaagggttagaagggggggggttttgtggggctcaaggtggggtcattggaaagtaaacacgtggcagtcatgcgaagggtagtgatggagatcacatggcatatgaatgaaagagaagagagtggagaggcacatgggtgggtgttaagttcaaggaattcatgtgagcacatgtgctttctcccctttcttttgtgttctgtgggaccattttttatgctccttaacggggttgcattttgcagtcacttctaaactttatactttcacctttacccctctctccaaaatcctcttttgaatcttactacttaagaatccttaaaatctaatgcccatacatattttatacactattaacaagatgcatgtgtttagcatgctataattgatcataaatatccctttagtgcatctaagatgccactttcctgtgatcttgcaacaccctctaaaatctatggaaatactaattgtttgattccttaaaaaaaattagtttaacatatttttatcaataattattagaaaactatgatatttttatcccaacctccaaggaaggaaataataagcaatgaaaaggtaacataatactttaattttattataaaatttttatactataaccttattaaaaacatttttaatataacttctaaaataattattataaagataaaatttagatacaaatctataagtgttatttgctttttttataatcaaaattaaagtttcacttctataattcttgtaacaaaggattatgcattagatttagatgcgggttcgtttaagtttttctttcggtaaatcaaagtaatatttaataaaattctttattatgcacattatcgaaattaaactctaagttgataaaaaaaaaacaacatcaacagtatttatgatattgcatttagattttgtttattataaagacaaaatcattataaattttgaatttattataaaaataaacaaatttatcatataaaactattcgtgacaagataagaaagtagaaaaataacttgacaaagataaacaaatttagaagggggagggtaaaaaaattgatgaggggtgttgatgtggagcgtgaaggccacctcatcgctccaatccaaaacttggggacttcttcttcttcttcttctttgtgttgtgaggccaaaaccagtgggaccagcttcgttggcattgacatttctagagctcaacaataatttaacatcttcctccttccctccctccttcgcacacaagacaatcacacctcatataactccctcacacattaatctcccttctctctctctctctctctcacacacacacacacacacacacacacatcaaattagtactacaactacatgtcatcaccatcatccatggaacaagaagataacactatcatacccacattcctcagaaaacctgcagaagatcagaacaacgacaactctcccaccccttctcacaagtctttgcatgttttccgccgcagcaggaggcggtggaggaaggaagtggcagtgaaagatgctgtgaaagaagaagatgaagaaaaagaagaaggagaagatgagggtgatgacagagaagatatagagaggaagattcatgcattacagaggattgtgcctggtggtgagtctttaggtgtggacaagctctttgatgaaactgctggctatattcttgctttgcagtaccaagtcaaagccttgagggctctcactggtttctttgaaaagttggagaaggagaagacaaagtttggaggttgatggtgaacatcaacatgagatgatgaatgaatgaatgaataatccatggtgatgatgatggattatggaagcaagcaagcagcttaggttaggtccttttggtttttcccacagaccccattagttagaatttttatttttcttcttttaatttttatgttttactttgatgtacttttggaagttgggatcaaggagaatgtttatcccatgatcgatgttcttagatttttaattttttaattttttattttgaagttctcatcagctctttctttctttttcacagtgttattttttttccatgactttatctatatatcttcttgaaagttgatatattcatacgccgcagattaatgttacagaaggagttattgactttaggcaactgttgtaggaatcttattaacctgtttcatgatctggagtggagtaaagttagagtagatgcaagtgtatgacacattatggtgtggcttcgatgtacgtgggctgtgacagggttcatttttagttcatcttggtccagtgggccacccctattgggtcatgaaatctggatgagatcagacgttttataaagtaacatggcacatacacatgttgtcattggtcactttctttcttattttgttgtgaaaactttgctttggagattttggaatagggttgtttgacttttttggcagttagccattactaccacgataacttagacttagaatgcggtttacagaaagaaaaaagacagcacctctcccacttgaagggttgtaaatttcacatggcttctttctcatccgaggataacatgatcttccataatttaaggtaaaaaggaacacattggcgatgatagtgttagccgaatcattgtacagccattaatttgttggagatgcatcactcttaaccttcttgattcttaccctgtgcatgtatttcaaagatggaacatagcttacaaataacaacaagagtcactaactttaatatgtttgcttgcatttttagtggtaggaaaagcagctcactttctttcaaagttaacaatcactgcttaaaaaagaaaaaaatgtattcaatcagtaaaattgatacaacacaaaaagttgtttcctctaattttagaatatattgtacatatatagtatcatatataatgtcaaaatttctatgtttaaatacataaattttattaaaaatgaaagaaatgcatgtaaaaaattgtgggcatagtaataaatactacctttaatcttattcatacgaaataagtgataatataaaatatattatcacttatttttcataaataggactgaagatataatgagataaaaccaagactctcatgactactattacaccgatgaaatgaccatttagggatatttttttagttaattatcatttggaggtttgttttgaattattatcaaaaaatgaataagttgtaacattttttatgacttttgaattgaaagttgtaatcgatattatgacttctattttttttttaatacgactttaaagtcgaaggaataaatttttttaagtcataaaatattgtacaactttaattaaaaaaaatagaaatagtaatatcgtatgtggctttgaattcaaaagtcgtaataaatgttacaacttattcatttttcgataataattcaaaataaatctccaatattatttaactaaaaaaaaacctaaataatcgttttgacctactacagcaaaggcactcccactacagtcactattttggagatccaacaaaacaccacactctggcaatcaaattccagcatgcttttgctgaaacaacccatctgcattctccaattgcaaacatcctggaacagtcacagtcacaatcacagccccagccaccacaattttttgagaccgaatcataaaaaagcttatcacgtaggcagaaattaacttgggcgtgtgacattgtgaacaacaacaatatgtatccatcatagcacataaagcatgcatgcagcatcaacattcaacattgacaacatgtatgagttatctaacttctaggtggctgactattactgatctacataaccaccaaatttatctccaaagagtgcatatatatataataacctccaccagtattgtaacgccacattcactgatgaaacaacattataaagctttgctcatgtacaattcaaaggaattggcaggcaggggagaaatttacacacatctcttcttatatgatgttagtgccacttcatcgacagagtagacttgtaataccaaaatcatgttaacggtaatttttaattaaataataatataaaaaattttatattatcaatatatcaattactaacacattcttatgtaattttgtatttaaaaattaaatttgattataaaatataataaacttaagcattaattatttatgctttaaatacaaacagtactcctgttgaatgtatagaaaaattatcaggtaaaaaataataattaaaagagaaacattaattttttaaaaatcaagtgatacatcattttaagtttttaacaaaaatgatggagaatgaggttaaaaaacaagacaaataatttttgttttggttacggctgaagcccccattttttttaataaaaaatcttacgtgataggttgcaataaatataaaaccattccttggatgcactcaatatatgttggataacctgcagtggatactcgagacctcttgggttggggatgaaatagtcgcagaagtagaggaataagtccaatttatatttactattttatattagaattagttttcttatatggcataaatatttataaattcaaatacaatacaagtaaaaatctaaaaaatatttaaaatgatataaataatatttattaaaattaaaaaattaactaaaaaatttccatttattagcacacaaaaatttcaaacgttagaattactcctgtatatagttattattgtctttttttttttaatttcgtaatatagttattctcgaacaaaaatttaaccgtttgaacaaatattgcaagtctatattaatatatagtaagatgtattaaaaagaaaatactacaagaaaataagaaaagatcacataaattgatttatcgtagttacctcatacttacttacacctacaatcttgttacatgatctctagacaaaacttaaactctcccttcaaatgtttgtggccctttctccacttagagtggtgtctcagctccctcttaaggtttagtggattttttttttttttttatctcaataactcctattagatatgagaaaattttcttctcttaaatagttaaatttctttagaattttttttactctcatgtcttaatgtgactctatagtatattgattgatatagttcttagtgatttttattattgtcttttgaaatagaattctatagttcttagtattgagtataactatcatttactactttggtcccgttgaaataatttgtcaaactctgtcattgatcacatttcttctcttctggccaccaccttcacctaacctttctcccattctttttctagccatcactttcatctcctttattttttactttaggctttgtttgggagttaggaggggaaggaaaggaaagagattcaagaggaagggaggggaaggaaaaagaggaaaatgagggaagttcattcctccttgtttgggagttaaaaatatattaagagagggaaattgagagttaataagatattaaatatgaaaattatataatttaaatgtaaaaatatattttaatatattttgaaatttgtagttggggtataataataattttaattacttttccttctaaaaaccccccaaattgggggaacaacaatttttaagctttggaggattttggaggagttttaaaaatcctcaaatccttttcctcaaaaattaaaactctcaaacaaggagatgacacaatctaaacctttcccttccctccctttccctccaaaatctctctcccaaacaaagccttatgtgtttctctatgtaaccttctcttttgactctatttttcccccatcacatttcttcctttcaactaaacttgttactaccatcttttgcaattgtatccaaactaaagttacttaggcaacacttccctactcaaatttgttgttttttgaggtcttctacagaacactactttaatcaggttagttatgacttattttgggccaactcagtttgaattgttgttggacaagtgtcgttatataagaaataacaaaacaaaagaaataagcgtagaaaatcttagactctattaaggtttgtttgtaatgggaggatgtgattatcatgcatgttttattgtgttcatagtttactaatatgtttatctattgagctttgagcgtgtttgatttgctaacgtatatttgttgtacacttctttagcatcctatatatactcttgtaagtgtctttggacattttcaactaatgatcatttgggggaaaaaaaaaaaaaagaaaaagcagtggctattgtgagttgcatgtcatttgtccctttgtaagctaacctttaacaagtatttgaacttaaaagagggttcaaggcgctaatcttgttacaaatattagttgagagatattggcaaagaaatgcaaatttcaatctctaaattgatacaattaatctacccaaatgattttaggcatgctttaccttcttaccttatgggtggtgattgttattgtattatgtttaagaaacatgtgtggttgattgcccaagttattaacaatctctatcgagttaagtttgcatatattgcatgattgataattgttactttgttttgtatgtctatttatatcatgatattttaaaatgtgagatattgtgtatgctattagtataataatatatgaagtaattaataatttgatttcttcctctttatatatatataattatatgattttcttttaatgattcccttgtatgttttctttttgtttgactgttttaacgagcttaatcttgtattctttaaagatatactattatgtagaaatcaaattgaggtcattctctacaatctcaaggtgcacccattataagttgtttttagttttatttatttattattgattattgattgatacatgacatatataaaaaaatggtgtaacattcttatgctaaatatctgtgttggaatttggaagtgttttcaaatccgaacataaaaaatgaaaatggaattacccgatcgaatttgacatgctggcgtctggcgcacacatcacggagaacataatttcaaatctgaaccgtcggttgattctgatcgcactttctgagcacttccttttgtgaaggaaaaggtcaaaacgaaaatggtaaagttttcaagatatttttgacgcacactacaccactcaaaaccctagttacacccatttcataaaactttgtcactttcccggaaaatcctccccatttttcctggaaaatttatcttccgttttctcgctgacacaaccgcacactcttcacaccttctctcactctgtactatccttaccttactcttgctctttgcttttgcttcataagaatgtacctcaacaattatttattcatttttttttttgtttacttccgtgtataatttgattcacggaccgttaatcagctacttcgagcttataattacaatccattttcattttttgtttattttattttccgcggtgcaattcgatttcgatttctggcttaattaaccgctttcggtgtttgcgttttttcgttgtttggcagaatcaaccatggcggacgaaggtgttgccaacggcggcggcgttgacgatcagtacggcgaggaatcggcgactaagatcgtggcgttgcaacgcgagcgcgacgaattggtgagcgaaaacgtggcgaggaaggaggagatcaagaagctgacggcggagctcgacggattgaggagcgacggtgcagataaaagcgagaagatcgaagagctgcagagagaagtggcacagtcgcgtgatgctgcgaaagcgacggaggttatcgccgcgagggcggcggacctggagacggaggtggcgaggctgcaccacgatatggtatcagaaatgactgcggcggaggaggcgagggcggatgccgccgaattgaggaaggttttgggggagaaagagtctagggttgagtctctggaaaaggaattggcaggattgaagaaggtgaaggctgagagtgaggttagggttagggatttggagaggaaaattggagttttggagactaaggaaattgaggaaaggaacaagaggattagatttgaggaggagatcagggataagattgatgaaaaggagagggaaattaagggttacagacagaaggttgaggaattggagaaggttgctgcagagaaaaaaactgaattggatgagtcggttaagcataaattgaggttggaggaggcacttagagaatctgaggagaaagtgactggtctggaattgagtattcttcaattgcgcaaggaagcaaaggaagctgagagggtgatcatatcgctgaatgagaaggcggtggagaccgttgagtcaatcgatagaggtttaaacagtgtacacggtgaagggaagggattgaagttgcagtggccagtggtggcagcagggtctacaggagctattgttgcagctgctgctgtaatctacgtgtgctatggaaaacggaggtgattttctgtctcatcggagagtgatcaaggagcgaggggattttgaactggaggaggttctagaggttagacttaccaggtctttagtagtcatagctatgctgctgcaattttgtttgttacaaaataatgcttcttctctggcttttgtttttgaagcctgttaattttttgctcatgtcgaagttggcatacttcttttttggttgttagttgcttattatgaggatcaaaccattgtgtgttggatttaataaataggttgcaaaattgagatgacttgtttctttgtgtttagtttgacccttgttagcttggaggataaacaatggcactgctgttagtttaaggcggcacttggtatcacctcttgtcaagctattctgtttctaaagttgatttctgcatccatgttcattttcacagcatggctttgaatatagaacccacctgctgaattaattgatgtttcaggattagatgatatcactgatttattgttgttgttattgactttttgtcttgcaatgtggtcagagagagatgttttttcgggtcttgttcattttttcttcccatgcttatatcccatctgtcgtaattgtattcagaagaatttgtatttggttgaattttttttcagttgtagttgtaggtggtgggtttggagtttgaaagcgttggcttgcattgcatccctttctttccaccttttaatagtttctgttaagttgactagtactattaaccttttgctttaatttaaatagacacaagggtctatttcgtgaatttgaagatcaattgtcaaacaagtagtgtcgattgctatgctaacgttggatagttactattactaagctattgctgacataacttgatagatactaagctattgtttaactgcttaggaggcgaaatttcgtgaagctgtagcatttttgttggaatttttctttcttttcttcagtgaggcacaaagaattttttgtggttttccaacttcaatttttattatcatcgaatccacttaatgcgttaatgttgtttatacgcgaagaaagtctgtttatataaaatccccttaatctttaatttgattctgatgtgtaaaaatctcaactatggtacaatattggaagaacccggcgcgagctgcaatcctttatgattccctgccctataaaaatgaacaccaaattcaacaaaatgatttattatcggttagaaaaatagttcctgctttaaagagcttacgttttatcttgtttaaaattaaaggtgaaggctcaatcaagtaataactggcttaaacttttttgttactacataataacttgcttaaatataaaatgaaattgatttttttcaaggcgaactaaaaagtcaatttcccaaaagaataaaaaaagaaaaattagcatctaagttgcatgatattcaggtagaaatagcttttgccgagcacacatatagtatggcatctattttgtatggtcattactcattaccagtgtcacttttataaaatcagagtgcatcagctttcatttaaaaataaattatccttaattttcagctttggatttgtaagactgtgtggtaagcataaagcgttgtagctacgcagtgtcagcctttaatttttgggcccaacacctggcaaggatagatcttatcaggaagagaacctttcacttgcacttcgtttagatggctgacaatagggaagaaaataaagagagaaacaagataaaattttcaattttgttgtttattggagaggagaaatagatagatttttctaagcatttcacacactaaaaacttatagtgtttaagcatatcatttgacagctaattttactaataatttttaattcaataatagcataacaatcagttaaaagtttctagctataaaaattaatttttcaacatctaactaattaactatttgaccaaatttaatagcaaagtttgttacaacttcaaagctattacagtatgggctatgttccatttctaaagctatgatcaaaccttataggttatatttttgttgtgtatctagttgagatacataacggaaatatgcttccattacatatgccattaaaaaaaaacttaccctaaagctcgagtgaaagggataggaagtggggaatggagaagaaggacaagtgtgacagaattgtgcaagagcaaaagagtttgagaaggagaggaatgaggtgttgggaagtaggggaaagaagtttaaaagagtttaggttatggagggattaaagagaataaaacatgagaaagtaaaaaagtcatgaataacgtaattttatgtattttaataatttttttttaattttttttaaccaataccctaaaatactattagtgtttataaaaaaggagttaagaataacaatttctacaagtatttgtgtttcttagatagtcatgctccaaacattcccttcctctctcaaccatcattaatggaatgtgctgatcgtcaaccaaacatgggacagcttaaatcatcctttgaatgtatcatttcaaagcaatggccctttttctttggtttttgtagttcatttgtttagcccttggcctttatgataaaagacatttttttttttttgataaactatgataaaaggcatttctatctctatacagaagaagaatgaaatgacacatgagcttacttcgtatagatcataataacgtggtgaatgtaaaataacttttgataataaattctagttcatggaagtttacaatatgccacaactaaaatgtaccataccatacattttgtcatttttgaaatgaaacaatgtaaccactctgattctgaaacgaagcaggaaagcaaccagaacatgccccttaatttgaggctcaatgaatgcacgcaggaaagattttgtctgaaagggcaccctcacagcctatgattatgcaatgcctcagtaaccttagctcaaggttcaaccttctacgatgctctgccctataatattaaaaaatcaaataacgattcacaacttagaaaattgccccaaagcaaagctaattaattttgacagatgatcagattcttaaatttgactgttgataatcttcaggtcaagaagatcgaatcagttttactacaagtgttttcttaaagacaaatgctaaagtactgtattaaggacattagttaagtaatttaaaataattttttttattaaaaatgaaaaattatgttatttatatatttttttatgtttttctattatttatataataaataatttcttattttaatttttaaccaatattttaatagatcctttcttaaaatatcatctcagtatttagaaatttgacatgacttgggcttttgactcttgaggagcatcagtgattataacgcatatatcaatatcccttgaaattattgttgaaatcaataaaccacattactacaatgctgccaaattgcacctaaagtactattgaatttgtctgtggtcactaaagatttcagaaccgaagtcttggccaaataaaaatatatgtttaattactacgtagtatcggtataaaattattaattaatcataaattattattaatgtaatattttaaaaattattataaaattaataaattattatatatgatgatttgtaattgaataatagtataaaattattttagagtttccaccctcaatgcattcagtcaaaagttataagttataagtgataaccaccaatgtaaccatattgacataaaatgcatgctagattgtattcatcaccattcatcagtaagcatgataaaatttcaggcaaatattttcaattcttttcttgtttagaggagttactttcattactaatatgtcggtaattgatacacagttggactcgtacttctgttcaacactgacaattgaggctgcttcgcatcaagtttttatttgcatagcagcttatcattctccttgcaatgtccaaataatttgaaaagccactaattaacgtcatattttgcagctaaggtaatcaaaacaattttctgatacttaaatcgaagcaattttaacccttgttttaccgacagtttgaaagggagttgtaaaattttgtttgagaaagcacaacagctctaaagcgttgttatttccatatcatactttttttttgtttcaaacttaacaagacaaaaagcaataaaaagattctgatgccaactagactattctctttagtgggttacgcaaagtcttaaaataaggaaaatgtataatttgtatgcccagggtctccaagtcaaaccgtgaaatatttccattaggtttagatgttattatagtgacacttaatactacttcagacccaaataatatcctatcataattaagctatataccatttgtacaaagaaaataagtcactttcatgagctgaattaagtttcatattagccctttcaaatatttgattaatcagttatttatcatttattattggtcaaagaaagaataatccttggttgaggtttactcaccttgacttatctatcaccaccactcataatctcaaagagtccgcagcaactcttccaagaggtgttttccctttgagccacaggaacaatggtctgtcacaacaaaaagagtatgatcactacatccataaatgcatataaaattacaaaggcaaaccttacaaccaacacttgcttagcacaaactgaaatgtctatatgaaactatcataaagtgtgaatcacccaccggattttcagtgctttcagcatcaggaacacttggtgatggttgaaaagactccttggcactttcataggatgactcttcttggccacctgatggttcctcaattttctcatccaatgttggctcaaaatccaatgatttctcaattatggttggagcaacctggtcactctcatctgattttagaacacttgtctccacagtttcctctgaagtcacatcagttagaggcaaagaagaatcaccgtagacttcatttggttcctcactctctctaagcaacttatctgtcacaactgaagacaaaacattcttctcctctccaccaaacatcatgtgcttaaatgtttcaaccacaacttcggtttctctctgtccctcatttcctgaaactgaaaagagctcattatttctctctgaagaaggcaaatccgtttccttcacctcatcattaaccacagctaggtcagatagaaaatctttcccttcctcttccttcaatttcaactctattgtatctgattccattgtattctcaacttgaccatctttcacagcatcaggctcaaaagtctcacaaactgattcagaatcttgtgtcacttcaactttgcctgagtcaaccagctccttattctcctcatttggtggtgcctcttcatcagtgatggaaatatcaccaacttgggaatcatcaacttcaacaaccacctccttatcttctctcgaattttgtgtttctactttgtggctgtcttgtaatgttccattgagagatccttccattttcttgcagtggtttgctgaaacagctgcccctgcaggtaaaaagaatgaccctatattattctcttcaactatcacaaaataacaaacataataaccttggcaaatgggtgccaaactgccaatgaaccttattctaaaccagttttgtgttaatagttattgaatgaaaaacaagaaaattaacaaaaataagattaaggaaagtaacaataagaaacataggatacccaacaaggatgtacaaagaacagatggacataaagataaagaggacacgcaacaaaatgtaggtggctggggaaggtagatagagagtgtagtaaagagtgattaccttggagttgatcagagtgagaagaatggtggttgagaatggtcacagttttgtgtttcttggcttgttttggtttccttcttgaagctggaggcatggacgctgactggttgttccagagaatggtggatgaagattggtgttggtgtcaatgccaatggttatagacttatagcagtgtgtgcgtcagtatgtgacttccctttctttctttttctgcttcttctgtttacttatataaagaataagtgcttttaaattgaattgaaacgctcatggagggaactcaagtgatgatgaaacgttaaaaacagttccatctcaacttgaagtatattctgagtgtgcgtgtaacgatgtgtactatgtttggagtacaattttcatctaaagtaaaattccttcaagttgttttaaataaggtgatatatggattgttttgttaccttaaaattttaatttttaagagagtattagtacctttgtgtaccaataaaaaaataatattaaaatcacatcagaaattaattagcatttaatttcaatggtgttttaaattttataactacacatattttcaaaattttaaaatattaaacatgaaaaatgtactactgtaaatggaatgggcaacaaagtaattcaaggcccgtttaacaattacaaaatatcaagatactaaacaataagtcatattatcaattccatattacctataggtaaaagttacaagtacaaattaatgtctattatttattggtctattcaaggtatcaatatccttcaatatatgtaaacaccataaaattttccttaatttttttgttgtgattttccaaaatttattagatggtttaatttgttgtcttcggagtgaaacgttgcaaataaaaaatgcattgaaaatacgtgagaggtacgttttaaaatcagcaaaaaaaagctgtaatttataaagggttttttaagcaacaagcataaaaacaatcttattaaaatgtaccattttagtacttgtaaaaacaatataattttttgtatattatctgcaattatgaaatgtcatgtataaaaaacctcttgggcaagtggctaataataagtatctttttactattatattattagagttttatcaaaaagccactctctagggacgcataaattagttgaaagagttgaaagagaacattgttttaggaggaatgatatctgttggtgatataaaatatatatagattttgtcagtaattaatcttggtcaaaaaatttgattaatattcttgagtaagatatttttctctaaccacaagactaataagtgtataatctaaatatgcacactctataactacaaacaacactcattttaatagtttttaaattctatttatctccttatcctgttagatatacatttatttctttatctattgagctgtcaaatatggcaattgttcaacctaacaaaagaagtcgaagactgggatagaaggaccatgctgaattggtggtctttatgggccgatggttagcacctcctgtcggtgcttttcatcccattttaaaaaatgtttgataaaaatccataatgctatcttacacttagatgcagagttgaaaaagaaaaagaaattatatatataatagaatttatgacatgatagaaagaaatgaaaaatattggtgaaatatttaaaatggattatgtatgtgtatcattattctatctattgaaagatattcaaagctaatcttctatttttttttttatagttgaggtgaacaaatataaagatcttctaactctatcgaaattgattttttttaagtgggtattaccttttatatgcactcaaaacgatcattgacatgcgtaattaaggttaattacataaaccatattaaaaatgtatttaactttttaacagtagatgtcaatggttgattgagaaaaactacgtacatatttctggatttaatagaatgaaatattttcactgaacatttatacttttctaaaataataaaaaaattcttcagtgtacattataatcatgcatgcatggtttgcccatgaacataatgatcaagcaatcctttaatgggaagtcacaagtgtttattctttcggcaatcctgtggaaaaccatgagcaaaacgtatgaaatcgcggcaatagtcgtaaacaacgaatcttgaatggatctctttgaggtgcttcctgatttgagcatcaagacctttgtttcttccaccattgaaacccatgcaagatgaggtccctggtccagcaatgcatgcattcgcattgaaatttctgaaacctgctatgaatggagctttagaccaatcaatcttaaccttgccccctcttgttgcccaaaagtctccattccataaagttgcataaatcttcattcgttgacttgtggggaatggaacaccgatgctctccctgttgtgcatcactctgatgggtgtgttatccaccaagattctacaaacacacaaaaaagaaaaacacacatttatgctatattgtacccataagtagaattatacaaatttattttgttccttacactattgaatgagttgtaatttcacaagcaatctaaaaggttttttaactgtcattcaagtataaacattatatatttatttatggtaaatttattaaattttataataattatcgagtaatattaacaatgatttttgattgattgatagaataaaagtttttttacatatacaacatgtatctccagaaaaattattaagtatgtggttctagatcattatgttttcaattaatttttacattatatgtatattaagtgttataaattaaataacttaaatacatgttacatataaattaagattggcaccataaacaggtctgctaataattttttgcatcttgatatttaattagttctatgactaggccatattaatgaattggacgtctatgtataaaaaaagctttataacgacgagtgcatataaattaaattcttaattttatgcataaatttattttgtacttacattatgcgctgagtgttccaatcaatggaataggtgtggaagtcctgtgtaggatcaaaccaaagatagaactgcatctcacgacccccagtaccgttggcataataattggttgagagaatgtatggatcaccagataagttgcccaagaactctaaatcaatctcatcatggtttggcccttgagagcttagctgcatatatatatatatatatatatatatatatgaaaaagtaatatgcatgaatattatgcaatatattatgtagtatatgtgtatgttgtaatgtgtttacgtgtgtgtgcatgcatggatgggagagaataagcaagtgaatgatgggttaacttggaacaagttagtcatacataaaatgtagtgacagtgcctgcagaatttcctggtataagcttgatttgcatgtcaaattgtccaaacaagtactccttcttggttgctatgcccgagccagaagatttgtccattgcaagggacatgcttgagcctccatcttgtatgttagctcgattatctccaaagagaatgttaaaatcagtgttgaaattcccacccaaagcaattgttgttgaggctaagaagttgagagaaagcatgaataaaacatatgaagaagccatgttaatttgattatctgaaaaaatatgaatccactaaggtatttaaagtgatgttgcattcacgaattgagatgataacagtaaaatgcagtggattcatatcaatttagctgtcaaaggtggttgtggtaactgcctcaagcgcaatattgctgtcacaattacaggtcaaaatctggaagaaccgaagaaaatgttttttaatcacaaaattaaagttctgattggaggagaattggttttgatgcatagatatgtgtggacaaaattttaagttgaacacaagtcaaagcccaaaataagttaacactaaaaaatgtagtctatatatgggctggaccttgaagaaaaaaagaaaaataatttggtgtttgcttcctacaccagtcaaaatgcttatacacccagcaggtatttgtgaaataccacaaatagccttgcttaaaataataaaacaaaagcatttttcaaatttctaatacaccaatccattcgtattcattcgtattcggcgcttcttctccttctccttgggttctctgtgcttccggcgattttggtcgttgccaagttgtgattctcctctctccggctgtggaaggtggttgttggttgtcggcgacgaagggcttcctgttttccggcgctttgaggtaagtaaccgtttcgcttttcgttgtcttgcaagcgtacagattgataatccgtgtgctgtggaatgcacggattatggatccgtaagaaggaatggcttgttgttttgtcttgcatgcgtacggattgagaatccgtatcaagtggaatgtacggattatggatccgtaagaaggattggaatccgcaggccttacgaattgccaatccgtatgccttacggattgtcaatccgtatgccttacggattgccaatccgtatgggtatttggttaatttttgatttttttaaatttgaagattaagtgtgatggctcaagaattttttgcatgaatgaactgaactgatttaatgaattggtatgttaaaagcatgttgtgtaaaccatgtagtcaaaattgttatgtgaaatgtgatgagcataatgctatggacttggcagaatggttttgatcctccacatgcctatggtttcatgatctacatttggtaggtaatttgaaatgtcatgagcaaaatgatagccacaatgaattgttatgtgaaaaccatgtagtgaaaattgttgtgtgaaatgtcatgcgcataatggtatggatttactagattgtttttgatcgtccacatggctatggtttcatgatccacactttctacataatttgaattgttatgagtaaagtgaactgttatttgaaaataatgttgtgtaatggtatggacctggtatttggtttctgatccacatgggtatgtttgataggtatcgttatctgaaagttttattttgatgaagaaggctatgattgtaatgtaattacttggtttcaatgtcagattatggctaatactataggattacggcgggctttggcaagagatgccagtgaagaagaacccgctgtacggcgaagaccaacagcattagcacggagacaacgccagaggactgatgttgttgaggacgtgcctgctgaggtagccgctgacgatgttgagcatagtgcacctgttgaggctgaggtggagggaagcatcgatgcctctgatgttgacggattttcggtgggcccgatgacagtttagtgttaactcattatgctgagcatattgcacctaggatttggaggggagaggtatgattgtatttaaacatagttcaatttgataattgttttcgcgttagggtatgtgtatgtaactaaccactaatacaggaacggcccgagctgaagttggcatcccatgggaggaaggttcagaagtttggccggcctgcgcctgagattgaagggttggtggcaggtacatgattaagcccattgatcacctgttcggtagatacaggtgaccggggtttaatctcggcatttgtagagaggtgacataaggagactagtagtttccatttgcccatcggagagatgaccatcaccctggacgacgtcgcatctctctttcatctaccagtcatgggtgcgttgcagacatacgcccctttggatgttgatgaggccattgcattgcttgtggagttgcttgaggttacccacgaccaggctgcagcagagacgaaacagtgccatggagcttatgttcgtctgtcatggttgcgggacttgtatgctgagaggtgtcagcagatgcagtggacggtggcagccagagcttatttgctccatttggttggttgcatgattttcgctaacaagagtgccacacatattggtgtggtattcttggaggcatttcgtgatctacaccaatcaggcgggttcagttggggtgcgactgcactccaacacatgtatgataacttgaactatgcctgtcagcatcatgttaaacatcttgctggttatattagtctgcttcaggtattttgttaatatataagttaatatttgttatttatttaatgttttggttgaatttcaacagcttatttgtttttggttattttgtttacttaagtgttgggtatacgagcactttcctgccgttgccaacatgattgcagctgaggattatgtggagagtcagccacgggcctgccgctggaagccggggaaggcgttacctctcagtacgtatcggaggcgcctagataagctgacaagcgaggctgtctgttggactccatacacggatcaccgtgcggcctgtccctttgaggtgatctgtctatactccggccatattcgatggggtccatactgcgtcaagtaccatccagagagggcgctcagatagttcggcttcattcagagcgtcccgtctcttctcaccttgcccaccccgttagatgaagaggtggatgagacctggcttcagtacgcacaacatcttgttatcacaggacccccttccagttaccccggccagtgcgatgctgcatacatggactggttctaccagatatcgcacccgttcatgtgcccgcctcagcatggggaagtcagagcccctcctccagtgccagaccccgcacctgatacacctcctagcatgtcagaccccacagttgacactgcagatgatcaggatgacatgcctcgacatgcagtggtaaataaaatgaaagcttcattctagtattcataaatggtaaatcatttattggttggtgacctcttgaccagtttattcgaacttgtttgcagggagccgttcaaaccattgcagataggttgcagagacttatagatctgcgcatggtgaccgtcgacaccgaaacctacgacattgtggatgagtgtattacagtggcacgcagtgtacgcgacgatcgaagagtgtatgtgcggtcgagacgtcgtaggactggctcgcgtggagattgatttgttacattattcgtgtagcagtatatacacatatgtatttacattgtcatattgttgaaacatttcatttgatatatttacatggtttgaacattatccatctgcgtcagtatttagtttagtgaaataaaattatgtgccagttatacaaatacataaccgacgtacaattaggtgaacacaaatgaaaaaactacataaagtcacaatgtacgccagtgttgagaccccctataacagcccagattaacataagctggtggcaaagtcgtcaagctggtatacttctgcattcgactactgtaagtagatggccagcttatgttgactcatattcatttctttagacatcatatcatcatgcatccaattatcattatccaccttaacaaacaaattaaaaaataaccatcattaaaaaactaaatgcataacaaccatgctcaaaaaaatatcctacaaaaaatattaacttcacaatatatttttaaatgaaaataggacaaatacattaaattaataatacttttaacaaattaaaaataaaaaatttaaaaaaataccttacggattggcaatccgtatggaccatacggattgccaatccgtattatcattacgggttgcgattcaaaccagaacgtacctccgacgaccctccgacgactccagcggccaacggaaactacaccaaagctaaccaccacttccaaaatgccgacgaagccacaaccaacagccaacgaagaagagtgaagaaaaagcatgaagaaaaagcatggacactgctggtgtatgttaaaaagcaaccaggggtattatcgggatttaataaaaatgctgggtgtattagaaatcctactggtgtaggaagttaatgccaaataattttcaatggcaaaaaattggaggaagttggttttgatggcaatttttatttttgggctttacatggttgcgtctttacaaaattacacaaatcaaaagcccaaaagaagttaataataaaaaatgtagtatggactggacccacattacacccttcgaaacatgcaacggaatagattaaaattaaacaataagttgtaatattaaaagtttaaatcttaaaaaatatcattataaaaagacttttttattttattcccagttaaatacatcttccaggaaagacaattatgtttgaacaagtagaattattatgttcgagtcaaataaaattattatagacagaaaatttctttttttaattatttaacacaattacatattcaagatctgaacttaagatttatgattaaactaaatttttttagataagttgatccacatgtttaatgatgaaaagaattagttaattaaatattagaaaaatgatttaaaaaatagtatttaatacaattacatatttaagatctgaacttaagatctatgattaaactgattttttttaaatcagttaatccatatatttgatgataaaaaaattaattaattaaacactaggaaaatgatttaaagaaataaataatactagtcaaatagtaggcaaaaattaataaataacataaattaattatttatttagcaaaaaggggtaaatgggccaatatgtagcaaactggggcactcaatcacgcccatttggggcgtgtttaaacacgcccaaatggggcgtgtttgtgcacatggtgacacgtggcagcaaaaaaagggggtgtggggttttcgcggtgttttcgtaaattacggaagaccataacttttgactggaacgtccgattgacgcgaaaccggtggtcacgcactcgaaatcgagaggagaagctgctggcaagtcccaaaaaaattttcccaaaagaggtctctaagtgcctcaaatttgcgatttaatcttcggagccctaaaaaattttttgttttctgatattttgtccattcaatcggtgaattgcaagctattctttatttatctaattacttctcttaatttcgagagttttgacataaaatacgtctccatcggacattgttacgaaaaataacgactgttcaaagttatatgcaatgtcaattctacactatatgtttgttccatttatgcattaaaccaaaatcatttaaaaatgtacagtaagaaccttgacgtacattgtttcaacttgtgccaagtccatcatcatatacacagataaaaagcaaaacagaacaagaaataaaacgtgtgatcatgtctttctcccattcatgttcttcatcagctcatgctcatagtcgtcagagtaaccctttaatcccctactatgtacgccccatcaacttaacaaacatcaacaattaatcattaacccaaagccctaaacccctaaaaccctaaaccctaaaccaaatccaacagttaattaacccacatccctaaacaaatgcataaatggttcaacattcatatagtgtagaattgacattgcatataactttgaacagtcgttattttgtcgtaacaatgtccgatggagacgtattttatgtcaaaacgctcgaaattaagagaagtaattagataaataaagaatagcttgcaatttactgattgaatggacaaaatatcaggaaacaaaattttttttagggctccgaagattaaatcacaaatttgaggcacttagagacctcttttgggaaaattttttggttcggggacttgccagcggcttctcctctcgatttcgagcgcgtgaccaccggtttcgcgtcaatcggacgtcccagtcaaaagttatggtcttccgtaatttacgaaaacaccgcgaaaaccccacacccctttttttgctgccacgtgtcaccatgtgcacaaacacgccccatttgggcgtgtttaaacatgccccaaatgggcgtgattgagtgccccaatttgctaaatattgacccatttactcctttttgctaaataaataattaatttatattatttattaatttttgcccaaatagtatgaaaattgcggaaaagtactgagtatcagagtatggtacacgcaaacaaaactacgttagtacgtggtgctggcggctgagtgtgtgctaaatttagcgccccttggctcgatgacttgaaggtaggaaaatcaattttgtacgctattttttttattttattttgtattttatctgtattactttttctactttatagaaaaaaaaactctgcataagagttcctgcatgtgcagcaagatggtcacacacactcacaccaaaggctctctcttggtatagaagttgaacaaaattctagaaattggagtaatagaatgtaaataattgagggtgcaaatatatatcacgatcaagtagttattgtgcagtgctagctgtcaaatagtgatggtggtggtgagctaggtgcccccagtgggtggcaattcagacagaccatcttaacttcttcacgttcacaacagagcactctgccacatatcagtgccgtgcaatgcatatagtcaaaactgtatcagaaaactcgtgtagctaagtcttcctccccagacccacacaagtagtaatatcggtacatttccgatccatatatttacatctgggtagtattagaccgtggatctcatccagcaaacaaaaagtacgtttcttctaaaattgatgtttgaagggttatattccaaaatggtaagtcatgagattaattcacgagacataaagattattgaaataaattatgtttcttccatcaaagtctttttcataagtaaggtagaataagaacaatataataattctttcaggcatactctataaaatagttataattcctttgttcacgtgtagttaagtttatttggattttttgaagtgttaaccggattcaagacttcttaatagtgagttatatgttttcaatctcgaccttgaccatgttgtggatcatcaaatgtatgtgttcgatcgtgaatcatacagcttaacttcaagggattgtgaagtgttcgatcgtgaatcatacagcttaataagcatttgtgcttttaagacgtttgagtgattctcaattgtccaattgaagatggatggacatctaatccttggacccaatataatggtcaagagtcaagacaaaatacacacaataaataggcatggctcgtatttgatcatatgagatcatgcataatagagctcatttgaatttcttgagttattaatcggattgacgactcaccaataagtgtgttatcatcaagctgtgttaacaacatttatatcagaatcttaaactttccaaataaatgagtacaagcacattttattttttatctaaagataggaagctaaataaaaatagggtcaattctttaaactttttttttacataaattatttatacttttaatttatataaaatttctcccattataaaatatatatattttatatttttatttttattttttcattatttatgttattctaatataaaaaaattcaattaaaaatttaataatgtttacttttaatattttcaaatagtgctaccttatagatagaagattttatgtaattagtcaaaatatgtaagaagggttttcttgttatttaaaaataaaggttttaaatttatgtgtatcatattccttgggtcatgttattttctccttctctgctgatataggattttgttctgttgtcatagatgaattgtggaccaactaaattagtgtgcagattgtttggagtcatggttttcaacagtttcaagtagatcagactcgcaagtagccattatattgctcactactggatgtcctacttaatacttaccatccatgcttaagtcgatcacgagatactgaagttcctagagcttaattggaggtagcatttcgtgacatcatgccttaagagaaggaaatcaagtggctgattgtttagctaagcttggtttgtccttagataaacagctatgaatttgtgaaattattccctctatttttatcaactgtagttttgacagatgtatcctctaccacgttttcttgtgatttttaatggattgttcttaggggtctccccttccattccccaaaaaaaagatggagagaatttgtgtaggttttaattgcatagaaaaaatgtctaaaaaatgtaaaatagaaaggaagttcgaacagtttacgtaaaaaataatataatatttttatatgtaaaataaaaatataaaagtattttcttaaaccaaacaatttgttaaaaaggtttaattttaagcttttttgcatttggttctcagtgattaggtgatcacaaatgatatgcctgatatgtttgttctatcatactttgacctccagtgcatccgttttctcttctcagtggtgttttgatatttaatacttgatgatggtgacaggtgaggaagctagagacttcatttctaaattgtaaacgcgttatcttttgaaatacaccactatatatgttcatgtttggtatgcattcatactatgtgtgaaagaccatgcgagtttgtctattataaatagtgtcctagcttgtaacgtataacgtagtacatatcatatagtaatgactaatgaatgaacgtgcccacttcattaatttccatcttcatccttgtttaattaaacatcagacggttctaaaagattaagaatttgataaattaaaagaagcacagcaaatcacgtctttcatcagttactacttttcgcaattatttcatgtcagccatttactttggaaatgctgaaatgtacgtaacaccaatatcttttctggagttgtgatcttcaatggatttgtttcccaaacattctttttaactagtatattccaaagatgctgttcatgtgcatcttttataatatgttctgaatttccttcgaaatctagtcgaaaactggatccatacccaagtaaataacatgtgcaaacgcctcaattcaaggacagcatacgataggaaacaaaataatattaattattgtcttattggtaatgtgtgttccaagagtacaatatttttatatgtaaaacaaattcattttgaggttgtatgatcatgtatacttgggagaaattctaatgggcattccaagggaagggaaaggcaaaggatccattgcgactggctcatctgggtggagtaagaaccactcatattgggtcacaacatagtgcacaaatatgaggatatttaacttagctagtaggtaccctgcacacactcttggccctcctccaaagggaacaaatgcatattggggtattccgatccctcctcaaacctacttgggttgaaactcataggatccttaaaatactcttcattgtaatgtgtcccgtatgttgtccatagcacctgagaagagccacaagaaaccccatgttacatgatttaattcaaaattgacaaattatgagatatgcatgcatggatttaagaaggaaacaagaaagtagtattcaccttccatcctctaggtataatgaatccttcatattcaatatcagtaatagccttcctgaaagaaccaaagattggagggaacaatctcatgctttctctagcaacttgccaggtatacttcatcttctttatgtcctccattgtgagattctcaacccatcttttgttgctcattatagcaacatgttctgcataaaataagaacttcaaactatcaactatcaactctaaatacttttggataatttaaagaggaaatagtctatacacttacattatgaaaagttttaagaatattaattaattataatttgatatatatggtaagcttttttttttttttttttttttttacttttatcataattatcttaaaagtcgtatctattatgatttttgattgattaataatgtaattttttgacataatgcatagaaattaaaatctaatttaagtatgatgatagaattagattaccttgatgaagttatccaaagaaatcaggatgcttagccaacatcttgaatgtcatagcaacagaaaaagtagtatcttgagctgcaaaaactagtagcaccacattgtctatgacctctttttcactgatctccccttggatcatcccatataccaatttggacagcagcattccatcttgttctcttcccatgcttccttccatttcccttctcttctctctcaccactttgaccaacatcttttctatctccaccctggccttctttgctctccaaaatttagaacctggaaacatgactgctggagaaaacactccctccaacactctttcaaaggtatctagcatacctggctccactttgattcctaataaccactcaaacactaactgaggacttttgttgaacggtaaagactaatcttttcttggcccttccagtttgtagctaagtgaaactgaacaaaattgcacagttttggaactactagctcaagtccagcataaccaaggcttgtgccaataacaccacggaggaatcggtgccccatctatctgcatgatagagtcccttcccatgagcttaactgaggaagaaggccaagagattttccccaacttgaactcattagacaacaagaatttattggcctcagctccattcacaaccacatttggagaccccatgctccttgttctgaaaatcttctcatgcttcagaatgcgaggatgaacaaactcttcaaacaattggtttctcctttgagcattgaagaattccatggtctcccctatcaatggaaaccccatttcccctgggggggagctttcttttgtctttgtagcattgcttgtgtctcaagaaattgaaagagactagcaaaagtagtaggggaaacaaaccccacaaaataaaatagataatatccccaaatattggtgaacttgtaaggatcaaggacttggaaaaatttaagttcatatctataaattgttttaagattcaagtgttggttcagcacatttttataggaacctgtggtttgtggaagaagatgaatgaagtcaaacccaaatgaattttacgattattataatcttgatcatcctagaagtcaattccttcctaataaatttctaatttgtgacagaaacaaaaaaaagaagaaaaaataatactgtagcaccacagcttgtgaaaagaatactgcaggattcttttctgtaatagattcattgtccgaaaagaatgacacgtaatcatcattaatatacctgagaaattcatgatggaaaataaaaataatttttctcttcatggtcaacgctagaagctttttagttacccaagaatccctaaaaatctgcaggtgaagtctcgttgttttatcatgtgactttggatcatgtttcagtcatcatgattgctcattattgcagcaatgtaaatactgattggtgtctgatggtgcagaatcaccgtctctgaatctcaactttaaaatatcttcttaaagtaattagaaaggtaggctgataatgttggagataatgttgtttgtaacagcctaagcacagtcgttgaacattccaaacaaagttttcggagcatggcgataaattaaatcagcatcatttccatgcatgttagaaagctggattttgtgaatttattgcttgttgggggatgtttagcatagaaggttcatcatttcatatgttaaaggaactctataaacaagctgtgaatgaattgtatacagttgcttttttacaagaaatattatgattacaaaaataacaagatttgtatttgctcaatgtcaccaaattttgactcgttgttagattattactatagcaatcatcgggccaagattaacaaattggttacaccttttgattaggtgtttaagaggttatggattgtctaactgagattaataaattgcctgtctttcatgtttagcatacgagggattgtaaattgtttaaccaaaattaacatttgtctatgccttttagatttagcgcttgagagattgtgtattcttcagccgagactcaggccacacatggccaattgactaagcattcaacatgcctttaaacagattaatgagataaatcaggctttcaaagggcaaaaaaataaacctataataaataatataccaggcttaggctttggatcttttaaacagatcaaatctatctaccatcaataattgacacaaatgataatagcttatgttacttaatcaaattatttagggatcaaactccaatattagatataaatgctccatgctggaaagagaatatctatcttaggtatatgcttagtctctaacaaaaattagtcactattttttatggtgggtatttcgtttcaataccatgttaagcaaaaaaaaaaaaaaaaccttgttcatcctaacttatttctactctaacaatgatcaaccacgacttttttgagagaattacctctattattattccatatgatttcactaaacattagtataattttgctgtagttaaaatagaagtaaacctggcttttgtcgtggaaccttgcctatactggctccatagcaactgcattcataaaccaaatttcactctttaacaactcgtctattttggtaagtaaataaaagaaacttattaacaacgctatggtccttccaatctggtataataagctcgtcgattctatcacagccatatggttaccaccgaaacatattgccaactattgagactgaggacttcgaaggaagcaacaacttttatgtcaggagggaaagcttcctatagacataattgttagcatgtgatagactcagagacgttagacggttgcattcaatacagccaagacttaattatcaaaacttatgcagattagacgatcgaaagcattatcttttgaacaataaaaaaaaatacgaaaagaaaaaaatgtgatgaggtagttaatgtgaagaaaaaagatagagaaaatagtgtttacttccaatccttaggtgaaatattcaaggtataatttgaattcttcaatggtcttttacgaattaaactctagggtaattacttgtaagactccaccagagtactactactatccaagacaatgtatgtcatagatggtgaagtaaattagaatttgagtgtgcatattttgggcttacacttatatggctctcttcaagctaggacgataattctcatgcaagataatgtgacgaacgcttaatcccacaatttggggttgttcattgctaacagttttatgtcatatgtctcagcatttcacgttcgtatgagctcttgactcttgtgtacgcaacattaggaagtggtgaggaaaattaaacattgttgagtagtgatgaattgtacttctatagtttttgggtcaacatgtctactctaatcaaatagaccaagggtcgagtaacagtccaggtcaaataatattataaaaatattctaaatacaatgttacagtataaaaataacattactttttttgtgcacatgtaaatttattatcataaacataatttaataatgattattccgttaataattaacataatggatacctatgggcttgttatttattagtcatcttccagcttcacttccccccgagatttgcccaacacctgtaaccaatatttcaggaattattaattgtttagaagggtggtccttcaccaatgtaaaatgagttatttctgataaatttatgcaaaaaacagaaaacacctttcttctacatttttttggacttgaatccactagtatgttggatttaaatttagttaaatattttgcttgttatgtttcttaattatcatataaaatagtactattaattaattaaaatgtagataatgaatttgaaaacgagtgtctacctatacataaagtataagaataatgaatactagcattgctacctatataaaaatgaattggagatgaataattttctaaaatacagatatatgaacatatgttatataaccataatcaatgattctacataagtgattaatatgttgaaattaagattaaatcatttgggtaatatccaaactcgatcattgataaaaataattattaatcaaattttatttaccttccaatcgaacttaattagtcaagattcttactttctccctggtaaatcaaagtgttaagaaaaaaaaatatcaccatacaaatgaaaagcattctctcctgaaattcatatagaaaggtttatgtgtcatgaatatttatttacttcaaacagagaaggtgctccttccaaagtccaaaatgtatgtttaccaaggcagtaggcacacaaaatctaaattgaaactccagcaaatgaaaaggtgttgaaacatatgaaacactaactcggacatggagatagatataacacggacacattaaaatctaaaacataggatatgggtacacaatattaagtgtctattgattttaaatttttttgataaaaaataaaattagagaagtatatgtgatttgtccagataagtatttggtaagtggtaactaaattaacaaatctaacacgatataaaactatcaatattagatcccgagaaaacgttgtcctcaacttgttcacccaatgcatagctcaagggccagttagtgtacgctcctctgtttatggccgaaatttttttatcatgtaattggcaattttttagttttttttttaactttacatataaaatcaattttaaatataaatgtcataaagtagtaggacagcgtgatactaaaccctaagaaacatgaaaagagaaaaatccaaatccttatttatgtcctattgatgaagaacaatatacaaatccaagctttaacgatgaactcagaaatgtccctcccgaagcaccagtcccaaaacagtcacaatccatgaaaagttcacaactccattgatgagagactttccagttcctaacaatagcaatttacttccttacaaacaaatagacaacagctttgtcttttctatttagtccataggcgacagctcacaggctcacatccaacttgttttcctccagtcctatacactacagtctgcacactcatttatgtttttatatcaacaaatatttaaggatatgtttagataaatttttctataaacatttatagaaaaaaaagtaaaatgtattaattaaacttctctataaattaaaattaatttatacatctttattttttattttatgtttctcttttgagggtgaaaaactagatgttatttggtagtagaaactgaatgatttgtgtatgtttagattaaaatttgaaaaattcggcctgaattgatagaagttgacttgagctgagcgtctcttacaaaaaaggtgccctagtcgcctcgaattaaacttaagtttacaaaagtatctcaaatattattttttttacaactgagtttcaagacaaaattttagtctcaaatatatttttggagattaattaaacataattgtaaactcattttcctcttaaacatacttttaaccctcccaccggaaatccaaacacacccagccttagcctttgtagacacaaaatgttccacttggaagggaatttcatctatccagtatttctcatgcaaatcaaaagctaaagatgctaattcatggcaactctattgctaaattgctataaatacttctaataaatttagtaaacagagtatatgtaaacaaatttgtaatatacaaattcaaaatcgatgctcgagtaatatcaaaatgtgaggacagcttgtaatcttaccggcaaaaaaatggggggaaacaccactcgtatccactactctcccaacatttttttagtaaactcacctaccctctgccattgtcatttagttcggaatgactcacacttgtaatcttcgacattagggtcccttttctctctttttttttttcaactgccttagttcaatatattttttttcatgcaaaatgattattacataaatattgaatttgcatactaaaatatatttaaattgaatagaatgataattgtacaaaaaaaatgctaattgttatttataaagtcaaataaaaatgtgagtagtatttaaaataataaaaaaaagaattttcagataaatatcatatatttattgcaatttatgtgctagacttggtacaaaatagtgataaccgccaatactttccgtcaaatatgtacacaaatccggcaaattttgagtatacatacatagatattatacaaatgactatatattacgtagatcaaccccggcaaattttgagggtatcattataataaatacttagaaatctttcatggggcataatattgaaaaattattcctggggcacgtctccattagccccaataaatgcatcgggtgctggagatttctctgtcaagtagtatttgatttgatttgatttattgaaggttaaataaatgtataactcactaagcttacagaatataaactggtttacgcctgtaattaataccataataagacaaatgcaacactcaaagctaatgagtaatttcagtacaatccagctcaagcttatgatcaacaagaaacaaaggccagagttaggagagtgcgttgtgtgttttaaagctattttagaaaactcaggcattattgcatgaagtagtagtaaatacggagtaaatgctcctgcaaaacatcaactaacccgcatactcctccacctgctaatatttactccactctgtgaaccattttatatattcttcccagtccactcccctctccaaactcaaacccccctttctcttctttctcatagtgttctaagcagtcagtgacaatggagaggaaaagacacagtcctatttctttcactatgttcacattgctacttggagtgctttctcagaaccttgtcatccctgtagtatctaccactgccatcattgtggaccagaagaactacaactctccagacccacatgcaggaacagatttatcaaattctctatgtaattctcttactcaactatacattttgcttcattatttatgcaaaatagaagatatcatttccttgctagctacagtaggccatttactttcaaatttgacgtatgaacgatcaagagctcttaaagaaactatcttgacatttaactttaaaatctaatagtatacgttgcttttacttcttgaaggttcatactgctctccagatcatggctctgggagtggtgggcacggaagctcaccacaccactctcatcatggaacaccctctcatcatggatctccatcacatggaggtggtggaagttacaatccaaccccatcaactcccccaggtggtggaagctatgatccaactccatcaccaccctcaagtggtggtggaagttacaacccaaccccgtcaactcccccaggtggtggaagctatgatccaactccatcaccaccctcaagtggtggtggaagttacaatccaaccccatcaactcctccaggtggtggaagctatgatccaactccatcaccaccctcagatggtggcggaagttacaatccaactccatcaactcctccagttggtggaagctatgatccaactccatcaccaccttcaggtggtggtggaagttacaatccaactccatcaactcccccaggtggtggaagctatgatccaaccccatcaccacccacagatggtggaagttacaatccaaccccatcaccacccacggatggtggaaattacaatccaaccccatcaccaccctcaggcagcaactgtggcacaccaccacatgacccctctactccaacaccctcagtcccaacaacaccatcaaccccatcaacaccatcaaaccctccctcaggaggaggtgggtactataactcaccaccaacttatggaggtggtagccccccaacaccaatcactgtgagcccaccttcaaccccagttgaccccggcacccccactatcccctccacacccccttaccttccttccccaactcccttcactggtacatgcaagtaagttactacttcttttcactacattgcactataaactatgatatgatatacagccacactgttaagtaacctatgggaccttgtcctctaaattgcagctactggaacactcacccaggaatcatttggggattgctaggctggtggggaaccttaggccatacatttggtgtctctagtatgccaggatttggtgccagtctcagcttgccacaagcactttccaacactagaactgatgggctaggagcactctacagagaagggacagcttcctttcttaattccttggtgaacaacaggttcccttatacaacccagcaagtcagagacagatttatagcatctcttgcctcaaataaggtagcagcagcacaagccaacctcttcaagatggctaatgaggggcgaatgaagcctcgagcatgatatagttaatttggtctttgtgtcagtttatttagttaagaatattatgtctaagacttattctaagagtgtgttatttaggcttttatcttgtgtaatatggatatcgttttactttacaagttcatgttagcctttatcgtttcttattctgtaataaagtttatatattgttacttcaatagttcaattatatctgcattcgaaagtacaaacttcttttcattatatatgaaaaaatgcaaaattcttattaagataaacttatttcattatataaaaatcacttcaactcagctaaaatggaaggcaaaatcagaatctgtgatataattcatcaaataaaaactgaggattgttataagtacagcactaaaagggtgcatcatcttctcattaatgaaggtccacctataaggatgtacataatctatcaaaagaaattgattacccataaagtgtaatttagaaatagccctagtctagaaatgtcgattgttcatgcaacatgatggcattcaagagataagaatgatatggtgagtcttgaaaacgtgaacaaggtacaaactgtaaagaatgaagttgtctagaattgtttcctagtgaaattcaagggaacggttttgttgccaatatatatgcaaacaaagacaatagatggaccaagatgctggcaatggtgcccctatgtgaattgggaatgatgggttacagtggcagaggaaggattaaagcgccatgtgagctccaattaatgtcttttaaagtgcctcaaggggaagtgtacaaggctgtggtatggtccagaacaattacaccggcaggtaaagactataaaaggagggtagtcttcccagtgtaatgtaaaaagattcattatatctttaaaacacaaacacaaataaaacccaaaacacgtcttcaacttaccaaatacttttgagcaagataataactgagatattaaagacctctactagtttagtcttcccagtgtaacgtaaaaagattcattatatctttaaaacacaaacacaaataaaacccaaaacgcgtcttcaacttaccaaatacttttgagcaacataataactgagatattaaagacctctactactctagtgcacttcgtagctagaaagttatattgctttgctatatatgatatatttacttgtgttaatggtaaggaataaaacgaagaacatggatcaaattctttgtgatttaaaaagaaagtattttttttaattcaaaatatgtttgaaaaaattatgttaattagataagttttttggagaaaaaaaaaaaaagcaaaagcctcagagaaaaagttgggttgtgcttttctttttcacaagtaaaaattaatatattctagataaaaaaactataagaaaattatatgtaaaagcatttattttagtttatccgaatgaacccaaaacttttaattttaagaattccaatgtgtatataacttttaagctccaaaagcttttgaatgcttaagatgacaaacaagaggaatatgaagtcatccatatgtccaaggtagtcaaattgagatcccacctaggattggaaaggaggagaacatgtatattgtaagatcctaacaaggatagtaagatctcacataaaatacaatatacaatatacaatgttttcaccccacatcacttccattttcaggagcattcttgtgcttagaacctccacttgcagggacaaaaacagcaccatataattacaagaatttagatgtttattggtagaaaggaagaaagctctcaaaatactatagtaaagatgtttactgataggaaggaagaaagttcccacttcccattcataattacagtagaagtgagtggaattaaaagaattacaagttcattgttcccatggtgccctcatatcaaacacattaaatcttaggatgaatggcaaaaaagataatttcaaaagttattccatccactcccctgtcaatttgaagggaatagagaggtgtggagtggaaaggagtctccttgattccattccttttcctttctaaacatccaaagaatggcatcttttactatctcatataatttttctcctttccacctctcaccatcaatacaagcaaagggtaaaaaccaaggaaaattgtatgcatttaattaaaatactgtcattattcttcaccttgaaattagaagccctcatctaaaactcgcttcaattttattcatttcagttcttatttaaaaattatgtttgcatttcttattttaaattttattcaagtatagatgtcaaattgggtttagatcatagggcaaataagtctagtagtcaaacttgcagggtcaggctcataatttgatagccatattaaaaagtgtattttgaaactcaagtccaccagggtattcaaatttcaaagattaaacaatgatttgtgcttcaaatctcaaaaaaacagtagaaagattacaattttaacaaaatctaggataacattcagcatactgcttgccaaagcacatatggtattggtgcaaaggttcagaggcataccttttacatagataacttctgacagtaacacccaattaagaaattccagcccttgagactcaatctctgataaagaaaccgctatagcagtttttacatgagtcaatggatctcagattgaatttcaggaaaattgactcgaaggttaggtccatcatatacaagtggtttcaatgcaggtaagttttgatgagctcatgtgagattcaaaccatttaaaaatttggtcagaatgcacactagtcatctcatggtaagcaaatgcaaggtttagctcctcttggatgtgagggaccagattcttatccagcataagagctttcttctcctcaagagcctttttccatttgatttgacgcccatctttcctcatataaccatttttatcaataaagcccttttcctgaaagaactcaaataaatttctggaaagagcctgatcaagccctggaattctatcagctaaagtacttggtgacaatggaaactccatacattcaacaacaccaacatcaatccctttatcttttaaaacctccacatactcatctattttctgctgcctataaagatctttgggcatgtgaacaaaaagggtcggcgggtagtcccctttaacatcaatttgctcaaacatcccctcagcaatcatgagcacagtactactaaactttacggcggtggcaagcacagacacaaaataccctccagaagaagcacccaaagccacaagaggaagtttctcaagcttccttctatcaatccaccactctataatgtctttaacaaccaacacttctttaccaaatgtccaacatctttgtgcacttgaaatagtaataacagcaaaaccttgggcaagaccatggagtacaagcaaccgttcctcaggcaaaccaatgcaatcagggcattcaggggacttgtcccagaagttgattgccctgccattgcatccatgagccagaaagagaacacctttaggtgattcaggcacttgccatatcaaatcagttccattccggaactcttttgttggatgcaaatgcaccaaagagtcaaagctattccatttttgtttaggaagttcataagctaaactgggattagcaccatcactgtcataacgaaatactaaaaggaaaaccactaacattagaatcaatgaaaaaaacatgaggaacacagaaacccggcaattctgagctccactccatggctttggtttgtatccacgcttcaacatgctgcaagaagggttgatagaaagggtagaaaagatcaaaattttaccaaaaactttcttgagagaagattggtaaaccatgaagggtcgatagcgttaaatcaaatgcatcattcaaatcagaaggagattacctacagtgttgaatctccaaaatcgacactacctctgaagtgttgagttgaatctctaggtgcaaggataatccattggatgaatcactgaaatgttctgtgcggtaaacgatttgcagttttgcactttagtcggttgctggattgctgtcatttgggaactgttgttttcacccctttttttgctaagttcatcccttaccttcttcataattttttaacattaacacctgatttttttccgaatgacacacaatatcccaccttaacgatttcaaatattattgggaatttgtgtaatacaataggcgtattagtataatgttttctaaggatattattgtaacaatagaaaaaagaattatgttatgcgtaattcgaaaaagaatatcacaagatactggtgtagtttgcttctttatatatataaatacttttgacaaacttatttccattttgcatacaaaaactattgcatataaattaacatgtgttaaatttatattaaaaagtgaaataaatatgtatatttagtttaagttcctggtctattagaagcagaaatccctgaatttatagaatttctgcctaagatcatggctgtaaattaagctatattcaatttaaatgtgactttaattcatcttttttttgaaataagagtgaatactattattctaccaatataaattaattatattttggtttcatgaatgtatgtccatagtgagtttgacctgtccacagtagcattttgtgatttaatgtgtacgtcaactcctactcaccaatcttatcttcttgagcaaggtatgcacaaggaacatcaagtaacttgaatgtatatccatagtgagtttgacctgtccacagtagcatggaaattttttattaatttaattaataaaaatacatataatgtttttttgaatacaaacatatcatataaacatcacttttaaagattctcaagtcataaaacattaaagtatctgtgctgcaagttaactttcggcagaaatcattagttttttaccctatatttgctaattctatgacattcaacaagccagacctttggatttaattctaatatgcaatgacattattttttttggggtaaattaagaaaaaaattagacaaatatataaaaacaaaaacaattgtttatttcattaaaaacattctttttacaaaataaatttaaataaacgagctcacaatataaattcccactgatatttttattacaagcttgatcctgctgttttcagtattttgttaggagacaagcaaattatattgtacatcttctaggaaagacatcgcaatttcatgttagtcactagtttttttttattacatatcatcttgtattaagactattcttaccaatgaaatgctttgagttgttttactttaaaaaaaaaaaaaaaaaaaaaaaaaaaaaaaaaaaaccttgatcctaatgaagaagcattcttattcttgttgatacgatttgtgacgcaagttccatcttgggtcccagcccgcacctttccgactcatattgggctaacaacagaacaaggagcacttaactatttactgggccaactgtgggcccatttagaagcaccaaagacaacaaacatcaaccatgtgcatgtgcatgcttggttccttcagccaccttcacctttgctccataaatttagcttttgactttgtacactccatcacattcctccttttcatatgtctcctttgtaaagcagattccatattggtttcaatatgcttaatcatgttatatttttcttcttcttctactttttgtttaactcgttacccattttaaaattttaggatttcaaataagttattttgtattggattttaaaattttaggatttcatgacgcttatgcgtctttactctttagtaatttctttaataatttgttagattattttgtgacatataaatacgttgattttggaaacatgcaagtttttaagctcactcttgtattaaaattcaatagactcttcagttagagtcactctttcacacaaacagaataaggtaaaaacatattttttgtcttattaattattatacttgagcaaattcattttcaagattcagatgttagagttacaattagctcttgaaagaaacaaaacgatggcaataaaactcttttttggagtgacatacatatataacataattagagtatctttagtaccaaatcttgagtatggattttgagttcaaaatttgattttcactaaatttttcaataaagcatatgaacaaatttttaatatgaagaatgagttctcgtagaagatctgtataatattcaaaaaataataatttgttttccctacaaaaaagaataatttgttttctcttcctcttcttaagatctcaaaattagatctatcactaaagaaacaaatgagagagatcttgatacatcttcaatcctatgtaacattatgggatcaatcaaaaagtgatttaagatcccaatttagaatttaccattaaagatcttcttatatcctctcttagtgtatgtattagcaatttataaaaagatgtgtaggatgaaaaaatcactaatttaatattttaatttatttattttaaggatgataccgtaatttaccatttaatctgattcaaaaaaaataaagtaaaaaagagtatgatttctctctcgtctttaatgtcattcgttccaatgcatgttgtctttgcatcttctctcataagtacatccgacaactcagaattgcaatagcaggccaacaactatgcctagattattagcctacgacaaacaactatacctagatgatcaatataataagttcattagtcatcatatatataaaagtcacgcacaattaaattttaatttttaatatccgtgtatgattatacaatttgaatttagagttttaacttcttataataataaaagttcttatttgatacccacatatacatatgtatacgtgggtatatatatatatatatatatataaaattgttgacattcttatatcttctcttagtgtatgtgtattagcaatttatacaaaactgtgtaggaccaaaaaaatcactaatttaatattttaatttatttattttaagaatgttatcgtaatttaacatttaatctgatttaaaaaataaatataaaaaaaagagtatgatttctctctcgtctttaatggctttggttccaatgcattttctctttcttgttatgttttgcatatatcttctctcagcagtacatgccacaacccagaattgcaacagcaggccaacaacaacggctctaactcagtgatttacatggtcgctagctatgatttcctcgcggatcatgatggtccttctctactgtgtttctgcggacgcgctagtgcaatgaccccaacaccaatgttgtttatccctcatcacccaatacctcctgaatacttctgaacctcaaagcataagcaacctgaaaatttacaagaatagctagaattgcacccacctagcttgatcacaagggaattataacttttctttgcctattcatttttagtaactaaagtgaaatgtcgaccaaacttgtaaggatggaaataaattttttgttgtaaattcaatataaataatgtgtgattcacatgcgatcaaaatagacacatatatgcatgtgagattcaagtattattactttctccttaacaattatatttagaagccaatatagacgaaattgacaaaaacacacacacagaatgtaaaaatgttgtctaaagttaatttagagataaaaacagagcttatatcgaatcctattaaatatgtatatcataaaatagaatttaattaggcgaagagtccataaacatgataaatctacaaggttcacactatcactgcaagctaaaaaaaaatgtctaatgagtcattaaaatggtgacataacatatataacatgaagccatagatagtgatagctcaacagtcaagacgtacgtagatatatatatatatatatatatatatatatatatatataggtgaaaaaagacagcatatgtttcatatggactggagattaaagtggtaaggactgaatttaatgttaatagtgaatatgacataaagatataatatacattgaatgaaaatcatatctctctcacacaaacgaaaaaggacggacttaaaagttaaaattatttttaacttattaattttgttcaaatccataattctatccacttatcatcctaatgatgtgaggaatgtgaggcaattttattttttttgccacaataacatttttcattattgaagaaaaaaaaaactgaatattgtacagccacaacatccttatccatttcattgtataatgactcaaggtagctagcgtgagtgccatatttcacgtccatattatcctgaatcaacgtgcccgtaaataaataacgttatcatagtggacttggtgtgatacaattcaagaataattaatgaggtgcttattttccatattcataaaaaaattgtctatacattattatttaattattgaccaaagataaaagatagcatattttttttcaaaaaatattaattgttaatttattgattttttttacagggaaaattaaacttgagacttttttagtttttattttttcttaaccactcaactcatctatgtgcttgctccaattctgcatcaagaatcaataagggagatattaaggtcagacaatcatgtcgtagtcctttaaagggagaattttggtagtcttatatcacgttcgagggctttataacaatttttaagggcggtacacgagtaagaaataaagggagaattgaatatttatgaaggcattcaattatatgtttaagtaaaataattaatgaataagactctagaaaaaggaataaaaaaaagaaaccaaactaatagatacttaaaatgcatgtgtttgatttttaattatcctacgtaccaattgtaaaactcattcgtatgatatattgatattataagcaacttgacaaagatattgcatcaacatgcatcaatgcatggtatagattgctagacctattagttccacttaacatatgagtgcttgctgtttgttgtatcagagcacatgcagctctctctctctctctctctctctctctctctctacttagtttcctcgctctataataagttaattacttatggatttccttttttaactctttttgagatttatgatattttcctcatcaacttacaattacttgtatccaaccgaattctgataatagtcacctgtaattaattcacgcttctcgttcattgaagaaaactttctttgatcaatgtaaattataatagaattttaatttgtaaatcataaatgatttttttgttaattagaatagtttgagattttaaaagtttcaaggttttaaatatttgtatatttatatccgttatcattaaaataattatttatcaattgagttaattttatataatatttttaatttaacttttacatttttacaaatatagctgttcattgcacgatatacataattactacttttcttttctttttattaaaaaggagaatgacaaaagagacagataaattattaaacctactagttatagtagtattttctttctattatgtcttttactttccaacgtaatcatatcgttttacgagaggatctaaatcccggggtaaattggtagaaagagaggatttaaatgatatatagtagtatttattaaaaaaaaaaatcatctagaagttttttttcccattatatattttttctttacgtgtcatccttacctgtttgcacccctatctaattctttaggtatacaatcactaccacttgccatatttttttagaactctacatttttcaaaatttaggtaaacacttactaataataaccatttttttttccttggcggaaaaatctcggtgtagaaactaagatctaacctatagtcgttgtaaaaataaaaaataaaaaaaaaataaaaaaaagactaagatctaacatacagtcgttgaagtttatgtaaatttggttaatgatgaaacaggattatgttttctcagttggcatcgaactacaagtaattaattaagatttcacacgcgcgcaaaaattattaataattcagattaatattagtattagaattgaaccaaaccaaccaattggcatgcactggttgaaccagaaattaataatcaaaccagttcatttaactctagaaatcagtcttacaaaaaaactggtataaaaaaccaattgaactaatccaaaactggacgaatcatccaagtttgaatcagtttgcccaaaaaaactatttatattttatattttaaattaaaaacttgatattataattgttgatataattctaaaacaatattatgatgaaagataattatgtttattatctttattttttaagcgtagttactactaataaatattattatgtgttattaaatttaaatattatgatatatttgatttagtttcatatttaatttttaatattatatattatgagtcatgaattttataaatttaatttattttttaatattatgaagttataaatattatgtgattttttgtttaatattatttaatatattatattaaaataaaaataataatattaattataattaattataccatttcgcctcagctcccactatgatttttaaaaccttgattcagatgtgtggctgtacacaacgttttaaaaactggggccgtatgccgtaccaaatactactactacttaacatcaattaaatataagtggtagattccttttcatatgtccatccaaatctaatttattaattaggagatcattgataaaacccatgcaaaatgtagaacttgtgataatcaactactaccggcaaatttaataataataataataataatttacaagtagtttaaaatatgctatttaatattttgaatattatatatatataattttctgaatatagatttggctagcttctctaaattatgcatatctcatgattttttttcaatattttaaaacagtcataatttattgcatatgtacataatattagctattaatcttatttattaataattaatagtattgtttatttttctctctaaaataaataagcccaaatatatacctagaggctagctagatattttacttgtgattgctttctgagtacatctagcgttgggttgcacacatcattccataatatatagttttagaatatgatcaataagtatagattaatattttaaaaatggatacacaattataagagcccaaatccgcattgtaaaaaattgaacaacacgtggaggttggagacaggatcgccgacttcaacattaatttcttaaaaaaacaaaaaacgagtgaaagtggtacagtggtagtacttctttgttaatagtcattaaaaacgttagatttccaaaagatagtaaattattaaaagtttttaataatttttttagaacatcaataaaaaattaaaagtataagtttttactaaaaatgctatttttttactgctattaaaaatactgttaattaatataggagtatatccgagttatttttagcatgatatgctgctattattattattattattattattattattattattattattattattattattattattattattattattattattattattattattattattattactactactactactacttatttaaccaatatgtttaagatattagttaataagattcaaattttaaattattaaatttaatttaagtaaatacaaatatttttttatcattagcgctattattttttaaacaaaaacttttctttgcaaaatttaaaatatactccatttgtctttaaatataagatacttttaattaatttatacatattaagaatttaaatttaattaatttagttagtaatattaaatttattaaaattttattattttttaaaaattatcaagatatgcctcacttttttatttttatttttaattatttttcatctaattaatttatatgtgctaatcattttcttcaatttttataagataatagatgaacttatcttattaatttataatatttattataatttaagaatattttaattaaaaagattaatacaaaagaaaactcaaaaaaatataataaaaaaaaacaaatagattttaaaaaaagtgtctaatatataaagaaggaggcagtattaatatttttttaattttaaaatattttcacttattataaatgaaaaataaaaataaaatcatatcaacagacgaataaaatgttgattatgtctatcaatttatatattcttttttgaaaaaataaaatgaccaaataataaaaaaaatgaaattgaaaaatactggttatagcctcataggtaccggcagcatctcgaagaagcgggtgtcacgtcatggaggtgtcggcgaaagagtgtcaaaagagtaaataacgtgaaaaacagtggcgaaaagagagatcgcaacaccaaggtgtaattgctatattaatcatttcccgcgactttggttttcgcatttccactctctttctttatctccctcacttcagcaactactactttctttcttttccccgtaactaaaaaactcaaccctcatttcaatcgcagaaaccgatccaaacacgaatgcaacacacacactctcttcgtcactcagatccggtgccgattcgatcggagagaaagctagccagatatagcttatagggaatggaattcagaagatgaagctctatgtatctgcaaagcggattaagagactcgtcgccggaaaaggatccgccaagaccactgctcctgcctacaccgtccccgctcgccggatttccaaccggatggtggtggtgctcggaatcgtgttgctgctcagctttgtgagagtggcggttttggtgctggaatcttctgcggtgtgctccacctttggtaatttttcttttccgattcatttttttacttttggttcgtaattttttcttttttcttttactgttaacttttttgtagtagccagttcggtaaggaaaacagttgagtgtgggacaagtacatatgaatgaatttcagtgtatataatcatagtgaaaataataaataccgaaacttactattttcagcttcatttggcttcttttaggtccaacataataatctcaaggaaatttttatttactatttttcaaaattctcttaacgattactttaataatactggtattttttaagaaacattttgaaatgaattttttaataacaagtatttgctgcaattaaaacttttaataattattttttatatataaacacatgcaataacattctttttgttttgatatttattttttcatagagaaatgcagttgtttcaatttaattagataaaacagattctgtgcatagtttaaacgtgaaatttataaaacaaacgaaaggataaaagtgtagtggaatttaaaattaattaaaatattttgaaataatatatttaaataagcactttttatctttacaaatattatgattttattattataaaaggtgaaaaaaactagtttaagttttgtgatacctttaattttttaactattaatggaatacatggattaacttaatcaattattttaaatttgagtcatggatatatactaatcctatttaagtcgaataaaattattttcaatgaagaatacctataaattatacaaagatacctttaattttaatgtttccctaattaactcctaaatcctataccactaataggttattttatttattaaggataatattcaggtgtagctttataaatgcttttaacatgattcttcaataaaattaaagctttatcttaataatctatgtaataaaatttgactttaattaaaggtttaaaggttaatatatgttagtgaagtaaaagtctagttttaataggagaatagtataaaatgtacttttttatcagcggaaataataatattatcaaatgcactcataatactatgtgcacttaagatcactaatcaccaatcaatattaaatcttaatcagtaatcaaatcactagtttaagatgattgaaaatgactttttttttttatctcattgataagataatatgttaaatgcatatccgtataaaagagaaaaaaagtacagttaaaggtgtctaattaaaagagttgatagaatgaaagtttcactcttcatgttactttattaaattaaatgcaatttttgatctattttcttaatttgatatattaagttttaattaaaaatttgattttaatttttatatttttgaaaattctattttgatacattaagttttaaataatttattttggtctttttataattttttttgtcatactaaagttattattttagtagtagatggtataaaaaaatcttcacactgataggacatcaaaattaaacttaaatatttagcttgtttaactcaaagttatacaaagataaatttaaatcttaaatcatccttaaaatgagctcatcttttgttgaaaagtttatggcagcatctatatatgaaccattgtaattgttgcagattgcgtgggatcgacatttttcggcggaggtgacgccaatctggtagaaccaatctattattatttttgacttgtttatttgtatttgaataaacaacttataagtaatcctttggataacattttttaataaattgtatgatcattaattcgttttaaggtgagctggataatgctggaataaataatttttaaatttctatgatttatttttataaaataaacgcaactataagtacactaatatatatatatatatatatattatttttaataaacaatattattattatttaactgtattttttattatgtgttgtaaaaaataatgttaagttaaatgccataattttataaatttaaaatgaaaatgaatttaaatacgaacactagctgccagcacggacgatatattgttcatatggggatccgacaaaagaaaaataataagatacaataaaagtttagaaaaaaataataagccatatttttttattttgtctttttttttttatcatatattcatatggggatccgacaaaaagaaaaataagaagacaaaataaaagtttagaaaaaagactatcaaatgataagtgacaataacatattaaacatataatctattatttaataaaaaaaaccgtaatcaatatcttacggacacaacaaatgttaaaataatttatttaaaatttcagaaaatgggttagaaagattcagagatattttgataaaaatgatatttgactatatattctaagcttacagattaattaccatttgacatgtcagagaaccaactattttaaattacgctaaagttgaacttttatttatacatggcaatgaaccaattatttcaaattgcaagttctgaaatttagtttttatttagaataatgaggacagtaaggattgattaaattcttaaccatattatatggagactccaatattatcttataaagctgattgaaaaagctttggtaaaagcacataaatggttttatttatagctttgtaagtttttagtaaaattttaatttattctagattttatatataggaaaaagaaatatatatgaaaaatataaatgagaaaattatttattttttctctcatatttttacgtttccgtgactttcattctcgttttttacggtgatactgtatgtatgtgcatgaagaaactcagagatgagttgaccagagtgctaatagaggcaaatgatggcaatgctaatgaaggaggagcaatgtcatttaacgagcttgtgaaagtgtttgcgttaaaacaagacctcaaggcatttgctttcaagaccaaagccatggtacacacaacatttactgattatttacgttgttaatataatcttttgcttgttgattactcttaggatatagtataatgtctgacatgtcattttattttatgttgatatatatgtagctgtcacagatggaacgtgaggtgcaatcagcaagaaagaaggagtcacttaattggcatatagcttcacacggtgttcctcaaagtctgcattgtctttgtttgaagttggctgaagaatacgccgtaaatgccatggcacgatctcgtctaccttctcctgaacatgtctctcgcctagttgatcccacctttcaccacattgttctcctaaccgacaacgtccttgcagcttccgtggttgtaacctccactgttgaaaattcagccaaccctggaagactagtttttcacgtcgttactgacaagaaaacttatactccaatgcatacttggtttgccatcaactctattaactcagcagttgtacaagttagagggttacaccactatgattggtctaaagaagtgaacgctggtgttagagagatgcaggaaacaaatcagttaatttggaagcactacgacaacaactataaagaaaaggagcttgaccatagtgaagagcagaacagatattttcaagctttaaggcccagcagcctttccttgttgaatcatcttcgcatctatatccctgaggtaatacatgttagttttttctttattctttagctagccctaatgctaagattgatcaaggttttaaaaaatagtaggcaaccacaatttcaaagttggaaggtttttgtggtgtttgcaactgcaatgcgattacaatcatgactgcattagttcgcaatttcctgtgggagcaatgctaataatagtctctgttactatttttctaatattttctttataattgcctgaaatttattgacatttttttttttttttttgagtttaacgtttcatttaataactccctttcatgatttagaaataagactccccaaaattgataattattccacttttcctgtaatatcaaggaactcaacgaaactataggactgtaatttaaaaccttgaataagattttagtaataattaacaagacgaatgctcagtaataattcatgattgtttcataatctgattttttgtggaccatcacagctgtttccagatctaaacaaggtagtattgctggatgatgatgttgtagtacaacatgacatatcttctttgtgggaactagatattaatggcaaagtcagtggttcagtgttcaagtcatggtgtgagaacagttgctgccctggaaacaaatacgtcagctttttgaatttttcacatcctatcatatcatccaactttgatggtgataagtgtgcatggctctttggcgtgaatatatttgatcttgaagcttggaggagatcaaatattactaagacctatcatcaatggttgaaacttgtaagtatattttgatgaacataaggaagttattaggcaactgcatttctatttaaaatgtgttttgacaaatttccatatgcttcaaaatggtactagctagcaagataatcctttaacttcacatttttacttcttaattcggttgtctcatcattcttaatgaacatcaacacgagtgatttgaaatgttcattaaatcttttattagtttgtatggactatgagaaatatcaagcaagtattataatgtcttagttaaataatccatggacactaatgcgctactgctagacacctaaagagaaatagagatataagagaaaaatgtgtagatatgtgatgcatgtggtatatcagtgacaagactgataaaaaaaaattaatattgttatcactttatttatatatatatatatatatatatatatatatatatttcggtcttgattaaaacatacttcttatttattaaaaaaattaattaactcattaaattatgttatttttaattaaaaaataaatatttttaaaaattattttttattgaaacataatattaaacatgaaaaatatgaaagatattttagagataatcttattaaataagacacatataattaaaatttgtttatatttgaaataaaaaaaataaagaatttgtattgcttgtatttaagatcctagtaagtatatacattatgtaggtgtgcatctatcattagtcatcttataattgagagagagaaatattaattgcccactatattcaattctttatcatggagggtgctgttttcttctgtcttgtgaattctgatgatcatactaattaactgcatgtatacttgtatgatttgaaatttgacatagaacgtccagtccgggttgacattatggaatcctggagtgcttccacctgccttgattgcttttgcgggtcaagtgcaccccatagattcatcatggttcgtcactgatttgggttatcgccatcgatcagaagaaattagcaatagcatagagagtgtggaagctgctgctattgttcatttcaacggcccagcaaagccgtggcttgaaattggcttacctgaggttcgaattttatggactagatatgtaaatttctccgataagtttattagcaaatgtaggattatagtgtgaagagacaaagttattccacctccaatatggagatagaatgataccgtatgggataagaggaaagaatgtcttgccttcagtctctgacttacggtaatgctccctgcatgtccatatataaatatatagcaaatagatgaagcaagtatacaatacgtaccctgttagaagaagctagcagtagctctacagtttaagagtatgaagatataagcatcataatccagtagtctagtaaattattttgtttttcaaaatggagatattgtttcacttgaacagcatttgtatcttgttaattttggattttagatccttacttgcattgaatgttacagttaaattaagggttaacaaatctccttacatattattaacccttttcagtatgattatttttaattttctagattgattctaggtatatagatgcaaaatcaattgatatagaaagcaggtgtttttaagaaggattaattctaatagtaaccgattttataaaagagtattttacattagtatacttaattagggtctgtccccaacaatttacaagtgtggctaaagtaaaatttgagagaattttgttcactttatacgtgagagctataatgttggagcctttatatatatatgcgtgactttttttcttttataaaaattaaaagtatattttgttttatcaatcaaaatttaagttttagttattttattctcaaatcaaccctaattatatttctctttaaattaattatagctgttgaataattaatatgaacgagaattaatccttcctttactttaactgcatctatataaatggatccaattattttcatgaacactagcactatatattttttatatttaattgaaatttaaataaaaataatagcaatataaattccaacgtatttaataagaggaactataaaataaaaacaaaaattaatatgcccgtagaagacactgatcaatatttaatttattttatatttgtaatatgtatctagtaataatgttttaatggtgaccgtcttaaaaaataaaattgcttttggaattagtaattttttttagctttctaggtaataaaagttaattttagatgtatataccacataattttagacatatatttacaattttatcttataaatgatttttttaagactaaattttctaaattaacttttgaaaatttatttctaaataaaaataattcttttaacatcaattatataaagtaattgtactaaaagttaaatgcgggaggagattttgagtcaaaaggccctaacagaatttgacgtgtgaatctttataattatgtttttgaaataagacttcctagaaaaaacacttcaacaccaaacttttaaaataatttttacccattcacttttttggttatgatgggtgacaagtaacaaaattataattcaattaaaataagagatgagaaaagagtatgacatcataatgagtgaaaagaattttactaattaagtgaaagaaagtacaacatttctctctccgaacacaagaaaagcacattgacactaccaaagaggaaaatactactactaaaagaacggagaaactattttttttcatatttttcttctctaagtagactatataaataaaggaagaagagaaatgattttgggatgtgaacaaagggtccaccaagccttcttttatggctttggagtgcaagctaaaagcaaagctcaccatgtgggactttgtccctaacagtttatttatattatagtaccatttatcttataacatttattgtttttctatctctctttcttgtataaattttttgtcaaaatttgatatatgataacattaatcttatataaactttgaggctacaaacctttcaaaaaggaggcaaaggaacctgcacaattgattggtacaatttcactgtgactccaacctggacaacaaggaacagaccccggtaacaaatgttgccgagtttggtcactatatatactgcaagaaaccgaggattttggaagtaaaactgcttaaagatttaggacaacagggattactacttaatgcaatttctgtatgtaagctggagggaatggacaggtctactatgtgattttttctctcacgtgaatgggtatattcttaagttatgttgaaatcatgcagccgaagagcttatacctaaaacacgtacctatttggataatttttctggtaattataagagaaaaaataataagtaaaaatgaaataaacattatacacaaattaaaattaacttatatataatgttttgacaaaggttacatataagttaaaattaattttttaaagaagttaaaaaaaaaagaacttactaattttcacctagggtgaattgaagttcgtttaagtttactttcttattttcatttctagaagtgtttataaggaaatctatccgaacaatttattatggattgcgggcctaataatagaatgtggttaggctcgttaatgttttaagtttaggtatcatgttctcctaaaagtctaaacttaataaactcaaacatttctaacttattcactttgattttttattttttattttactcaacgtaagacttgcaacacaatcaaatacaatagttgtgttattcctcatatgcttgagaatcagaagcaacccactgatctagcttaatcctcctctttgttgtccaactttgaagttttaagcctgacttcttcaaaacaaggattttttccccaactagcggagagtgatcacggcatatgaaaaaaaaatgcaattattcaggcttttcgtatattcagaattatataattggggggaatataatggagaaattatatatgatgaataatgcggacgcccaattaacttttactcctcgataggtatagtgttcatattgaaataagcatttataacataaaaatacaatatgccaggactgaatagaaactatatatattgaaagatacataaacaatatcatatgatgtattggtacaagtgctgattagcttttgtcttgttctccgttgtaagaactttagcaaaggaatttctaagggcactttcattcacgaaacataggacgatgtaagggctcccacaccacttgaaaggctgtggcataatttcaaatcacttatcagctgcatccaaaggtgagaatttaaggaagtgagaaacatatcaaaatggttttgccatggggaatcatctgtcaaaatcatgaacttatggatttgtatataaaaaacacggcataaaaggttaatacatctctttctaccaagtcatattatttattatttatacttgtctctaactttttctctttatattgcttaaaaaaaaactttttctctttatatttaactatagatattaccatattggtgtccactcatcttttttctattaaaaaatttcatatacaagaaaagactaaatccaaaagagagaaacagtattaagaaagaaaattaaaaaaacccacctgcccagaaaagaaaacaaggtcatatacaaaaaaaggaaaagggatttcaaaaaaagacttgagtaggagctatgatctttgaatctcgatcaaatgtgaaatttaccctggttgactattgaaaacaagttatagcttggctatgccatttggattggggagatgctgaataacaaatcctacattgatgacttaaaaacaagtaaaatgatatatatgtaagtcgaactatttcttatgttccaatgcacgttgaaccacaattttactgagagaaagctttggcgttcaaactgctaaagggcaatacaaacacagcctgagccatttaagttgaacgtccactaaccactttcccacattaaaacccatgttgttagtagccatttaaaaatcttatgtaatgcatatacggttgcatgcatataaaggattggtacaatgttgaaagcaattaagttgtttgtttcattggtcattggccctcgagcttgttttagttttcatcaattaataattattaaaagggcattcaataacaacaacttgtaattaacagtggaagatgagtgtacttacacaagttgaagagcagtttggtcttgacgtgaatattgattactggaatctatgagattaacagggaagaaattgcggtcatatgattgtgaaggtatggttgactcgcacacatttcccggtatcatatcctgttgccgttgttgtgatctctcgtgttcagctatctacatgcatgcatcatccaccaactatatattattaattatcattcatctcaacatacactttatatatagagtcttggagggaattaagagatgatcaccttagctctcagaaaattattatggttttgcagctctatttcctgcattttttcagcaagtataatgttcatgttagaaaaaatataaatatcaggcataaatttgcaaggttttataattcccttcgtacgaagcaatcaagccatttttactttatttttcacgaatattggaatttcttctgggtttatcccgtttcagtttcatattcttggtcctattaattgaaaatatgcatttggtttcaatatcgtaaaactttgatatattttctttagatactatatatatgcatatacatacatacatacatatatatatatatatatatatatatatatgtatgaagcaaataaattaagcagaaactaatagcatcgaaggaaatgatgagtacccgcttttgcatgaactcgatatcggcaaacaaagtttcatgctgaaagaattggagtgcgtagttagtccaaaggaatagagacattctaacttggaattttcaaaatactaactgaaattatcttaattagttgctagtttttgactaacttcttgcatatctacataaattcacaatgcctatatatttagaagcttaagatgcttcgtgctgataatataatacctttctggatctaactctgcttaaacctttctccagtctactttccaggttctttaattcctttagactcagagagctaagagcttcaccaaggatgtgcctggaatgcaaaaaatcacattgaattttttcatttcaatggagaagtctgatgaataatatttttaagagaatggaacattgacctgtttagattctgaatgtctctgatttgtctttttaatttggacgcttcctgctgataaaactggtattgataaatagtgtcaaccagttagagaaaccttgtggaggagcattatgatatagcaattaatttagtgataggagaattaaaatttaactagaacgcagaataaggtatatataaaacaaataattcatttttcagtgtgatgatttgaattatgtgttgagaaacatgcatgatacagtctatagagctcaagtgaagagagaacatgaacacgagagatattaacaaaataatgtgtattattgatatatcatgagagagaaaagtaacataattatatatatatatatatatatatatatatatatatataactgaaggagcaactaactaatttaactgttatcttgttgagctaatagataactgatttctaactgtttcaacctgtatatattgtaaaaaataggttaaatttcgacaaatcatcctaaactcatgaaaataggttgagttgcattatgcaattaaatgttaaatttacataacttgttaactcaatgggtcaaaaggtggattcttttgtgaattattttgttggaattttattggacataattttattatttttttttctaatgatattagtatgatattaatttttcaagaattatgaatatatataaattaagtggatatttttttctttctaatataatttatttcatatctaaaaatattatgaatcatttagttaagaaacataatcggtaatacttataccaataagtgttgattttattgaactattatttattttgttgctttactttatattttttcatgatgataaattttaaacaacatttatactaagactatttagtaagatagtattattatgataatgacaatatatttagatttttttaaagtatttatttgttttatttattggataagtctgagttaaatattatatatataatatttatatatttaaaaacaattatggctaattcaatccaacccataatgcactaagattgggctggatcgattgtgattttcatcccattcttaaaatttgtccaatccatttttaattttatgagttgagagcgcagattaaattggattgaattggtttgatccattttaacattgtctcgtgtgggactcatcatacctctcaataccaaactgtcaaatattggtgaagatgtcccttgaacatttgaactcgtaaatgtcacattcaaaactaagcattagactattagagtatcctaatgataaaggattttagtggctttgagaagattgcagcttgaaataattaaccttcacgtacgctgtaattctattaagaaaaatatgccgtaattttaaaacaacatttattctggaccaaattaaccaaacaagagcattttctatcatttctttgatttttttttttagcttactaaatttacctgtgtattagcttcagagacagattctgcatttgtggaagcagcacatgctttcttgtacctatcgatagttcctctaacactgcaaaacaatacaacaaatagaaacataaaaatgtgataaagtacatgctaattttaccaaaacacgtacacggtgtcgacttaatctgtagtttacaaattaattatgaactcatcttctttgacattaaattcttaggccaaaaagctttgagattgtaataaaaatgggtgtatatttataatttagcaaaatatgtttttaatttctataaaattagtaattttgatttttgtccttataattttatttttaattttcatcctgcaaaaagttaaaattttatttttgatctctattattgtgtgacattcgttaatagcttatgtgttcagcggaatgtcaagtgaccgtcccaggtaacaacagctagtgtctatatatatggtacaatgttaacatgtaatatcttaaaaaggatttctagagattaaaataaaaaaatatatatgttttatagggaccaaaattaagatttattcatatttaaaggggaaaaatcaataattttaaattttaaagggatggaaagcaaagaaaaaaaattataagaaccaaataacatgctaattttataggaactaaaaacatatttaagccttataatttttaatttcaatgtccattggaatctatgaaattgacaaattacattacatctattgcatgcaagagaaatgctaggaacaaattatctaacacattctttgttattgattgaaaattattataaattataaaattctgtgcatcttcttatctagtgaatcttacccataattataattaatattaaaaaaatgttattaatatttctctttcatataaatagctcagtgacctcttgctttaatttctttgtttaccttacagtgttaggccctatccaaattttttctattaagaacacaaaaattaacaagctagttgattgagtatggttaaatacacgaagtttcattcttttgatcttaaagaatggtaaaccccatctgtctgaacttctctaaagttcaaatacaaagtggttatttactgagtatgcaggaagaggtcgatgttgcatcagtgggccggtgtaagtttaactttctctttaattgaaatgtccaaaacacatatataatggagagaataggtaaagaattgacgtcaggaatgggaagctttattccacaaagatgaaagcaataaaaacatatgggaaagagaactaatttgcctttagccattcttagaatctgctatcatcatgttacttttagctacttagggtaaagaaatcagaagcgggaataataatatctaaacactatgatatattttcttaagaaatataggagatgaggatgagaaaatgaggttgtagtttctcataaaaattgtttctctacacttctaaaaatatttatttctcctaaaagttgtttctctacacttcataattttctagttttatgcacaaaatcaaattaattcttacacgtttgccttttcatcttaattcatttgttttttgttttttgttttacgtacccaaaagaaattcaagttatttaaagtaaaatcaccaaataataccctatgggctgggaaacgccctaaccatattagactttcctccattatgtaaaggacaaaatttacgaaaatgggaaacaaattgggacatccataaccctcgatatacttattagtttaaattgatttactttatgctcaaaaagagtttataacgaatactttagtaagaattttaaaaaatattgaagcattatagactaaaaatgaccttaattaatcataaacaattaatcctgtgaaaattctgttgcaactttaaagaaaactgtacccattttgaatcaagagctctaatatctgatttgattgcttcttcgtgtaacctcattgtacggagataaaaatattcttaaaaagagaaactatattagtacaaattaaatttttgtatgtaataaaaatattatacaataaaaagatatatataaaaaagatgttattaaaaaaatatacaagtttactatgtgaataaaagtctgaaagggttatttaattagtttgcagtttctgcgcatttccccgtgatctatcacattagaattgaaatggtcttcctccaactttgtgtacatatgtaaaaaagaattgaagtgattgaggtgtgactaaatactaaatagtgaaaagtctgaaaccctaactcccaattggatgagatgcttgtgttgtgtcactatacattgacaaataagtggtattaaggaggagtcaagatggaaggggctcattgagtgcatgacagctttgtgcagcaacccagacccttttaagatttgatggatgacaagtggagagagaaactcaagagagagggattggtaaagcttaacaatagcagatacaccaggaagctaagatttctcacctgcaaatctttgtaaccctaactaaagctttctcttcatctgctacatacttcatattgtttcaccttaacgtctataatttctatcgcttacacagatctgcacccttcttaaaaatcactgggaagacgcgtgatagagcaacaattaagtacaagagttagaaagaatgatatatacatggtgaacctagagtattcatcggtcagaagttaaaaaaactaatttttcaaagtattaatgcttgtttaaataattagcatcttttaatagacattttttcatacatataaatgaaaaaaattaaacttttaacgacatatgattatctactaactatgcctttcagttatatatgataccacataacaaacaaaaataatcataataagaaaaatggtcttaaccccatatataaaacccttgttgtttctagatatggtttgtgttatttaaatggttcataagatatgaaatgagattgaaggagaggaaaagtactgtgttgaatcagtagtaaaagaatatttgaacctgttgttggcatactcatagaggcgtccacggcttgagaagacaacaagagcaacctcagcatcacacagaacagacaattcataagccttcttgagcaacccgttacggcgtttgcagaaggtaacttgcctattcgttgtgttctcgatccgcttgatttctattttccctcttcccgttttcttctgtgaacacccttctgatattgcttcgttgggaaactccatctatggctgcaaccagagctatctagttaaaaaatttaattagcaaaaaaaaaaaaaaaagtaaaacaccgaaagttggtatttaatttggagtatcactccattaaggatgcatgaacttaattaggagaaccaaagaagaagctttggaataaaaaggtcattaaactataagctattaagcttgtccttgatatgaagataataatcaatcaaagacagaatggaaagaaacaagggtgtgtatctagctagctaattaggttgtacctatgcaatgagaactatttgtagttctttggtgttatgtaacatgtgaggagaaaatgttgcaaaatatggaagtggggtggcctatgagacaggtatttatggacagaaaatagaccctccaactctcagtactgaaaataataatttggtagtaactccttgtgtaatgtttggaaaataaaagaaaaagggtatagtgagaaggggtttgggatttcacctgtcaactttcatgctcaatgtattaaccgttcatttttcttcatgtatgggaaaaaggtgaggggggacaatgaaagtgtctttttgaaagtgactttgttaatgagtggggtttcattcaattccaatgagagggacgtgaacgtaagtttgcacgcaaaaacttggaaagcttgaatttttgaagcatagctgcagggttgcttcttggattttgagttttggcattttatcctgctagaatctaatctagatttgtttccctccacttcagccccgtttctctttctctcatgcttgaaacctgagttttcaattgctcactcaacccaactcttgcattttttgaatttaagacaaattaagtttggattcaagttaaatgatttagaatcaccttgaaatatcaggtaacaaaattttaagtaatattcatatgtttgttttatgttaaaaaatcaattttgcatctggaattgattgaattgagaaaactttaagtgtgtggcatggtgtcagattagattctctataatgttgaaatatcatttttagttaaataaatttgtatgttttcacattaaagaattttgagttttagaattgataaaaaaaataacatccaaacataaaacatataacttcaaaatcaattttaatgatacttatcgatatacactaagtaattttgtattgaatgaaaaaatttataaagttttattactaatgtccatttagaataaaaaaacatacaaatataaattatatcattttaaaattaattttactaaatctcatctaaacacacatataatatttgaataagcatgtaaattgattttaaattaaattaattttaattaaaattattttttaaagtaaactcatttatgtttgaatttttaacaataagttaatagtaagttttatataatttttcatcagagacaaaatttatctaaaattactttaatttaaaattaattttagactaaaaaataatttatcaaatatatgtgaaatattgcgcactatatttacatcttaagtatttgaactaggtttattaatattatatttcataggtctttttgttgattttatacatatttctttccatttagatagcaacgtaatattgtgtatttttgttaatacaatgtttcttaatttacgatattatatgaattaagtcatgattaaaaaacagacaaatacttggtgtaatatcattaaattccatttccatggagtgttagtatgattcattatttttttattgcagaatttgaccaggttttatgttgacgtatttgcataggcttcaatatataccttgtattttgggtaatgggaaaatcagacttgtattctcagttgcaatttttctttcttctcgtgactttccagtaccttgttgatttaaatgacttggttaatatttaaattatcttcattaaaccttttgaatttggtgttacaatgtgttaggacacagcggtgtgacctcacatgacccttgtggagttatggtgggtacatatatagactcatcatcaggaacaaaatatatatctatgaagttaaactattgtatttgtttttgttgtttgagtgtctacttgcatgatacgagactaatctttcaattaaagattcttatttattagtgcacttctcaagtcccttcagtcgaatttcgtcattaggctcagttggagctccctttgttccatgccctcatgtatcgaccaaggaattcctgattacgagttcagcattctcctttttgcaatgcttaattgttaagcaactttaatcactcgaggatctcggaacaacagacagaatcacacactatactcttgcaaaattatctgattgattagttctgatgcaattctatataagcttgaacgattaacctaaaaaaacaattacacttaatacttgaatgtgcttgaattagatctccttttaagcaggatctagttaaaggaacaattacaaattacaatttattttttactataatataaacacatgttaggttgatgtaattaactaactattgtattatattgaagtacaaaaaaaaactaactattgtgtttaaaattaattaagaaaatttaaataatataagcttttatggagaaaaaaaagatactactaaaaaataaacgttgaagttaattacagaaaatgctaatttcataacacggttatcttcaagttttagtggcccgtttaagcccttgttttcaaatatatgaatgcagtttataaggtgtgcatgtgtaatagttaatcgaatttatttaaaataataataattattttttttcttcagattacataattagaatcaaacttatgactgattaatcgtacatgtgatgatttcatcaaaaaaatcgtacctatgatacataaagagactaacctaagttctgaaccaattaattagtcaaaccttcaagtaatagatgttgggcctaaatcccgagcataacctttacgtcaatgagctacaaattttcacactagaattgaagcatattgaaatcttttcctgtgtttaaactccttttttgtttcttcttttaactgtgtgtttctgcatttaatcaaaatttacgtgtgtcgaccgaaagttagaaattataacttctgcgtaacagactcaagttgacgtgatatttctcttgatacgtagtatatataaacatgagtgagagttttatatatcatttatgatagaaccaatatttcacactacatctgaaataaaaaccttagtcgtttattagatctattagtcgtttattagatctatatctaatatatatcttcatatgcacttaagtaattcgtttttcacttatgaaatcttcactcacttaaaatagtcgtgcatttgacatatttgatgaaatttatagagctgtcaatttgagatagtccgatctatttgtattggtcaatcaaggagcatgccaaaaaaaaatggtttagctagggcaggtcaaattaatattgagctaaaattttgtaagttcaatccaatccttgaggagaagtagtctaaatgaattgatcactaaaggtttatttgagtaagtttttttagaaatacttttaagaaaaagaaaagaaataaaaaattaatgagataaacttctttattagttaaaataagatttttattagtcaatttgtaaaaggtttttaatatatttttctaaaagatgaaaggacatttataaattaattaatgattatccaatagaaaatttattttaacttatagagaaattattttatttttttcttcttattttcttatcttataaatgttactaaaagaacttacccaaacaaattctaactcttctaaaatataattaaaaaataaaattattcaaagtaaattaacttttacaaacaaattaataacatatttttttaatcactataaactaaaataaaaatatataagttgttaattgttctataagacagcataattcaatacacaataatagaaataaaatagagtgcgtgaattaaaagcaatcattatgtgttattaggttatggagatattttagaagaagaaaaatttgttttatgacgatttttaatactcaatatcttaaaattattaacaatgttaaatctacattgaaaaaagggttagtatgaataaatttaaaatataaaagattaaaatgaatattttaaaagatgaagaaaatcaaattgaataaaaaaaagataaattaagaaccaaaagtgatatttaatctattaataatgttggttgtttggttgtgtcttttatacacagttaatcttaatatacttaagaggttggagtattggaatgcatgcatattttctttttttatacacacaagaataattaagagatgccttagcatctcatactgataaagaataacagtgtgtaatctattaattaaagccctctacaatgcagcaaatttataatagtatggttcgtcaaccatgttgatgaaatagataacgtgaacacatattctagttagaagaaatatactgggtaagacgataattatgctctataataatttgtatgttttactctcagataagacagtggtttagatgatatatatgttcgggtaattgtataagttattattaagtttaaatttttgtacataaaaatgaatttaaatatgaataaattattaaggaccaaacctggtgagaatgtttcattacaaagtaaaaataatttaattacggcggtttaaaaaatggatatactgttcatccttgctcccaaaactctattaggtatagaaatgattacatcttcattacaagctaatatatatcttcatatgcaggcagatattacaagctattagcatccttcaacgagaatatgacttcgcaaataaaattgcgcatttatcattcattatatatatatatatatatatatatatatatatatatatatcttttcatgtacatatatacaattaatatttttttattaacaataataaatgtaatcatttgatataacatttagtcgcacttaaaattcattattccttaatatattatgtaagcattaaatttatatccttctccacaatttagcttatgttgtgaattgtgctacactcaatgcatatatatacaattaatatattctcaccatttttgaattggacagtttgaaaattaaaagcacagataaaagaagtagaagaagaaaaaaaactcttcattagtttgaactactttggttagtcttactcaaatgcctttcacaaagaaaaaagaaaacgattttgcaagaccgcaccatctaattcattcactgatgaataaattaggaccctctttgcaaacaatttctgtttcagatatcaaataccatggaaaagtaaaagagccgatggaaattaatttcaataacataactaaataagcacatcgttaagatatgaatgataaaagttatctaccagtgctacttgcatttggtagtatgctatagaagtaactcaaagaaagagtaggcaatataatttgctcaaagaaaataagcatagtaattaattatctatatttcccaacttttcttctgtctgcctgctgccattgattcgtgagtataagatgatcgaaaatgtatcatcaaatttgtctcatgtaaaatccactgaagatgcggaccagacaaaggaaatctttctcaattcctaatgccctatgtattttatcaaatgcaatgagttccttcttttttttctcataaaaaaattagattaattaaggaaaaacgcatctccttaattgccaaagactatattaatgtcagcgagaatttatactaaaatttacacatccttttttttatcagccaaaggaaaaatttattattatactaaaagggtaccagtggtaccttccaaacagaaccatgcaaccataaagaaaactgtacatgtcttaagacctgttaaactacaattccttttatttcacaaaaaaaaaaaaaaagacctgttaaactacaaccatacacatcgcttactaataaaaatctgatgatcgaactcaaatcacaatagtgtgaacgaaacactcgagtagaagttttggtaatgcaataatgagtttcttttaggtacaatgtaaactaatattgtattgcgggaacgcctatagcttgccagtaactagtgccatctaataatttcataggcatgcatattcatcgatttagttagctgcagtgtgaatggtccctagccattatttagatttcattctctagcaacatatatttaattctataccattgttttgttgaaccttacaaattcaaatttccccatgcatatgccatctgttctgaacaatttaatgccaatattaaggctacattctatgtcctagcctcctacgtacgtgacctaacatcataaaaggaaatttgaatccttgaagtttcttctttaaggaccacgttgttctaacatggaaagggttttgataataacccattgataagtgcaattattccttcatacctactcataatcatggtgtctgaaatttgggcatacaatcatctttttcttgacaacttctgatcgatcacatgagagctaattaaagttagttgttatgcatttatatgaccattcaacacttacaactacgacaattaacaggtatttcccagagaaaaataatttccaatacttgctaatataaatcagaaggtctatgaaagcataaacacttggtgattaaattagttagaaggtaagaccatgcacgcagtagtttttaacgtgaaaaattaccccaagtattttatcatgttagctacgagcaagtaataatgtttgataaagtaaattaacatttggtatcccttacgactgaattagtgataagctaggaaaagaagaaagataaataattagtgataagatgtgacaaaaatgagagacgcttgaatatagtgggtgtctaaacataaacaacaatagtatttacgcctttctctctgttctctaattttctttttaggtgtcaattatgactcaagtctccagggatatttttccgaccaagtattatcttttatggattgatgacgacatgaaaaccaattctttatactcgcattagaaaaagaaaaaagatcaggatcaaggatttttttgaggtgggacagagtgaagaatgtaggacaagaacaaggattgaaacacatacacgtcatttctacacttcgactatgattgctgagaatctttcatgtgctgaaaatggtttacttgcgttgaacactgattcttagagatgctagttatttccttgcaaagcctcacattatttcagtaaccatccatacattgtattggatgtataccaaaatcttgcttcaatgtgaatggggaatgtagttgactcaaatgcctttgacaattttctggccaaaaaactagttacttcttgtacgttgaataatacattcaacaaactgctcaccaaataagaagttaatggacagagccacagaggaataatttgatcatcatcggtaaattttatcacacaattttttttaaagtcagcgcttacggagtagattcaatcttaatgatgattgtggatttttaaatttaagacaattgaggattgaacatgctagatatgctgcctcaatacaattatacaagttttgccagaaatgaggttgttgcttttatttgactatttgagtacaccaaaaaacttgaacttcttttacaaatttcatcatgcatatatagttgcagcaggacaatgataattgagcaggctacttctaagtggattacaaataagttagaatcgactaaaaggactaaaattgtaacactcttatcgaatcacatcaaaatgagatagatccaaatgttgtgcatatgagattatacagctgatgatgacttaaagaaattaattgatattgtctataccaacaagatatatttatttttcagtaatttgtcatttaagaatttcacagttaaacgtgtttgacttgaaatagttatgaaagaaatgacattttaagaagtttttcggaaaacgttgtagtgaggacaaagcatgcagaaaaatcttatgttgatttatagggacaatcattaatcctcaaagcaatcaaaacaaattatcgaagtttcggaaagaactacacacggaaggttataaccaatggagtgttatggtgtctaagctgctgccgagaaatccacaattaaaaatattataataacaaatacaagtaaaacatgtaactagtggactacttactattcaaatataagaacagtaaaatcctatgatgataataatagaagtaatagaactgagagaaccatatcactgaaggttctaagagaggatatatagtagggaaaaactttggaactatcgatgaaagttagtaaaatggaaacggggcacaacaataaaattgtatcccgaacagaagaggcacatatgcgtctgataagcccaatggagaaaacaaagttgacaaagaaaaataggataatatgttaagaatggctagtaaaagtaagtcagaaaaaaatgctttacccgaattcttccaattgccctacatcgtctactccggtaattcatagtcatgccaatgaatacatgatgtatggaccacaccacaacagcaatattgtgatcatagttaacagctgtgatttgtgaagcacaagtcaaaattcctaaaacactagtagccaattgatgattgattaggtgagggaccacgactcaaaaatacaacgtaaggagttgaagcaggagaattaattaattgttgaaaatctcattacaaagaaatcaacactctggcatgggtggaatgattttgtaggaaacaaaaaaaatgtgtaccgtgtacgtgcgagacgaaacaacttgttaacgtcatttaaatattatccttttgcatttgctttgaattgattgaccatggaattagttgggggtatacttgcaacattgcaaccctcattcttctttctttttgttggttgggatcataaaaggaaaggaaaataaataactttttctatccaatccctcatttttttctttgtgtagcttatcgtcattggtcacgaccaaagatattttcgtgatctttaaaaaaaaaatcaattaatcaaccttaataggatatgtttgactgtcaacacggaaagatccataataatctacaaatcaaactacatacaacgaacaaatttgtattgacaaattttgctctatttctaatgttctatggatacacacaacaaaaatgatttattaaaaatataccagtataatttactattaaatttatatgtttatcaaataatttcaagaaacggaaataaacttcttttatcttcataatacttgtttgatatttaaatatttaaacaatactccatctggtccttgttactataaaacattttggacatcaattatacaaaccaataaaattaattaattcaattgattctattgaatttatataaaaaaaaatactactaatgtgtcaattatgtccttattaacaatcattaacttgttatgggtgatgtgaaaagactaaaatgctagagtattataaatcactatcaataaaaaacataaatacttaaaagacaaatattaaacatatgtctttggaatattggttaaaaaactaaaataaaataaaatgatatcctatgttttacgtaataaatacttactcattttaatttattaatcaatgttacaagaacactaattaacaagactcataattagaatatttgataagatcaaccaatgaaagaaaaattaaatattttataaaaattctaaaatctcttataaaaagtatcattcattttttcttaaagtatctcttatgataaggagtagagtgagtaaaattgatgtgaattaaatgtgttggctaaagggcttcttttgcattgtttataagagtatgggctagatttaagtggcccaataatattatgctctgaaaccaaaaaatggaggcccaataatgagcaggttttcaaccatgctgcaacccttacttcaagatgcactcttcgtaagtccttacttttttattctgcttcatcccctgtgtttgctccttgtttttcataaaagccttcagtatatagctattgagctctcttttttttctgatgaaaaaattgcgctttataatagtcaatctgaagttgtgaaatttcacatattaattaagctttgtgtaaatcggtaggccaaagtatgcattgcattcattatgtcatggatagatcccctaacatttttattgacatgatatatatggtgggagggaatccacttatatatagagagagtggggaaggaaaaaggagatatcaagttattataaaaataattttaaaagaattattttttattctaatcatttagtttcttaaaatctaataattattataactctaaaaaatttactcctatattccatgttgatgaggtgatttttgcatggtgaagtagtaattaacttgctttggtttcattcatgtgctgaaaaccaaactagtggaccgttctttgcttggtggattaaggaataacaacttctatggtttattaacatcgcatgagatagcatccagcaatttcttatctcaggtcagtttatgaattatggcaatatcatagttgtgaaaattgtgatcatgagtgatatttttaaggacaatacttgtcaagttttttaggtgttttacttttttatgctgtcattcaattagaatcagtttcacttccgtaatctactagtagtaagttttgcattaaaggattacacggattatcaagataaaactccaattctaatgggagaacagtgcatcgcgaacaatatctaaggaactatatatgtaagttttgtcctattttcaatgacatgttatttatttttcttacctttgctaaacttagtcatttgaagttgtagacaaccttgtaatgcaaagatgccagacatggattaatgactgactgactaatgaaaaaaattgttttgctttagcagcaacagcaacgcaagttcatacagatgggaacggttctgaaggtggttgataactcatgagcgatgtgcattcaagaattgaaagggaagaagagggcaaggttaggtgacaccataataacatcagtgaaggaggcacatccgaatggaaaagtgaagaaagaaaaggtagtgtatggtgtggttgtgcgtgcggccatgcatgcaaaaggggaaggtgtgatgaaagtgaggtcaagtttgatgacaatgctgtggtgcttgtggacaagcaaggccaacccatcgggactagagtttttgggcagaagaagcatgtcaagattcttaattactttggctggccatattgcttgaatcagcttagattttcttaattttggaatcaccgcttcacttttttctgattgaatcttttggaatttgtgtgtgtaaaatgtactaactgtaacttgtattgatcgggctctattaggcaaaagagaaaaacgggagtgtacaattcatgtcatcactttagggaaaagagaaaaacagatgtattggaatttttacccttgaaataacaagtagcaagtagcaagcaaatgggatacaatattatgttcatgattgcatttgagaaaatttttttcatagatgtataggtgtgttattttccttttagtgatattaaatcgtcttgcctgattctatacgaagttaattttgtaaaattagagtcaatccgatgatcaaatgatcagtgcctaatctttgtttttttaatggaaccgtgagtggataaaaattactaataacgtattaactttattcaaacatgaaatttcaatacactttaactttttttctccctttttttcttatctatatagaaaatgttttacatagatacaagttgttgggatcatttatgacaaaagtccaatacccttgctctattacagaatttttttgttatgaatttgataaattcaattattaaaaattcatatatatacaatattatagtatttatttatatttaaaaaaaatattatagtttaaatgaaattttttgattaagtattagttcatttttaaattgtgcaattttttttataaacttgacgtgtttaataagatcaatttataataatgaaattagcattcaaaaagaggtattgaatgcaataagctggaaaccataccaaaaaaataaaataaaaaatcatgataccgtgaaagaatttaattctgaccattattaaaatggattatcaagattaaatttaagtcaaataatcctaaccacctactatatatttatggtcaacatgttacctctcatttctcactttcccattagatagttgtatatattttttaatagaagataattttcgtataatgataataatgaaatttgaatttgtcaccttctacaaattattcaaactccttttcactaacaagatctagtgactcaaagcactttcttgatatcgttcaatcttattttaacattttatttgtttgcttgaaatcttattttaacatttgacgtactatattaataaaccgaagagatagcaaattgtattaaataatgtgacaggacaacattaagtacaagcacaaaacttttttatactgacattacactaaagaggaaattaaaatcatgtatacatagacacatatttcagaaaattaagaagaagagagaaaaagtagattctctcgggaccctaatactattaatgtagggtttcaattaaattgaatttgatgggtactattttgttctatatactaaaggcttaaggccgtagtagtagaactttttacgcaactctaccgagactgggaaaaacaattgaaagggtaggcaccttggtaacatttaatgccacaatgacaaaagcttagagctcaaaaggtaatacgataactctcgaatatgcaccaaaggcacatgaaatcccaaagttttggcatccttatattcccctcccgttttgttacacatatagtataccttaatctttatggtctctttcctctcttgagagaaaaagaagacttttgggtcattccacaaacattcctttcctttccttcattcacctgctactacactaaatatatacatatttgcatgcatcaacaataccacccatattccttcaaatcttcttaaaacttgaatttccccaccaggaaatatctgaatatcgcagtttctacatcatgggtgtccttggaacaatggcaagacatttggacacaataatagggtgaacaaattaatctctctccattaatttgcttttaaaaatatctgtaatttgtgtcgtatatatattttatttcattccactcctacacatgcattgctatattatatctgcgccttacagaatatatacttttcacacaatacctgctaaatcccatgtacaatactcatttaataaaaaaatattcaccataatatgtattctgcaatttaacacacaactgtaactataggtttttcattttatggttttccccgtaataattaacagccttttttttttgttttctgcatgccaggcctggagtgatgcttctttatcctctgtaagtatagtaaatgccatatcatattatcatgcaatcgtgtatcattattttctcttcctccggattaactgctgtaattcttaattaacaatcaataaaaagaaattaaagcatcctacgcagaggcatgcatgcacattatcttatctgtattaattatttcatgatatgactaatcatcaaattcttgactacttctgagtaaatatcatagatacgcatcaatgagagcaattgaaagtccttcaaccttggatgatcaacagtggctaacgtattgggttttatactccttcatgaccctctttgagctttccactcataagatccttgcttggtacgttgacatcaatttcaagtcaaatcaaactatatatatagggcacataatagtaatttaatatttgaactttggcataaaaatatatacaggtttcccatttggggatacctgaagcttatgttttgcgtctggttggtacttccaatgttcaatggagcggcttacatatatgagaattacgtgaggcaatacataaagaatattggaagttccaattattctgaggagtacaagaaggtccttcacatgatgaccttcgatgcaaggaaagcagttgaacgctataacgatagatatggccctgatgcctttgatagagtagtcagagcggtatgatacaaaacaactatgaattgcttcatcgtaaagctcatctatatatctgtgtttttaacaattttttgttaactttcatatgtgcaggctgaaaaagaagcaaagaagcgatgagtgagggactatcaatttgaccaagttggaatgaaacgaacgtcaacattgtgaaatcgatacttctttctttgtatattttaacatgaaggagacggaggaatctattgtttaattaaactaaatggcagcgattatatccttcatatattttatgtgtaccttccatggtttaagaatgtacgtaagagcattcgatctagtttgatatagtcattttctgatttagttaagaaacaaaaattatttggttaaattacctcagtttttcgctaaatcctttaaaccctttaacgagaattctactgcaagttactaattggtttcctctaagttccttcagcataactattaactacacgtacccacaaactcatgcttaattgggataaaaataatggaaaagcttgacgatctcaaaaaccataatgctttcataagcaacctttattgggtaatactcatcttcaaacaaagcaacgtacgtaatagtcattatgtataaattaaagtggcggaaacccaatcttataatagaataaaaccagttcgatcaacctttttccttcaacactttggcatacactatatagtaacttttttatgcatatacactatattgtaactttttttatgcatatacactatatagtaactgatactgtgttgaatgaaggtttttaacagataataattaaaatcaggaagaaaacaaaaattgaaacataaaatcatgcactcgtatgatgaattatcctagactcttccgattttatatgtggaaacattctaaaacgtaacaactttaccccctccttattttcacttttcatacagagatgctgttggttattattttctattacttattagcatcacttccacctcggcaatacataattaagtttaaaatacaaaaaagtttggccgatacaatacttggagaagtatgatctacaagacagagaatcaaacaggaggatcgactgcaatactttgcctactaacttttttgttggattttgataaaattttgtgtttatttcgtgttgcattaataaaataataagcgttagtgtaccggcaattaaagaatatctgacacatcattagctcattttgactcaaatgaatatgaaatccgtttaaatttaataaattcatcaatgtaacatctccttagtaattgaccttggaataaattagtcaaattgatttatttaatatattaaaacaattacaaaaacgtaattcagtttaaattctctcacaacttaagacatgaatgcaaatttaaactatttttccatcaaaagcaacttcactggattaaccttttatattcaagcagcttgtaatcatattttttttagaagtttttaaatgaaaaataataattttttcataaataatcaaagccggtatggtagaatttttttttcttcataatttgccagttcaaattaatgaggaagtatccaatggttaatgaataactaaagccccaaattcaagttttattgaataggttaagagagatggactattcccttatcctaaagcccatctttctttcctttctggtgtatcagtaataagcacatctttgcatagtcattgaacagatgccatgtggggaatacctggctcaaaaatagatatccaaagcgtcattattcattggagacaaaattctgtaaagggcataaacttcaaaactgagagctggatgtatcgaaagactggatggaattatatcaatttttccaccggtttcagcaacctggcaatattgatacatggacaatcctgttatgttctcaaatggatatatactatggaggaggaaaagcagatatgataaaatgatataacttacacctaaaatcagtatactttagtcaattttctctgaatttctatatcactaacactgtcagtaatcgcaggtgagaatatggcagaatagcttgtcatcctgatccatattttaagaggaatttaagatgtgcttcgctcttttaggaccaagtcggacaggacctgatgttaccatgccgtccagtttaaaagaatttacagcaggataacttccaggatttagattttgtgcctcatgctgacaacacctactcctagcactgcccatgtgcggatccagttcaagtgctcttgtgtttcgttgcaattccacgcttgacttttctccaggcaacctagtcatacgactgaagttttcttgcactcgtatattcggtaacttggtaggttttctggaatcatcaagattggctgcagctgcaggtctctttctggtatttgtgcacagctgatggtcatcaaacttcaatctgtcagcgaccttatttatgtttatattaccactatttatggtagagggtgtaaccggaacatgtagtggatgaccaattgatactggagaaagaggagtcgtctgcatgggacctagagaagaagtcagatgattagaaggaaagcgaacttctgctgaatgattcacaaatggcgtagtgaaattatttccccacagattttgaggaaaattttgactacttgaagcagaaaattgccgagaaaagatccctggtagcatttcatctgttgagattgacaaccacgatggtgaacttctgtagggactatcaaaccaagatgttttggcctgttcattcacagttggctgcaagaaaggaaatcctccaaaggctgattttgtaacatggggatttttgttcctgtcattcagctcaccattggctacatgagtcgagtgactaaaattgccagttcctagaggtttagctccaggtataaactgctctgaaaagtcattggatgcaccattaaatactgcataagtagacttttgagtaatgggattgaaataagaactggcattgaagttgactccatgattactttgccgaccaataaactgttgagagaatccagagtctgtactgctcatcaatatggtgccttgtgctgcttgattgctttgaatttttgctgcttgcaatacattgtcagctgatatttgtataggtgaaccagatacccattcctgcttagaacttctttccaataaagagtgatctaaagcagcatattcagaataattccttcttctggattcctcatcaggccaaacatctgcaaattgttgcatctcttggctgcttctaccaattggaacatctttacccatcaacctcattgttagttggctggaacttggtgagatatgatctgaaccttctttcagagaaatcaccccatttccattgtgattccagacccggtcacattgattctgttcaatgaacgagtttttcttacagttcaactctgaattaagtggcgggacatagtgactggaacacatatctgaagaattaggtcggttgatatcttctctctctctagattgtaactcagtgacaggtaattgggttggatgatgaggaaatggattaagactatcttttggaaatgtcttctgaacaacatgattctcattaatgcttaaattttcctggttactttgatggagaatattattaatgggtaagccactaaaagaaccacgtaacgtacttgatgtatctgactggttcatccctaagtttccacttgaactgaaattgattaggtcaccatgagaattgagtggcaaaccaaaaaaatccggatccaaacagctatttttgccacttcctttctcccagcctgtattggggaatgagttatcaatcatatctgcagaaaacatacgagaaaattgcctacccaaggcctcgccactgttatctttatctccataagtttgcaatggagattctggtttttcatttgcattatatgaagcagaataagatgaagaaggctccagaaatgtctttgtattttcatttgagttaacagcatcaacctgtggatcatccaagtggttgaacttcccactgtagctgaaagatccagattcacacatctgtgtatttataccagacatctgctcttcttggactgctgaaagaggtctagaaatgtcagcatacggagaacaatgcagggtatttctgttccctcggtaaaaaaactgtgaatcattattgtcacaaactgccaccttagtcaacaattctgacttctcttctaactgttttgacttctcttgattgatacatggcttcaagaagctttgtacggtatcttggtccagagtgttagaaaactgtttactttcaactatagggcaaacctcctctctcttgcctctgtcaatatggtcataatttctgtttggctccaaacttgcagtttcttcatcacttccagaagacttctcctttactactgaagatgccaccgcatctgaagatatctttaacatggtttcatcaaatgaatttgtcttttttggaccaagtatatcatctttgccagagaatttcacatgtctgtccaaggttgcctcttgatcattataatagctttcttgagcaccatctccaatactactgccacttgacgtcttttcagaaacatgtttgaagcggttcttaagaatgccatgaaaaggagatactgctttttcttgctttccaactgagtcccagtttttaacttgttgcttcttttttaccgataagcaatttatacctgatttctttctatcgatagaaggatcaacctcatgaagtggaagcattttattaccgattgtaccttttagttttctggaactgtttactgcacttcgcaccatgcgctcgtaaacatcatcctgagatagacaagattaataaaattatgaatgttatattataataaaataagaataagccgactaacctttaggatatgcaaaatatgaagataaatataataacacctcttgtagcctgtagcttttatatctttctcctttcttttcttttttatggatgtcatgttgtagtttttacaagaaaataaacaaaattacaacagtttcatgtataatgatgccaaaatgtctgcttatgaaacagacactgtagaaaattagcatttcatatcctttcaacaattccaatcggaaatagtgaaaggatttcaattgtctatgactgttgctacattacaatttacaataacttgatgtccaaagatgaatgtcccgaaaagtttactcagaccattggtttttcagttttttttataattcttgtccctcatcaaaaagctttttgtaaaagattgaggcaacttcgttcatgcctatatcttgtgtctacataagataaaacggcaaagacgttttcaaatggaatttatggtcaagtaaaagtagatttaatacaaaagaacaatttcaccatggaaagtttcagggaactatacaaactatatttccagcgttaattataaaatcacgatccaaacttctggataaacaaactctttgattattaagtgaaatttttttaattttctataattaggaaaagactttagtgacatttgaataacactttaattggggttttgagtactccatcattcatttaaaaacaaatcaaattgaaatacattaagatcaactacatgtagaagtttataaaattgaaacaattgaattaagaacgaaattatatcattattttatcatgataagaaatttcagaaacgcttaaaacaaaattcttaaacttggtcattttagtatcaattttcagaaaagggaaacatagaaatctatatatgtatatatcataaatgcgtagatcatatatttaagtagccataaaataaacttaggtactaagaaaaacaattgaaattttttgtaatcaatacatcccagaaatgctcgtagttaataaatacaaggttatttgagcttatatattctggtacaaatatactactatttttaaatctttacgagtgaatatacatgaaataaccatatatcaagctagatgaatgtataattatatatatgaatatcagcatgaagaatgcatgagagcttcaattcaaaatcttatttattgataatttttacgtgttgatagaaagtacaaatccctaaaattgattttacttaacaaacagaacgctaaacaagcttgtagaatttggaacgaatattattttttttttaatttcgttgtaactgaaagctggggcgtaaaataattatatgctattaagatattaaaaatccggtaaggtgcaattacactttatgataaaataaacaaaattgtaaagacaaccctttttgtaacaaaatttctaccttctacaatgccactttgcgaatctaaaatatcatatccaaagtgtaattctataacaacatatatattcttatcattgtttatacgaagaagaagctaacgaaaaacacatgcatggatgtagcaaatagtattaggacaaacaactattacagattctgaaattaaacgatatcaccatgaggttaaaattattattgtaaaatatttatacgataaatatcttacttagttcgttcttttagaaaggcaatttaaaatgcaaattaattaaattaaattttaaaaattagtgggatattggattctattaaaaggggaggggatggacaatggcaaatgcatgaatcatgatgcttaaataatttttttacatgaatttgagactgctatgtaattgttcactgttgaaactagaaatgcacatatcacatatgatacacctctgtagaaatctacgtggtccagataaccccattcgaaacctgagatttctttagaatctgaatgccgaaaaaatccaatatattttaatcttgtaaaagaaatggtaggtaggaaaaatatagaaccagagttcgagaattatttttggataataaagtatttactaagattagtctagaaaagttatttaaaacaatctagacactataataagatgccattactgatacagtaaggacagtcaagttataaatttcacttctaaggatagagttggctgcaagatcatatcatccttatatcatcatcgagtaaccttcatggctagccaagttaaatatttgactactttacttccactttcaaatttcggccagcgtaaccacaaactgacgttggtttcggttttctattgcttctatatacacctcctaggttgggttctaatagacactcacatcgattagatcttatctcaaaattgtctgcacatgttcaaaacatgagtcgctaacttatgttgaccgatacatccaagtcattctacccaaaaacgaacactttcacaatataaaatcaggtgtctcacacaacgacagaaagtccaaaaccattatacgtaccataaatcaccaccccctacttcactaatacgccataaaatatgcccatgcgataatgatctatatcaacccaagtcagagtattcttttttgacgatacatgcccatctggaaattgcatatgcgaacattcatcaatccaaatcactaaatatacacttctgacagacccaataaatgatctatcaaattctggacctccacttgcagatctcccacaagccaaaatacatccagctgtaagctgcgtataaaacctctctacgtccgaaaaactggccacaagagatatatgagaatctgttgatctacccatggcacatacgataattcccccccaaattattagttaatagtgacggggctagagaaacccctcatcattagactcagctctctcttctacctcgtaacccatgagtggccccttctagctagggtacttgtactgattatacacacaacacacactacagctggagcaacattcttgcaggcttcactaccttctgaatcccttccgcgcacgaaggcactggtcacagttttccttttttcgtaactctcttttcccaacttttacttgtcgcgtatttcgctcaagtactcaaccaaaagaaaaacactcactttcgtccacaaatatgtgaagctctctctctaatcagctttttcagcagtaattttatgcagaaaaagcaagacatagagtaaggaaagctataatcccatggcataagaaactacatcaacccaaaatctacattctacagtgtcgggtaatattttatgcgcaaattccatgaatttgtatacttatctgccaggaattagctgcaaatcgcggaaacacacagcaaataacggaagattaacttatattttatgagacacaaaccacataccttgttcccagttggtccgttgttgaagacattcttttttttcttcttcttcttcttgctcgcaaccgtctgcttctcattgttcacgaaccacacaccactatcgccgtgcttctccaccttgtttttcttcttcttcaccttcttcaactttttcttgtttctattcttcatcgtactcttcttgttcttaattaccgaagcaacgggagtagcaacagcagcaggagtggcggcactagttgaatctccacctgaatagccataatcggatttctcctcatcttcttcctcaacctgaatcgctttccttttgccggcttcgatcggtggcgccaccgtaagaatctccgcgatcgagcgcttcttcggcgccttaggtatgggcttgcaattaaccgtcgaccttctcatctgccgccgttcctccctgacggcctgcgcgaggcaaccgtctatgtgtgcgtttactgccgtcaccgtggcggcgttgaaatctcgacaaacaggacacaccatctccatcttctcctccgaggaatctccttggtccgatttcgccgactcgccgcctccgcgcgtggatctcagcgcctccagccgccgagaaagccactcgaacttcgtaacggtaatcgaaacatcgtccgcctcgccctcgcggaacggccagaacttcaacaccctctcgatttgcggcggtggctgaggctgcggctgtggctgtggctgtggctgtggcggatgtggctgctcctccaccttgaaaatctcggctatggaacgcttcttcggcggcttcgactttgacgacgaagatttcaaattcataatcctcatgtggcgacgctcctctctcatcgtctgcgcgaggcatccgtcgatgtgcgcgttcaccgccgtgagcgtcgcggcgttgaattcgcggcacaccggacaaaccatctccagtttctcgtcttcgttgttgttattgttgttcgccgccgaggagtcggaaggaggcgcggatttctcggattccatagattctgcagattcatcttcgctgcaatctctgtcgccgtcgtcgtcatcggttctagaaacttccggagcagaaggcggaatctccggattttgaacgcggcgttcgttggaatcgccggatctagggcacaggttcatcggcggaagccacgactgaacctcctctggtgatacgtcacgtgaggaggtggatgcgaacggccagcacttgaaaacgtcgatggacctcatcttggatgtgtagtccctgcaacagcaacaccgaatcaaaacctataaagcgcgcttctatatattagtaaaaccaaatccacaaacaatagataatagaaaaatagatataccttatggagaatccatcaaacgtagccgccatgataagtgattacaagaagggagagactatgaagaagaagaagaagaagaagactgagaaaagaggaacatcgatgattatgattagatgagagagagagagagagagtaatcaacgttttgcgctctcacaccagaagagaagaaggaggaggaataggagagagtgttgtgtgtagctgtctgcttgcttttccctaatttatgactgatagggacgtatgagagagagagagagagacgacagatacagaagaaacgaaggtgagagaatattttattaattatttaattaacactcatgttttattataatgttaatgttggtgcttgttactgtaattgattttcgctgattaattattttattattgctaatcaactcttgcgctttattcttttctttccatgcatattattttcatcttaaaaaaaaattaaaaaaaaaaagtgattgcgaattgtgtgtgttgccttgctggtgggtgctgcgccgaaggttaagcgatgtatgtatttaaatgatagtatagttaaagggggcgtataatgtatattgtatggtagtatttgttaaatgctaatgttagatttgtagtgttatatgcccacgctcgtctacttatatgaaacaaagattctgctgtaagaccataagaccacaaacaatccaccatacgcgatcacccaccaatccacgcgctttctaccattataatatcacttctttttttaaaaaatatattattataaatagtttccaaattacttacgttgttttcttttttttttatatacaattaacgcgttatttttcatggttttcaggtccacttaaataataagaaaaagaactaaatcataaatcatgtgacattatacattaaataataagtactaccttaggagaaactcaaatttcaattactacttaatctttatggttcttcctttttttaaaaaagatgtgtacagataggagaaaataacagaagaaaaattgtttttcttcttttcttctaatactttcattttttgagttctactaatttagatttacttttgcttcatatttcatgggggcagagattataaagaaataatgagaaagagatgtaacaacaacagatagactagcaaaattaaatataattttctttctttcttttaatattttcatttcttgagttttatgaaattatattcactttcactttctacttgctgacgaacaaatgacaaagaaacggtaagaaagaggtgtgatataggagagaacaataagagtcaatattcttttaatactttcatttctagagttttactattaatttagagtcactttttctcagtgtttggcaaggaaatggcaaaagaaacaacgagaaagaggcctaaaaatgaaatataacaacaaaagtcaatttaatatttatgaaatatggtgaaaataaattaaaataaagtggcgggcctcaatcacatttctttccgtgtaaaaaagatgaaaaatgacaaagaaacagataataatttgacctataattaattttgcatacgacataatcttttttgtataataatttgctgccgatcgacatctccttacatcttgcattgaccatgaacttataatttgtgtgtctcttattttaatccaattcttatcaacttacaatacatatgtctcttgttttaattcaattttcataattctctgaaaaacacaaatctcaacctctctaaaacaaaacacactcaccaccctcattaattattcaactatttgaaactattttatcacgagaaatagagtgaattttctttctttctttttggtgctataaaacatccttcttagagctgaaaaatagggaataaaaaaaaattatgtatctgaaaaataggaagaaaaacaagtaacaaattattctcattcaaatgttgaaagtttctattcttcctcgtttaattttttctcatccaaacaaaaggtgaaacattagtaaaaaaaatgaacgataatataaggtatcaagaaagatattaaaacaagtactcttgactgtatttgaattcttggttgacatgccttaacttgaatatataatgagtcagatattttttttatttaccatgatatttgacattgtattaaaaatatgattataaattttagactcaagtctcattaaaagtattaaagaaatatttttacattaatactaattcgagtcacgatatttgtctaaagtatattcttaattatgtcatctgttctaaatatacctttaattagacttaatttttttttataattacatactcaaaatcaatcttaattagtagtacaagttttcaaacaaaacattgtgtattaaagtctctttttaaatatcttttatccaaaaaaaaaaaatcatatcactgtaaattactttgaatcaattttagaaaattacattgattcaaaataaattataggaatacatattcaaatatacacttgagtgtggagagagtctagctcagttggttaaacaataacatgaattgttgtaaattttttgacaatgtctttaatgtttacagataaaaacatatacttgagcaatgaacatttttatctttttttcgaagaaaagaacatatttatcttttcatgcgtaaaattaaacccctcagtcatcaaatttttatgggtgttcgtatttgttgtttaatagtatatcagtgttcttcgtatgaaaatgttttgtcctttgagacacttcaaaatatttaaacattgtatttacttttcctaaatatttgatgattacttacttaatttgaaactaaataattgcctacaagttcactgagagatgcttcgatatgagtccaactccatccattgattcattcatcaatcaaattaggccatggcatacaattaagttatgatggtgagggaggcaacaaggaagcaattagaagaaaggaataactattttgattggggagggaattcgaaatcgcaattaatgcctggtttgtggttttttgctagtttttattattattattattaatttttaagttaatatatttgttatttattagttgcaacttttataatttttttaaaataattagaatacactaataatgtaaaaatattttacattattatttaattacaattatcatatatgattacaattttaaatttaatataaaaaatagagtaaattttagaggcttacatcactaaggcgatctactttgacttaaaacgttgaaagtccatgataatcaagaatacctataataaagtccactacaagagacccaattacaagataagtttgatacattttagaataggagagcatgcattagcctatgggttagtacccatagttattaataaaaataaaatttgttgaatttgatttttttttaccaactatatatgcaacaaatttaattttaaagaatgaaattaatataaaaaaattgcgcttctttaaatgtgcattttacatactatctctaaaaagttatctcaaacaactattgtcctatttatatatactttactttcctagttgtttatcaatttcaacaaatcctattataatattattttaaattaaaatgaaatagttttttaaaagaacttatcagtagttaaaataatttataaggattgacaacttcaattttgagagtaaaaaaacatttttttatcctcctcttatcatcttgaatcttttgagcattatttatgagatttttacatctttttttctttaaattcacaaacctacatacatgactatgtaaattttgaaaaataaattggatcaaggccaaaatttactttcaaaacaaatactattgtcacatcacaattattctcctattttccaataattacataattaaataattaaacaaaaaattatgtttataaaagcgatataaaacattgcaagagttagagtagtttataaaagtataatttaattttttctcgtataaatttgttctctccatctaattttattcattgaaaataaaagacaaggcatgagaaagaataaacaaactcatacatgaaagaaaatatgatgctgttgtttataaattttctctctacaaatataaataaaaactaaagtaaaaataatgtaaaatttaaaaaatgagaagaaaaaagagagagagaacctacttatatattataaaaataaacgtttgtcttgtgcatcgtggaagttaaaatattagttatagttaaataaaataaaaagttaaatttgttctctccatctaattttattcattgaaaataaaagacaaggcatgagaaagaataaacaaactcatacatgaaaaaaaatatgatgctgttgtttatcactgtttttgacaactatcgatagtcaccacaccactcaccattaactatctcaataactttgattctttttatttttaaatatttgtttctagttaaattcgtttttaaaaatatacactgcaatacttaatagaaataattttaatattaatatatgcacggaaaaatctaagtgaactaagattactctttaaagcatagcttaatccttgattagatactttagatgtactcgatcgagaccttaaaaagaaatggtctaagacaggacgcatgcaggttggtcgcagttgaataagatgtattcaatctggacatttgtacataaaatatacctggatagaatgcatctaaattggacaaatttagatatatagattaagataaatgataattaaagctagcttgtaagaagaaattgtacattataattatccaaagacgtatataatcctctaaaaatgtaagttagtttacaaatttagttttcatttttattaattgaccataatactttttacaatgtttcttcaaaatcactgaataaggtgtgtgtattagtgcatatatatatataaaaaaaaaattgtctaacttcatggttattaattattttgacgagatcactccagataatcaactagttgtgatgagtaagagattaattgattcgtcaaaataatttttgtctttttcttatttattatttttcttaaatatgaatttataattttttaatacgaacttttttattttattgttaatctatattctcatttttatttatactttcttaaatattcggtatacgagattaagataagacctattatgattcactgtattatgattcactgaatgcgatattaacttctaaaaacacttgcatataagaaaatcttctaaaaacattatggtagaaaaataaattcttaaaatattctcattcaacatgagcctttggatttacaatacagaactagacttaaactgaaaacaaggaattatttgattcttttataattttttaaataaatttcaattttgaattaagaattaatttcatagttatcctaaaaaatcaaaaacttatatagatatttgagattccattggagaaccaaaatttgtaattccaattattaaaaaaacagttcgaggttaaaaaataagaagaaaaaaataagtttgtctttttaattttaaaaataattaataaaaactaccatcgtatcataaaaaaatgataaatgatcaattttgtctgtgtactttacattcgtcgtgtaaatatattgacaatttaatcctatcgtgaagtttcatccgttttcgttaatgttgagtgtcaacataacacatccttgatgacgtgacaaatccacatgtataggagatgctccacatcaaccacaatgttttagactaaaatgttagtgatttttttattttaaaatttataaaggtaatgactattttaagaacacgatgactcttctttctaatttcatgataatattttcttttggaatgacaacatgatccctaacgaatataacttaacgacaaaatggttcatgacaatattgtgaatttaaagacgcacatgtatcatagatagtaaaaaacatacataaggtcagtctccagagtcccaataacattcttcaccctccacgtacatactccaacaccctttcatcattttgaacaaatcgacctttgtgatataacataaggttaatcttttcaaacattcagtaaaaggaaacacacaaaatagagtcaaaagaagaagaaaacagagcatctttgtatcaataataatatttattctttttcatacccaaaacaaagcatcattgtttcagttcatcaaagcatcatcgacaaaccctaaaccctaacacatgtttaatcccttgtttgcctacaataacgaaaaaataggaagaaatctaacaaaaatgatggccacatgagaaatgttacaaaaatggaggtcattaataaagtccagccaaaaaaaaaaaacatctttccttacggagttgcctttcatcttcaacgcataagaagaaatcaaacaaaaacggcaaccgccaaccaaacaccaccatctgtcgccaagtcgtcatgggcatcgatgatgcaaaggcaagaaagagcatagcaaacttagcacccataattcaacctttttcttacaaaatgtaaaaaggaagaggataaatggtgaattaataaaaggcaaaagcacacacatactccaattgacaatttggtccaacacatggctttcacttccaccacatggatttgtcacgtcgtctttcatgtgccacattgccaaaaatgttaacagaaatgaaggagacttgaaggtaggactaaattgtcaatacatttacatgattgtagactaaattgatcattttcatagtacaaaactaaattgacaattagtgtaaaatacatagaccaaattggtcatttaccctaaaaaaaagagtagttatacatgaactactcataattttaaacactctattaacacctctaatttctcttcatctctatctttttatgatatcataaatcttatcatacctatattttttttcgctccctagatattgggtagcatattaatcattaggtgtctagaaaacattttccttaaaaaatatttattttcaaaaagctataaaaactatttttacctatcataaatagttatgaaacaagaaagcccacatctatgggtaaatgaccaatttggtccctgaaagatgtatcctatgataatttgatccttgaaatatgaaataaccaatttagtccacaaatgtacaaatgttgtgacaagttagtccgaccatcaagtctttactgtttccattaacctttgtgcacacatgacacaaatgtaactaacgtggcacatccactgttggtcctcaagtccaacatccataaggtcaaaggacaagacacgtctaatgcacaccgttttggacgaaaatgtcacttagggcttggcggggtcgaggttggcattaacctcgtcactacccttgagtatctcttacggtaattaaaaggcagcgttggagaagacatcgatgctagcttggtgcttgagggaatggacctcgatggagggccaggtttcgtcgtcgaggatcttgttctcaatgtcgatggcagagtggattatcttggcgatgctcttgttgtgcatggtgacaaggcaggtgttgctaacgctgtggaggacaatgtcgggggccatgaagatctcaacatacttgcggctaagcttctctggcgtgacatcaacgtcacgataggtcgtaatgtcaatgcagacaacctggttgcactcaaagacattgacatagttgtgttggtatgtgacgatgatgccgatgacgtaggtgtagttcacgaggtggactaatttgtcactaaatgtttgacttgtgaaggtgtgttttgaggagccaaacattaactgtcattttggtccaaaacaggatgttttgagaagtcaaatattaggtgattatttagtaaaaaatgatgaatatccgacgtgtcttatcacttgacctcatgaaggtgtcacgtgtacacgaggatcgacaaaaacataaaagacttaatgacggaaccaatttatcataatatttatacatttataaattaaatttgttatttctattttttagggataaattgatcatttattccaaatatcttattactatttttttttttctaactttgtagatactattcttgagaactgaaaagacgtggaatggaagtatcgtgaagcgcgtgaaagggacgagttgtgtggtgtcgtgtgtggcgatgcttagaatatgaggcgcccccactaacacacacacacacagtgtcacacagtttcttgcagcgcgcatcattttgactttaagaccttttgtttgtttaaactttaaagtaacgtacaccgcaaattaccaacttttagcatgtttagaccaaaccataggatgcagccaaacacactcagatttaattcaggtagatagagttttttttttttttttttccaagataaatatgttagataaaattatagttgggtgatagtaaatataactttaaatatcaattataatgtgatctaaaagtaaaatattattattacataaaagttataatttataaaccatattgaatccaaaatatttcatgatttgtgaacactcaatcatgataaattgttaatttttaataagtatctcaaaaagttatatttataataattttctaattgattgatgatgtaattttttttataatattatgagtattatttgtaggaagtaattttattcgagttaaataaaatttaataattatttttgaatatttaatttaattgcaattgcataattaaaatttaaatttaattttttaattaaattaaaataattctgtccattaattcacatgttaaataatattaaatttaatatttatattttatttgagagttttataattatgtattgataaagttaaatattattaatcatttaactttatcaaatatcactgttattataaattttaaaataattatgataaaaagtatgaactattattttatatgataatttataaattcttatttgaatataattactgtgaagaatatagttggggcgtggcaatctggcataatgatacacgaagtgactgaaaacatcatagatgcatgcggtcaaagaaaacgacaagaaggtaggacccacccactaatgataatggtattcgtgtcgtgtagtgcacagattattctctttctgtctaattctaatctaatctcactttggtagtttggtttcgtttgcatcatgcctagcttccaattccaacacccaaatgcaattttcagttcttacctctctgtttccctctacactcccgaatcctcctcactcatctggtatgtgcctataatcattataatatataatttcatcaaattagtctttattctagtttggaaagtcttccatgcattttctattttatatatttctatttctttagcatatataacttacttactgatatcatgattcatgatatatattttttgttactcattttattatgatacctgcccccaatccttaatcaagggatcatttcagtaaagaaaatgaaatataatttaaattcggctggagtatggacttggtgataacaatatatatggacttgctgttttagctcagcacttttctggaagagcttaaatatatatatatatatatatatatatatatatatttttttttttttttttcaatttttgtttgaggagtaggaagtaacacagtggtttgctgattttcattcccaaaatgagcaaagcaggtgtcaggtgtttgggttgaaatttgttgttatttttgaaacttcaaccatattttggatattttttcagttgatttttttttcctttctcttccaatgatgtgttttttttttttttttcctgtaacagattgaggatcagattcaagtgcatcttattgttgaaatcatttcctgtttgctgatcctggctgatgaagaagttggaggagattgatattcaacctttgaaggttgttgaaacagaatctacagtccaagcaggcaagcaccctccaagagaattgaaggtccccaagtcactgttaattgaaacctcaacaaccaagtccgaggatcaaacaactgcaacacaatatacagcaagaaggtaacaagaaattccaactagacctccatcatgagtatggaatattttactgaaattgttttatgcattcaaatgggggatattagaagagtgttagcaatacagtctctattccctatacgatggttaattaatgaaaactacaaaattatgattgaggcagatgagcaaagttttgtgagttttgaataaattttaatccataataaagagtatattcaaaagagtctgttactgacagacatttctcaatggggaaatataaatataagtcacaaatgaaatgcatgagattaagtttgcttcagacaggaacaagaaattaaaaaatgattggcatttatttattgaggcaatgctagattttttctgaagctcttcggggatcataattcataagtaaaccatgttgtcattccacccagaaagaaaagatgaaggagatggttgctgtttgctttgataattgaatgaacaattaatgcaggagagggcattgagtaggatagcaatcatgaaagagctaccctttaggtttttgtgaaagcagaagggtttagatacaacttgagtgttgttcagcttttatttaatgttccatccaggatgtacaatgacaaccagcaagggaacagttttaaaattttcataaataaaaacataagaaagggcttattatctcttatgtaaattaccttgcaaaatgtaagccttactactgattgttggactgaacgtggatgcaaaatctgaatttaattatatgtgcatcatttccccctttatagataaagaagtacacagtccacaagaggattatggtgaatttgttacctactgagtattgacaaaaggagggggtaactcttaagttaatttgactatagaaatatagtgagattaaaaatttgacgaattgtacaaagatgaaaagcaaatcacttgtgtctggggtgttcaaataaggtggaattccaccttgatgttagagtttgcttttaaattacaaacaacattttagagacttgaagatactaatgagaactatttgtttgagttttaggtgtaaaaggatcttccagagatctagttattgatgattgatgacattaaatccatggatatagcaaaatgaaacgaaagcatgagaactattaattggggaaacttaattagttacttaatgctatttgtttataccaagtttttgtgggaccaaagatataaaataaactttgttgagtttctttaatttgctaaccgtatggttttgaactgcaaaagcattgacttccaattaatgtgaaagaaacattaaccttgttgtttgagcattatttcttttattgtgaggtagtagctcaagaactgaatgcttctgagtttcagttttgttaattacttggcaagtgtaccaattcgtctaagtagtagtaaaacggtaagaccgagtgtcaaaatccacatagactttaactatactcagagtttgtatatatctaagtttaaactaataaatgactaaactatatacttgtcaagtgataatgcagacatgcaaaattcaaccgtaaataaagataacaaggtagagcacacgcaagagacagaaaaacaaatgcttggaggtgtaaattgtcgtttggtgcagatttttgtggacgtgttgggtgttcgacctaccgaaactactcttgatgcaatgttagagatttttcaccatttaacgttattccaactattacctttatcctctaaattaccctaaccatgtttcctcatgtaaaatagcctaaattacctaatttcactcctaatcccttaagaactacatcaaataatttgttttaagaataaagatgcataattaaggctaaataacaccattttatccctaaacatggattacctagaagctccttcaagttcttagggtacaaacatttcccaatgattaaaaccctataacatacatgtgaatgggtgatcaaatcataaacaagacaataaactcataaaagaagcaataatattaaaatagcataaaatggttagtaaagatcatcacatcaagagtgtttggttgcctagcccccaacaatgggtgatttagcctctcatagtcatgagagactcagaaatacaaaatgaagcaaaggaaatagaagaagaaggactctaagtgagtgggttttcgttccctattgtgccttactatttgtcccttaatagtacagtgctcctcctttttattcttcaaaatgctgcacattcgtgtttttcgaaaatgaatgtgcactaaacctgcatgtgcacgctgagcgcacatgcaaagtccaaccgacttaagtgaccaagcgctaagcctccaattgtgcacttaggactcatgcatgatattggcttctcgcgctgaggcatgttgagcgcgatgctcaaattcttcatacatcttccattcttgtgttgatgtgtccaaaaactctacaaaatagaacaaaacattgtaaaattactaactttaacattcttaagataaaaactcaaaagaatctaaattcttatctttttaagtcaaaagaagcatcaaaagagaagaaattaaataattgctatgtcatttaagtgcacaaactaagtatgcatagcaattatcaagttcatcatgctaaggattatggagccttcaaggaagacattcatttatatatatatatatatatatatatatatatatatatatatggattttgctgaattaatgagtaaggaatatctattggagaacaaaaatgaaaacgaaacgaagagaggaatcatctgtaaattggaatttattaattggtcgaagataaactcttacaaatatcttgtacttgttatgaggctgatgtgatcctgtcaactttttgcatgagaaaacctctgtaggtgcatgtttacagaaaatcattgagtctaattaataagggtgtaagcactcatttgtgcttaaaagttaaaagtggtttttgtctatattactaccaaatgatatgtaaggagagacaaggtggtagttgaaatttgtcatggtaatatcataacactgttagttcattcttgaacagcaccaatatatataagaaataagacaggtggctttctggatgaggaaatctgatcacgctaattactcaataaacaaattgtatgttcattcacatttgtgcattatgtgttactcgatgcactaattgtaatcctgattatttagcttttataggttgaaggaaagaggttctaggctactagtttgatgagaacagcttattgaatgagtcatgagtggttgtgcttgcccgttatgatataaattgttggcatctaaacctattagatttcagtgttagtaacatagttcatgctgttaggctgtgttgctgctgcctttaattacactataaaggttttaaatttcctgctgcaggttctgattttaatttctgttgtgagattttatgtttgtagtagctcacttgctccttagaactactacaaagaagttgggttatcttttgataatattaatttggtttcacatcacattatgctttatggtatggtaaagtcatacttttattttttatttatacttttgtgaattaacagtaaattttccccttagaaaaagttacaatcttatatacatttacaggaaatataaaagtaagttttttatgcaagagtaagagaaatgaatattgagttattgaccattggattttattatagatggttaagattagaatataaaactaacgtcatttttttaaatggtcatgtgatattaagaaacttttcatcttaatcatcatatgactcagatttgctatatatgcaacatattgtgacagctagctgcaatctatctattagaaaaataagtcagacgcacgaaatgccattgaggtagctaatgatctactcaaactcttttactttgcttttgtagtataaaatttgaattggttacattaacttgtcatctatgttcgcctatgtcaactattggatctcaaacgaactttaaaacaatttccatcaattaatctacgcacttagtgatcaatagcttttcgttaattaatttaagttgtgtttacttaagcattgtgtcaacccagatccgcattattcagaagcaagatgttgtagtttatgcctcttatgggttattggatttggtttccacagttaatacagttcacacacgtgatttcaaacacaataagtttctttgtaggtaaaaagtatattatgataaaaaatacttttaataaaatatttaattgtcctaattatactcctgactcctctttatacttaagagttcaaataatgagtaattataaataaaattacaggaccatttttcctttatctaagttttaatcagtgacaaatagttttgagcatcttactattgacttttaacatttcaaaagaaaatgaaaatctgaacactttcactgtcagatttaaaagtttattcaaactgattattttatgaagtctcaaatgatagtaggtgtctaaaaattggccatcaataaagctgaattgagaattaagaaaaattactggtgaaatactcatttacaataaaatgaacacctatctcttgaaaaaaaaatagtataacttttgacaataaaaagtattatagttaaaacatctatgaaatagataaaagagtgtaatttcatagagtaatttgaagtaataaaagatcaaaaagagtatttacaaaattacaaccccaggtaattaagagggagacaaaagtaactgtgctaagacagctcccaaaatggcactcaaataggaagttgtaagccaaaatgggcctacagacaaagaggttccctcctttcaccgtacgtctttctctctttcactctccacaagacacacttttcttacttacttaaacagtaattcttcactttaatactattaagcatgtttaagatgcgggtgagcacatgataactaagaatgaagttaacaatttccatatacaaacaaatgagacaccaaaaccgaagaaaaagcaattagatatatattagctagcttcgatatctgtctcaacctacacatccaattcacttctttgttaccacttaagtttgtttctgagccaagcttgtgttgttctcaggtacacaaatggctcatgaacataatttagaaattaattataatatattaattaataatgaatttttttacagtgtaattttatttaatccttggtttttagtatataattgaaaatcatcaacttttgtaataattatttcaaacatcttattcaaataatgtctaacttagttgataggaatagcataaagatcagtgtatcaaattaattaaattattaatatctctcaaaagtgacattgtctttcttattactacttagttatattgatctttttcttttcatttgtgtctggtgatgctttaaggttcactgtttgattcagatcgtactaaagtagaatatacggttgcaacatgtaatggtgtcaggtgtgtgttgttgcagcggttaattttacgtgtgaaaattaagaatgaaggtaacactagtatgacaatgattggtgtttcagaaacgaggcaccattaaatttgaaattgtagcacttttagttttaagttttaacagagaataataagaggggaaagcttggtaatgctaattttcacttcaaccctcattaagatgtagtagtatttactttatctttcatcttatttatattttttttaaaactaattcacctcagtttatctcacaatgagtggacgtatatatttatccttttcatttaaggcctaaatgaaagaatatcatatgatatgtagttttaactatcaaacaggattgatgtctccctctaggtctggttacaaatcaataaaatcacttcgtaatcaaattaactaacatctcattcaatttatttaaattacaaaagttcatctcatttagccttatactccttatttggaaaagaagcaaaaataataatattgaacgtgttgttttttgtgctgcctaatgcttattgtaaagtctagacagttaatttaaacaagaaaacaagagagagagagagagagagagagagagagagagagagagagagagagagattaagcctgtgttttgttatacatcaaatacctgagaagtggtattttcacatcaatgacatgaaagaaaaatagaagctactatttatagctcctgcttgagatcaaatactgatcgacaagtgataaacattaaaccaaacaagcagtaaggaaaaaaagaaagcaacaaaccttcagcaaataaaaattcaacttccattttcaagtacctgtatatatgtgaaagcgataaaattaaaatgacttcaatttttgagtttaatgaatatccactgttaacataaatgatatttaaattaatgtctgatgtattgatatatcattacttattatcatatcatcttttattcattaaaaaaagtaccaaacgtattgagttttagtgtataacttctattatatagaatacatatttttttataagcatatagagaatacatatttttttattttataattaagcatagagagaatacatattaattattttcaacataattaaatttttgaaaacatcagttaatttttttaaaagaactcattgattgtccatgcctaaatgcgagcagtaaagcaaacattatattgattcttcttaaattttgaatttatatattttcagatttcagatcgtctgttaaaaattaattactagcaggtaagcaaaaatactgtttgggtacaaattatagagaaaggtaatcccatcctggtattctggtagtcaaagttgtgctatgcttctgtgggggaataacttacagtggatcatgtttttgttaaatttttagcattcaaatgctaattttaaatttagaactttgtacagttaagagactaattaagttttatatatacaactcataaatttatttgagggggatcaagttatctgtcactcaaaccaaaaaccaataaatacttatgccttatactcataacgaaatccattagtcctatttgcaacccaacctaagttgtaaaatgtactaggctcatggaatgcaaatatctaaaatgatttttctttttcaaagtttacaagtggaaagtttttaagggtctagttagacttcaatttatgaatatccttttcttctaaatttttgatgaaataagttaacaacgttatcaatttttgaattaatgataacataaaaaattacattattattaatcataaactaacatatataataaaattgttaatttttataagattatttttaaagtgatattaaggtaattttaattagtttccacgtgacattataaaaatatttacattaacaatgtataaaaaaatcaaacccattaactaataatttcttttttaaataaaaggttgaattatgaaaaaagaaatataaaaataggtaacgccaacggtcaaaatgctcttaatatgtccactgtccattgtcgtagacttgtttgcagtattgcagttgcagcagcatctggacacatttgttacaaaccctcagaatggcactgaaccaacctagacattagataggtcaaagtatgcgaacatgcacaaaacattgcaaaagcagatcccggcttaaaggtgttcccagactactaaaaattatagtggaaataacacagtttcactttcagtctgcattttctgagctctccgaaaaggagtttaacaatcgatgttaactctaactccagaactagatctcgttacaacgaaattggaagcatggacagtgatcggatgaacagaatgtccgagtaaggagaactagccaagcttctgaagccttttctattttagttgggaaagaacggcgaagtccatccgaacctccaatgaagaataagaggagagcaaagcgccaatggtgcgcgaagcgcatgcgaaacgggcgcagagaaaaatcagtgtgttagaaactacaaaaaaaaaaattaatgcctaaaaaagaagacaacaaaatttgattgcatgtaacaaaatgaccctttgtttgttattccttaaaaattctttcatcttttaagtgtaaacagtaaaaggatttaatttaattgattaaacagttattataaattctttgattcaaatggataaaaaaaatgttttgagtttttcctaaaaaagacaaatgaaaagacattggcagcttctatccatcaacatcgtcctgcattctgattcgcaaggttgtctgttatcagaatcataggcagcagcatcattactgaggaagaaactaggaagcaaaacattgccacttagctatattgcaaagaaaattttcgttgttttaattttgcagcaaaaatcttcgtatttacaattatatttaaatagatggatgaaagcaaacaagataacataaggatcagtgttaaaaagtaaaactgttcaccggtccaaacaggtaggtactcaattctcttgaggcccacacatgagaataggagcaacgacatggtaccttctttattgaaaaagaacagcgtcttaacaaaatatgcctaaggttaaaataatattttaaaaagataaagtttagaaaagaactaactttttttataagcaagaactagaaagaatgtctttggacaaaattacacaatgatatgtcacattcttttcagaatttattcaaccgcacgtcgagcgaaagttatttacaaaaaactatatatatgacgtgcaagtatatgatactgcatgatcaaaaaatttattggttcttgatggcaaggcaaatatttatctggccgtaaagcgagatgatcggctacttggatttgtgcgattacccctaaatatggcttccagattctggaagcatccaggagtcctaacctgtgtatcataacaagaaaatattacaccttaggaaacaaagaatcacacagtctcgttgtaaaataactatatcgcacaatatccacacctttgagggcattctactggtgagatggattaaaaacagtcaatctagtaaaattacgttggtataaaaattattaatatccatccaatgatacagaaaaagtctttgaatctgaaattcctcacattctgttaagttttagtattaaaaattactgcgaagttatatactaccataactaggtctaaaaattgatgaaagaaatattcacatgaaaaagggataccttccagcccctcttttgagcaagatggtagtatatgtcttccaatctcccaattatttgcctaaatgttggccttctgtacggtttttcatcccagcattcctcaattaacctatggacaaatcaaatttcctgaatgtgaaaaacttattaatttaatttcctacttgtggtaggttttgaaactaaacattcaaatctgctgccaattaaatgtatttaaaaccctcactgttttagcccataagcataaagctttggtgaagctctaaatggtggacgctcattttcaacatatgctttaggaacttcattttctggctttgcataaaacggtggacaaccttcaatcatctagaggaacagaaaatcatgcaagttcctgtcaatattttgctgggcatctctacaaataacaacctacagttggttgtcaatctgtatattctatatacaaaattgcccatcatccacaaataaaataatcatattttgaactttcagaaaatgaacattttgtcttcacataaaaaaaaaagtacgagaacatattggtaccacaacaaactgttgggcatggcatcttacttaaatgaccatgaatatacacatatatacaaacatttatattttttgggtcaatatgtggagaactcaaaatctctagaactctacctgtccattagatcaaccttaaaatatgcaataaagcattgtatatcacaattatatataatatacatatctttaggattatctgatggacaaagcaggcagagctcacaagtcacgaatgcttgagctgtccatagactcctatacgtatttacttgacaagtgaaagaggtcctatgcgtaaaagacaccatcaaacatctaaaattcaatatgacgtaacaatgctgaaggaatttgaatgccaaaagcaacataggatacacagcaacagatgatacacctctcaatgcattccttttcctgaacttccaattttttaactaacatgaacaacacagatgtatgtatgtaggggatatgactttatgttcaggattatgtaaatgcttttaattgctcaaaatataactgaaaaagcacagacaacataaagtaaattcccttcttttttaagaaagcaaatgcaattaacagccttttaaaagttttatgtgatgagataaacagaaattacaagggacggagagtattgaattagcatgtattaattgctcaataccactataatattccacaagcatcaattcatcaaacagattttatatttattaattaatttgccagtttagggtttaaaagtcttgtttcaagaccagagaagatacaaccattcacataataagggtaaataattaacttggaagtcatttaaaagctctaaaataaggaaaatcagcatgcatccaaagatgagcaataatgatttacctcctgtaatatcagagcaaatgaaaatacatccacttttgtgtcgtattcctcatttctatatacctctggagcaacataacgccctgttacagatttgaataaattcatcaatacaaactttgaaatcagaaccaattacaataggattaaaataaaaccagttatacatataagagatggccatatttataaatcaattgataaattcaaattagtaaaattgagcaccagctgacaactgtctatggtagtcactgagtagacagcatttcttttttccttgcagaatatgcaacactgtgcacattacggccctcatgaaataagagttcacaatattgcttttatgcagaccgacatgattgaccacgaatattacaaggttccagtaaagatgaaaacttgcattatctatccagggctccactaaagaagaaaacttacatgatgtatccaggcttgccacgggtttgtcttctttgaccgttttagcaactttaagcaacttgctaactccaaagtctgcaactttcagatgcccagaatcatcccgcagtatatttctgttgtcttactcatgtacaatgaagaaactttaaacagttctaaccattcaataatgaattaaaaatgcatgcttctactgaaaagtccacgatacttcatacacatgctggaagaataataaaatcaacaagacaggacaggagaacataaaacatacgaaggctcaagatctctgtgtataatggcttctggtttatgttcatgcaaatagttcatacccctgcaaaatatacatattttggaattattacaaatatccaaatgaaaatttttaatataggagaaaatcttcattaattattcaacttttcaacaaatgaaataatcaggagagcttgcttccttgcaaaccaactgaaagctagtgatgcatccataatatgaaagctcttgactgacctagcaatatcaagtgcaaactttacagctgttactggttttaatgcacctttctgcttcaagtaggcacggagatccccctaaagagatgataatccattccaaattgtcagacattacaatagtgaaaaatacaaggtatagttaaccacgttatacacacaaatagaggagatatcttcctaattatatgcacttatttttttcaccatttcactaacataaagtgaaatcccaataaagataaatggaagttctaattcagcacttatcaatactagactaaaatggttatctcttatcattacttaaaatccttcaatttagatatttataacttctagacagaacaggaacataattgtctgaccggattcagttcctctaaagtgagaaagtgagaaagtaagaatctaccaatcatcaatttgaattaaagcattttgtatacataaccgactttatatcaattgtagataatcccacactttttcacttagagggccaaatcctgtctggcctattcagaattgcaaataactcctgacacttcaacaattagtatcagtcccagtataacttttatcatattaagttcttaagtattaattttttgtgcctccaacataatgctagatttcaagtagtcctattgaacctacgctagtcactttctttccaaagactatatccaaaatgataaatttctgaccacatattttattcagctcactattatctatgatagccattagccaactaaccaatatgatttgttcataaacaccacgggcaaaataacttatcataaaaaatcttccatataaccagtgtaggaccaagactaacctggggtagatattctgtgacaatcatcattggtgtgctttgtgttacagcacccaaaaactggactacatttggatgccttattttctcaagtaatgtaagctcatcatgaaatgcctttctgataaacagacaccaacaaacaaaatccactatgagaacaaaaattgagaactgaatatccaattgagtaattgacatgaatgaaacaacagattgcataggtagaccaacccacactttatcatcatcagtgaacaattcctccccaagtgtcttgacagcaacctggattccacgccataatgcaatcctgaaagttccctaatattcaatataaaatatgaaacaaaaaataaatcagggtaaattgacttgagagaatatgtcaaaacaaggtaaaaggagaaatcaagttacaaaacaattgaccatacagagaaaggaaacttgaaagcttacctttgttatgcaaacactattagtaaaatcaagttcagaaggatcaatctcatactcaggtacttcacgagcattctgcacatgcatgggagccatctacaataaaaagtcctcagttgcaacttgatgtcataaacaacctatactaaaaggagtttaatatctatgcactgtcagtgtaaaaaaatacactgcagtgtaaaagcaatttaaaaaaaatacttttttaagaaacaaatatgatttgtaaaaaatacttttttaagaagcaaataggatttgtaaaaaatacttttttaaacaaaaaacagaaaactagtactacttttttaagggaaaaaaacagttagacaaacacatcaaaagagcagaaaacaatttattttattcaaaaaagtgttttctctttaaataacgtatttattgtaaatcaaacaacctaccatacacaacaatatggtattacgaattgtgattgaatgaaatataaaaaatttgtacagtgtcagtttatatactactttctcttctaaaagcttgaactataaggcgaactggaattatatgtatgctcagacagcgtaaaaaaaattatatttccattcatgataaatatgtttgactttttataataactacttaaaaaagtcatacaaaaagtaatatctgattaatagacaacgtaaaaaattccacaccaaaagtgcacatctatctattaatctctcgaaatgaataacatctttatttttagaggaaatgaataagatctaagaagaagagacataccgggggtcttgcaccgtgtttctccaaaagcttgacaacttggtggttcttgtagtacatggcatcaactagaggctgttaaacaatccaatccagaaattagggtcagcgagtgtagaataagagacagcgagaagagcgaaagagagtgaaattacggtgctgccccagcggtcttgtggatcgacgtgggcgcctcgtcggagcagcaagtcgacgacgtcggtgcggccctggcaggcggcgacgtggagcgcggtgcggccgtcaatgtcggtgaaattgacgtcactcccggcgtccaagagctccttaatcccgtccgagtcaccttcgttgacaagatacatcaaacggaccgccgggtccagcgactccgacgagtcgccgtcaccggcgcgctccggcgcgagggaggattggcggccgagcgagaagcgagggtggagcttcttggtttccattgcggcggcgagggttttcggtgcgagagagaatgtggattgaattgaattggattggattgaagaagggatgagaataagagagtgtgtgaatgaacattaatgtgtatgtaatgattttttggttcaattgataaaggatgggatcgggttctgtgttgtgtcagagagtgactagttcaaatctttgacgtcaccgcctttcttactacacactccatcgaggaaggaacaacgtcggttttcggtaatgcctctctagctaacctaactaagtttttcttttttggacaactatattttctaatagtataatttaagataaaagcttagatggttaagttgactttcttacagattttttttctgatatttttccaatgttgactttctaattaatttttttaggagattctaattaaattaattgcaacgttaatgacttttttttaagatgaacgttgttaaaactgaaccttcaccgtagaacacggtggatatataataaaaaatgagaaaataattatacatattataaaatattttatacaatcattaaatcataatttattatataaaatatttttttttaattatactatcttataaactagtcaaaataacttataaactactaaatgatcttactaactactcataaatggccagtgacacttaaaagctctacatccttttataagaatataatattacagttatatgataataaaatttaaggattggtttggtaagatgaaagagaataaaataaaagataatttgaaaataaatatttaaattaaaataatgtaatgaaggtatcatacttttttatatttttgaattttttttttcacttctcaccaattttttcacaatcaaactcattctttatttttttttttcactaaatatttttctaaatttatcaattgaattgaaaatggttatttaaaaaattattgaattatgcttataaattattgaatttttcatagtgttgtattttgctttcttttcatatattgcgctttagttattggttggatccatttaataactttatataaattatcaatttttcatctctttaatattattttttagggtgatgtgaatagacatatttttttataccttttatgactttctttagtataatttgggtggaagagttaaagaagtgttttatatttagattttttttaacatcgctagatttatgaatttttaaatggagagatgtatataaaaaaatgggacataaaatacactatttaaccaaattttaaaattctaaatatttaaaaacatgaacccgttttctacaatcgggtcaaaacaggagctccgacaggttcgcagccatggatctacctagctgaagggttcaggttcaggttcagttcaggaaaagagacgaagattttgagcgcggaaccattgccattgccgtggccatggctttcaaccatcttcgaaacctcaatcgcatctccatccaccgcattctccaccatcgttttcagcctctccttaacgctactactaggttcttcgccgatgctgcttcttcaatgcctcaaccgcagcccaaacaacaaccttcgcctccatcatcatccttgaagcacaatgagctcgccaagttcgccgccatcgccgatacctggtcagctttcgaaacgaaagagagaatctgttcaatgaatttattgttataaacaccacaattaaaattaaattgcacattttttttcatggggtgaatttgttgaagttgttgctactgtgtgtgtgtgtgtgtgtgtgtgtgtgtgtgtgtgtgtgtgtgtgtgtgtgtgtgtgtgtgtgttagtttgagaatatggatgacatgtatttgccctttccttgatgtgaataggtgggattctgaaggcccctttaagccattgcatgtgatgaatccaacaagacttgctttcatccgttctgcactttgtcgacatttcaagtaagcctgctctttcatttagtccttgtacctccattcttgagtctggggtgtttattcttgaaactactttggtagaatgtgcaatgctttgtgctatgttataatttgattcctttttctttttttgcatggaattagtgggtttaaaatataatctggttgtactgtgtcagattccaagccactgttatttatgcagtcttattaaaccaatagcacttagtgtttgctacacatacatggtaggaatttggtttaataccccttgaattaaatataatcgtataaggatgtgtaagaagatgattctaatgaagtatctgttaataaaaagtgttaactgaattattttttgacacaaaccaaatgaagaaacaagaagaaaaacaataggaaaaacggtattacggttgacaatgggtttatatttttattttgtctctaacggggttctattcaaataataattagatttcacccttgtctcaggaaggacccttatagtgccaaaccccttgaaggaattaaaattgttgatgtaggttgtggaggtggaattctttctgaggtatatcttttcttcttttttcctgtgatttttggaaaagaccttttcctttttatcttctggcaatctggcctatgataaacctatagtttggtataataagttcagagatgactatatttgttgactatattacttgttatcataatcctcatgcgaatctgtagcattatgatggattcagaggtgactatatttgttaggttgaatacttgaattgtggaaatctgaattatttctttggtgcatattggcctccctctcacttatagagtattaagtttgttattgtttttttattgcaaatttgtgctcttttttgttgttattttataatttatagccatgcttctctttttgttcttcagccactagctcgattgggagctactgtgatgggtgttgatgctgtagagaagaatatcaagattgctcaacttcatgctgtatgcttattatatttgaatatttgaaatttgtcagtcttgtcctacaaattgattagattgctgtattctgtatattggaggaagcagttgccaacattagtaaattaaatcttcactatttgccggacaacttattatctcctgtcaacagggtttggatccagcaacttcatctattgagttctgttgcacgacagctggtacatttacaaatcttgaagcattcttttacacttttgttttacatccatttttgacgtgcatgctttaagtctgttaacatttggacactactgctgaaatgccctacttatccaaatgaatgctaatacagtttagttcacaatcttgataagaagcacaagtctgactggcataatttccttttatctaattttctgagtggtttttccatggattcagacctttgctggatagtttagagtttcaaaagttacaagattatgatgcattggcataaaaaacttaaatattttcacttcctgttggcttgtgatttcttgtttttcttacagcttgtagttaataaccattttatgttatttatcttaacttagagtcttagaatgtatctttggctgtagaaaagtcaattttttttgctatgatcttatgtcttcccactagggtcttacattgaagaaagtttttactctatcccttaatgtttctcattatacaaggtatcatacttggacatgctaaatcgctcaagtgggtgaataagttttaagctaaaagagttgttacattacatatacttaaaaaattgaacgctcttggtacatcagtacatgcatgatggcttcaataatcattgtaaaagtcaaagttgcttgcattcatctagttcgtttcgaattgtccttatgtttttgggtattatgcactgcattttacaactcaccaacaattttgactgatcagagaagctagttgaagaaggaagaacgtttgacgcagttatggccttggaggtactttctctttcgtgccccttacctctttctggttgtgtgcttgcagattggagtgcataaatgggtgttgggatacaaaaaaaaaaaaaaaaatatgacataacttgtagcgtaaaatctttgatagtagtacagtactcagtggagttgaaggacacattttgccttgcattggttcatttgctttgaatttttttgcaggtgattgagcacgtggcagatcctgcagagttctgcaaatctctgtcagcactaacagttccagatggagccactgtgatatccacaatcaatcgatccatgagagcctacgcaactgccattgttgctgcagaatacattctccactgggtattcattcttctcaactcaactccattcaacacttattttttccatcctacattcaatcgacacattatatatatattgaactccacagcttccgagaggcacacatcaatggtccagttttctcactccagaggaacttgtcctcatcctccaacgtgccggtatcaatgtacatacgcaaaacgcattcataatttcaattgttagggattaatcatcgcattcacgtgacactttattctggttgcattgcacacacaggtggaggagatggccggattcgtctataacccggtgacaggacggtggtctttatcagatgatatcaacgtaaatttcattgtgttcggtaccaaataaaacaacaccaaatagcatagatagataaataaataagatccatgttactgttattactataattatcattagtattgaatattgaaatttgttttgaatgctgaataataaacattaaagttataacagaaagaaataaaggttaagtgtggaatcagggagaggagggggcaaagtttcctgagggtgatgattgagtcaatggttgaccgtgccatatctgaaactccggtaccggacataagaatcaaggaaccaggggtgagcaaaatgggaacggacagggaaatggagaggggagtgaagtgcatgacgcagtcagactcaaaggagaggatggtgatgccgtcgtggaagcagagaaggtccaagaatacattacttgcctttatatccctatgtgtgattttttattctggactcttaatgaagataagaaggtccaagaatacattacttgcctttatatccctatgtgtgattttttttttctggactcttaatgaagataagccaaagctttagctataccaagacaaattttcttccttgttggccatactagttttgttgcgtttgggtccttccctgtatttgattgggagaaggacaatcagttagttggttatatcaaatttttaattcaaatggcaagtatggctaaagtttactcatcatgaagcttaccaaaaagaatgcgagatagacaattgttttccatgtactcatatatcactatatcagtattagctggtttccctccacacaacatccacaaagcttaacaagattgggatgttgaagtccagatatcagtcccatctcattcacaaactcacgatttccttgtttagattttgaagaaagctgctttactgctatcattgtaccatctgatagtaggccctgcatcttgaacaaggtgtatttttttttcttgcattagaattacacagttacacatattcaaactactgaagtgctgattggtctaacaaatctccaccattacactttaaccatcatgtacgtggataatttttctctttcattaacccacgaaggttatatatgcttgctaatgagtacaaaatacattacagaaattatgattaaattgtaagcgttaaattagaattgaatggagatatagagaccatgaagtgtgtcttctatttcaaatccagtaacaaacaaattaaccataagatggaataggtaaccaagaatggaagatcaaaataccttgtatacacaaccaaagccaccttcgccaactttattcactgcatcaaattttttggttgctgctttgatttgtcttagtgtaaataaccccgtctgcagatctttgccgagctctgaaaataaaaaaacaaaatattggaaatttggattcaacaagaaagttaataactttctctacaatatctgccacatggttcatttcatttctatctagcatataaatatatagggcaggcaagtatactctcgtatgttctcttaataagccttgactttgatgaaatggagaaatatcatcaattacaaatcttatatagaagtaacttgttgcacttcagttttatgacatttgaacaaagtttgtagaaatatttatttaaacaaattgtggaagaagctcaggcaaatactgctggatacagaaaagatgatgtgttggaaacaaatggaaatatttgttctaactaaaagaattggaagaacttggtggcatattccataccattatacactggatctttgcctcctaaccatcccatcctgctcatgagaaccatcaccagaagaacaaccactaaaacaccagctactatgccgatggccagtatatatgacataaataatttgaacttggcagcttccgagaggcacacatcaatggttcggttttctcactccagaagaactcgtcctcatcctacaacgcgccagtatcaatgtacgtaataaatcataaataatttgatttgctcggtattaatcgtcacattcacatgacactttcatttggttgcattgcacacaaattcgcccataaaatatgagttatgcatagcacgatggttttatcagacgatatcagctgaatttcatcgcgttcggtaccaaatcaaacaacgccgaataacagagatagatagataagatacgtgttactgttattactacaattattaatgaaatttgtttagtgaatgctgaataatagaacattgaaattattataacagaaagaaagggttgagtgtggaatcagggagaggaggggcaaagtttcctgagggtgatagaggtgcgtttggattgagtcaatggttgaccgtgccatatctgaaacaccggtgcgcgattaatttcgtgtttccaacggtagcgtgcttctccggacatgagaatcaaggaaccaggggggagcaaaacgggaacggaaagggaaccagagaggggagtgaagtgcatgacgcaggaagattctaaagagaggatggcgatgccgtcgtcgaagcggaggaggtcgacgtgggcgcagattccttcgccgggctggtagacgttggcgatcatctggtcgaagagaggttctctgtggaggaggtggagggggaagggggcctgggactgggactgggcttgggcttggacggagcggcgtatggagtgggccagaggggtggcccaagaagggaggtgttgtaggccgaagcgcatggcctggttgatggaaggggaggggaaccaattggcggcttggatggaggagagtatgtgagactggcggcgtggagagaggaagtgacggcacagccatagaccattcacttctgtgatggcctcccactcgctctcgctctcgctctcgctgtagccatcagaatcagattcttctgatgatgacgacccgaacacttgctccaacactgctttctcctcctccgccaccctcatcttcctttcactttctcttcccgcactcttcaattcatgccacgcgcaacttacctagctgcgccattcatactttataagcttaattaaaaactgataaatgaggttttatatttttttaagatgaacatatatttttcagatcattagatctaagacaattcaacccataattttaacgctaacaaataaatataagactaactattctttataaatttagtttatcctatacttttactcttgttaaacaatgttacaagttaattaaataaactgtaaattaacttttaaatatcatgtcaattacaacgaattttcccactcttacttgtacgagatgctgcaataatggtggtatgccacctaaacctaaaaaatggaaacccttacttgtagttgctgttattacgctggaacaactcaaataacagtatactcatattttttgttatctatttttttatttatttagaaaccatttactctcaatcatcaatataataacttattttaatttcattcattcaatgcatgaagaaatggtttgttctcaaaatttgcaattgaagttacaccaccaacagctcctaatgtcacaacatttgtaccacttacacatgcacttagaccacttcctatccgatctgcaaatactcatatgcttagagtttcatttccaagttgaagtatctccaagagtgccaaaatcaagcttgatgagcttcatcctataccacatatctaactacctcaactcccttcaaaaggattcaacgtgttttaaacatattttggatatattttgaaaagttaggcattaacgtgttttagatgtattttggatatatttttggaaatttctattatgacattgacattgtggcatgctttggttgaagttttactactacttgagaacttcgatattttatgtttaatgaataacaattttatattttataaatgctcgatttagcttcgtaaattacgtgtatgttatcttattttatggatgattatattactaagtgtatgttataactttttttgtggactagtttatcagttaataatatttgttagggattaatttgttgttagtaagtctatatgtttttgtgaaaaaattttagaatgaaattttacttatgtctgttgtttcaaaaatcaatattttaaaaaaatgtgataatttagtccaaaataatatgaaaaatcattatgcacacatgttcttgttacgtgaacgagtgagtcatgtagactatctccaataacgaagatgaaataattttaacgattagaccagattattgtaacattttacatttgtgaactaaataaatgattttcataatataaaagtaaaattgtcaacaaatatatattttagggactaaattgagcatataccataccattaatagttcatggttaattaggtcctctacgaagattaataaatgataactactccgcgcttgttacatactgtaaaaaattgcaatcacaagtttcttaagttttttaatatttttctcggaagtctaaactcgtagacaagattatccgttattattagttaagagcgtatacgtctcttttagcttcagaattcctccaactccaaatcctccgtttttctctctgaattccaatagttgttgtgttctgaagagagaacatgtcaagcaattcagatgcagcagcagcgacgctgcatgctcgtggccgtttggccatgctcgctgctcacctcctcccctctgaactcactgatcacgacgccctccgccctctccctctctccgctcagttgccgccgacgaacctccacggaaatttgaccgtcgtcgacgacagaaccggcaagaagtaccagcttcaggtctccaaagaaggcactgtcaaagcttctgacctcaagaaggtaaatttcctcctcatccatgaaattttcaatttcgatctttgctttccaaggaatttccaatatttcaaactgggtctccaccaattctgctcctttcatctttgttgaattgtttgcaaagtgggcttttttcctattcctagttgcatggtgaaatcttagctgggatggtttgtgattatagtatgactgtttgtgcttacttaacattgagtttagtttttatgcatgctcagtgtaaatttacacttccaaccaataagaaaccatcttagcataaaagtcaacaaacttaacatacaagtagtctgtgattgaatgaaagtaatatatacactatttactcttattagtttagttattgttatgttatgggtttttttggatttgcagatatcgactgggaagaatgacaagggactcaagctttatgatcctggctatttgaacacggctcctgttcgatcatcaattagttatattgatggcgatgaggggattcttagatatagaggctaccctattgaggagttggcagagaaaagcactttcacggaagtgtcctatctcataagtgagtgttctgtttcactgcaaatgtgtgtatgaggcttctgtggcgcttgtgtatgagtagataaaacattttgactgaggattcacttaaacagattttatgttattgaagacacttgaattttgggcttagttctgcttcttgttaattatgtgcttcgatatgtatgtagcatgaattcttctgaaatttattaacgtgcatctttttttctgttttcaagtgtatggaagtttgccttctgaaagtcagttagcagaatgggagtttgctatatctcagcattcggctgttccacaaggagttttggtgagattttatgctttatctaaaccaactcttattgtgtttttatgttctccaaatcccatccgctaaatgataacttttttttgtttcagtcagtgacagcttttagatttgtaaaatatgaacaacttccactaattgttttacttcttgaaatttagtatgccagtggtattttatattgttaaagaaatctagtagctcttgaagtgatcatataaaataaaatagaaagattatgttgtttgtttctttcaatggagtttgggattattaatctaactaagtagtggtatcatcttacgtttattttgtaggatatcatacaatctatgccccatgatgcacatcccatgggtgtgcttgttaatgccatgagtgctctttctgtttttcaccctgatgcaaatcccgctctcagagtaagtaacaaaaactgctgtcaagtcattttttgttaataagttgaatttcaatacaaatttgtacattgtctatgcttcgagtccaaaggactctggagtgaatgagggggcatattagagatttgagatactgagatataataaaactaatcttgggattccttttggatgctactttttcctgtgggttactacaatgtacttgtgaatgatactctttctctaattaggtttcaacattgtttattgttattgctctgctatattcctttatccagatttgatcctttttcattattttttttttataattaatgcagggtcttgatatttatgacttaaagcaaataagagacaaacagataacacgagttattggaaaggtgtgcttatttggttcgttcttctcctttcactgttctatctctgaaaacatgcaaattatttagttatttgaatgattctagccctggttttactgattgtatcttgtgggattttgtccactatcctcgcaaccctatgattatttgttatgtgtcctactgctttattgccatatcatattttcacccctttttatttactgcagataacaacaattgctgctgcagtttatcttagaatggcaggaaggccacctgtgcttccatccaaccacctttcttacacagagaacttcctatacatgctagattctttgtatgtatggtatttttgtgcttgatcgttaatttgaattaagacaaccttgcttttttatatttaactttgctttatagactaatggtagtttgagttttgctcatatataacaaatccatttttgtttttaaaaagaggtataattcaatcttaagtgatagaatggtagccacatactagctgttttttagagttttaactattaacacaatctccactgtgcatactttcagcggtaatcggtcatataaacccaatcctaggctaactcgtgcgctggacattatcttcatcctgcacgcagaacatgaaatgaattgttctacatctgctgtccgacaccttgcatcaaggtagacatcttactgcaatactacttaagcaatataaagcaaatataaaaccgtcatattgctaaactatatatcttattcttatttcagtggcgttgatgtatacactgctattgccggggctgttggagctctatatggaccacttcatggtggagctaatgaggtagctataagtagttaatgaagcagtcatgatcttttatgtattgctaggttgaacgtagtgaataaacacaaacactatactgttatttaatatgggaacatgttaatgtgaccttcaattctgcaggctgtcctcaaaatgctgagtgaaattggaactgttcagaacattccagagttcattgaaggtgtcaaagccaggtggctattacagtattactttcttctgttatctattttttactctttccttagttgttagcattgcttataccctgaaaggatagcatgatacctgctcttttcagcaagcagagaaaatgatagttttagttgatatttttgtcctgcatttttcctccaggaaacgcaagctctctggttttggacatcgagtgtacaaaaactatgatcccagggcaaaggtcttacgaaaactggcagaggaagtgttttccattgtgggccgggatcctcttattgaggtgtttatccattccgtatttcctttgtctattgtctgttatatattccttgatcttggtatgctggtcacgaggcctatgatcagggctgtgaatacagagaaaaactactacatttaaaaaatttcctattgttttatttaaatgtatttttgtatttttaattttgattacagaatagtatgcttactgtgtatattgtatatgtttgtgcatacaagtttggcaccattgtgtctacatgcataatcattagatgtcttgtttggtttggaaaaaaaatagcagatcaagtcaaatgaagatcttaagacattaaaaatctctagcaacacctttcatttttcaaatttaaggtattactagggtttctggcactttttttttcctgaccaggaaagtacctatgtaatttatgtagattggtcagtatatggacttcaaaagttctaacttctgtatgtaattatttgatcgttcaggtggcagttgccttggagaaggttgcactatctgatgaatatttcatcaagaggaagctatatccaaatgttgacttctactctggattaatttataggtaatccattatttcacccagttattctaacttgaaggataaaaatatgccccctctcccccccccccccccccccacccaacaaaagaataccatacaaggcttgaactaatagttttatgcaatcagggccatgggatttccaccagagtatttcactgttttatttgctatccctcgaatggctgggtacttggctcattggagagagtccttggatgatcctgatacaaagattttgagacctcaacaggttaatttctttctttaaatcatttttcttgttatgattttcttgcatattaaaaatatatcatgcttactgtattgtgctaatgtagctgtacttgttgtgtatcacttgttttactggaaaatggttttcaagttgtatcatggctgcattatatttcttaacagtggtactaggcaatatttgcgtaatgcattagaactgtatggtaaacttttagagccacctataactaccacactcttcaattctacctgaagatatacaacatgataagaaacttgggagaaccacatgataaaaattagcagttgtagttggagacagggccttataactataccagaatcccatacttccaatgtgtgattcaagtcccttatcttgcaattgaatccaaacatctcatcacactttgcagcactttgataatttgattagttctaggtgaacactgcaatgttggcatcacgatctccagtgctcgtttgcagttgagaacatggtgaaaccctctgataccaatcgataagaagtttgagagaatcacaccacaaaagttagtcattgaaattggagagtaaaagaccttataaatcctacactagaactagaaccccatatttccaatgtaggacttaagacccaataccttgcaattggatcctaacaacatgtgatgcctttcttatttcaatctcttgcctagtttcatcatatctattttatgcttcaggtttacgttggggaatggttacggcattatacaccagtcaatgtcaggactacatcaagtgatgctgacaagcttggtgaggtggccatatcaaatgcctcaaagcggcggcttgccggatccggggtatagcttacaggctcaatttagttatatgagcaagatgaccaaaaggtgatatataattctcacgaacgtaaataattctttgttgatggctttttataatccaaagttaactttgctatgatcaggatgacatgtctgcataaataatgctactggtgtcacatccatcacctaccagaagaacgatgctggtgtgatttgttaagcctttatgtgcaagtcacgtttcagtacttctactttcaaattatttgttaattgttacaagggaataataaatagataagcatagtttacatatcccatgggagcagtaaaatgtacaattgattagcaaaatgtttgtgttaaagaaataagagagttttctgtgtaccagtacaaattatttcttccccctcccccctatagttgggtgcactaataaagaaaatatgctgaaattcaattagccttttttttcctctcaatatttcatttggactacgcggctaataatctatttttttttaaaatattttattaaaaacattttaacaatatatcaaaagaaatgttagtaatatattcgttaacatactttattgaacacttttttatcattaattaatatttatttaaaatcataaaattttgtacgtctcactttatttaatgttttacacatgattttgcagctttagataaatttaagcaatagagactttgttagcaatcctcacatgtaaacgtaaattataactaatcttttttttaaggcaaaaataagattactgaataaccctaaattaaggcaccccattgtgatgggaatagttccataaccatagctccaaactatgattaggaattacaaagtatatatggattttatgaatatcgcaaaaatatttgcaagcgggacaaataattacccataataataggactaagtaccggacaactggacaagtatatgcacaaatttacacggatattctgtgtgtgtatgtatatatatatatatatatatatatataatattttgtgaaaaataattatatttttatgataaaactctaagtctttaatctctaaccatatcactattagagagtgaaaaatactaaacctttaattagagtttttgtttagcgattaaaatattagctttagcaatcactatgttgtatgttattttttattttttttatttatgacttgagtttggacgtattaatgttatgtttgcttgttttaattaaattatttttatcaatttattattattaaccttatacataagtaatgtgcgagtcataggtgcgggtatgagtatataggtatcaaacgtgtacgaaaataagattaaaattattacctgaaagggtatgggaccaggtacgggtattatttttaaatgcgagtatagaaacatatactatagtaccttacctagacctacctattgtcattcctaattatgacaccccaaattttgtgcgaactagcaacaagataaaactctttacattgttattaattttaattttgtttttctcttttcttgcattgaatacaccacgagttttgtattaaatatgtggcattaagaaactaatttcagttgtctgatccatctgaattaacggttacaggatgatagctcttttctgtttcaacatgtgagccagaggaatcagtataaatactaggtattgatatgctatgtgttccgcttggattctgccagaagtgacttcttatactcttatgtttggaacttgaactaatagctgaatatcccggatccgaaagtagatcttgaatatcagtccaaccttcaagcatgctcacaacttgggacattgttggtctaagtgtaggagatgcattagtacataagagagccacatttagcaccaccatggcctcctcagttgaatattctgaacccaaatttggatcaatcagctccagaagactccctctctcttgcaaaacatatgcctaatgaaactcaaattttagaccaaattgatactaaaactctaaaaaaagaattacaatatatatatatatatatatatatgagcaattctagacaaataactacacgttaagattaaaagtgatttaacatttgccgataaaaaactaaaaactaacatttgatgttaaaaaaaagtgatttaatgattacatgatcactgaaaaatgacaactttgtgatttaatcttttcaaaaaatccctctcacttgatatgcccgtatatgcatgtgtgtatgtacgaactagtaaaatcaataatccataggtcttggtaatttagtatctattgtttgtttgagcctgttatattatgcattaagataaattctaattacccaatcaagaagataaacaaaatcctcgtttggcctgaaatttgtattgctctttccactgacagtttccagtgcaaccacaccaaagctataaatatctgctttgtcagttaaatagccacgcattgcatactcaggagccatgtaaccactgcaaaatgaaaaaaaaaaaagcatttagcattgttaaaataatggatttgactaagagtatactttacagaataaagtacatcaataaccatgggttaaatatttaatgcttgaaattataactaacttcatagtatgatacacatgcatttgatttttaccagaatctccactattgattaaaaatgggtatttttaccatggtttgatatgaaaacaagagaaatagtagcaaaatatgaacttacattgttcctgcaactcgagtgctaatgtgggttttgtcatcttcaataagttttgccaagccaaaatctgagactttagcattaaaatccttgtcgagcaatacattacttgccttaatatccctatgtatgatttttattctggactcttcatgaagataagccaaagctttagctataccaagacaaattttcttccttgttggccaatctagttttgttttgtttggatccctccctgtatgtgattgggagaaggacaatcagttagttagttatatcaaatgtttgattcaaatggcaagtatggctaaagtttattcatcaagaagcttaccaaaaagaatgcgagatagacaattgttttccatgtactcatatatcagtattagctggttgccctccacacaacatccataaagcttaacaagattgggatgctgaagtccagatatcagtcccatctcattcacaaactcacgatttccttgtttagattttgaagaaagctgctttactgctattattgtaccatctgatagtaggccctgcatcatgaacaaggtgtattttttttcttgcattagcattacacaggtacacatattcaaactactgaagtgctgattgatctaacaaatctccattacactttaaccatcatgtacgtggataatttttctctttcattaacccacgaaggttatacatgcttgctaatgagtacaaaatacattacagaaattatgattaaattgtaagcgttaaattagaattgaatggagatatagagaccatgaagtgtgtcttctatttcaaatcaagtaacaaataaattaaccataagatggaataggtaaccaagaatggaagataaaagtaccttgtatacacaaccaaagccaccttcgccaattttattcactgcatcaaagtttttggttgctgctttgatttgtcttagtgtaaataatcccgtctgcagatctatgcccctgagctctgaaaataaaaacaaaatattggtaatttggattcaacaagaaagtttataactttctctacaatatctgtcacatagttcatttcatttctatctagcatattaatacatagggcaggcaagtatactctcgtatgttctcttaaagccttgactttggtgaaatggagaaatatcatcaattacaaatcttatatagaagtaaattgttgcacttcagttttatgacatttgaataaagtttgtagaaatatttatttaaacaaattctggaataagctcaggcaaatactgctggatacagaaaagatgttgtgttggaaacaaatggaaatatttgttctaactaaaagaattggaagaacttggtggcatattccatacctttatacactggatctttgcctcctaaccatcccatcctcctcatgagaaccagcaccagaagaacaaccactaaaacaccagctactatgccgatggccagtatgacataagttcttttgccatcccctgatggaggtttaaaatctgtgcaagggaaaaatatttacttttagcttttgcataaatgaagaacaaaactgatagaactggatcagataaaaggaaagaatgatgaattttattgataacagaactctagtggaggtcttgtagaggtagacattaatggtaatctttcccttttcctacaatttttaaattcataatggattatggtttcaactgcagtcttatcaagtcatataaagcactaactctaagatgcatgatatgtgacttactagggtttactgaaatagcagatactagaggtccataaactcctcttgtgggtatgccagtggttccttttccagcccagtagaagtgaatcttcaaagtatgttgggtgacagaagcattaaatgtcttctcaattgacttgccagtaccaccagcttctcttcggatatcaaagtctttcagcactaaattccccttaattttaggacataataatatattccatatacatcaatgcacaactcagtgcaaatcaattatttagcatcatttgcaaatcaagcaagtaattgttacctggatatagacgtcaaatactcgccttccaagactgttaagggacctatcattgatgaaaataatctctgcaaagtgaagcttaactgtgtaatttccatttattaggcagaggccatagtatgtgagagcaaggggagaaacacgtgctgttgtgtatagttgtgaattgagtgcagagacattaagtctagaagtattggccacaatatatggatcagagtcaatatcattgtccatgaagtttccagtgctactaagagcccaatcctggctagtgtaatataacattgcagcacccttttgttctctgtcagcttcataaatattaccactaatatttgcttcgtttccaccacaattaatgttcagggagtactgatctattgaaaaaacaatgacaaacagggttgaaaagaaagaatactcagtgtaaaatctttcaaattgtaatggtctaatggtaaaaatagacaactgcatagaaaggtaaaattcgcaaagaatgtaacataatcaatggttgtaataaaaaagaataaaatgtcattacaatcattcaatggtggtaataaaaaaggatatcaaattatcttccagtttaagtttcttagaattagtcaacctatttatttcaaataattagaaaaggaggaaataagtcttaaccccttaagaaaaacagttatattcttgtttctctcctaatggacatttattccttcttacattattttgttttatttgaatttctgtacaactctgagcttaagattgttagcaaagaagtaggcagtgaacttttgcgtaaatagaatcataagcaaaatcatgttatatgactatcttaaatttttcttttggtatgaaatcatgttgagttgaaagtttctcatcaacttatttcactcaatttcaggtcacagaatttgagtcaatatttaaaccagcccatcagatcataaaagtaatttaaaagttgtagtatggtcacatacttacattggctaactgaagcagggcatggaaagttcctttttaagcatgaatgaatcttatttctgcaaccaagagagaaatttaaggttatattctagggctactaccaataaccaaattttacagaaaatattccaaagacaacagcttactgtgtatttacagatgaagagtagctctcaacaaggtttctggaaaaaaaaaaaaaatgttgcagtgataactgataactaattgaagacaacttttactcaaagcttaaataaactaaaactttacatgctcccgcgttgacattcagttggacttgagctgtcccaggagaatttattgtcagagatatcactgtgcaccaaaatatataataaaagatgttaatctcatgttgctaaaggagtgcttatttaatttcagatgcagacatcaacggcttgaagatcccagagagcataattttaaagaccaaaccggtgatcgatccagtcaagatattggatcaatgattaaataagtgagtcatgaattaactcacatgacccagtctttttttttttttttttttttttttaatattcattatatacaacttttaaaattgtaaaatttaatattattgaaaattattttttaaactctattgttattatattatattatattttttgtcatatatttcactgccttattcgctgtagccactgaagcaaatattaagatgaagactgaaaattgaaacataacaattcaagtatttaacgtacatatttttgttatttgcgaggacccatcgaggtatgatccctgataatttgttcccggtaagatacctgcattatttaatacattttgtttcgtcaaaattaaaaatgaaatgtatcaataacatattttattcaacgcatccacttacatgaagtctactttgtcaagttgggcaaaagattcaggtatctctccactcaagccattgtaactcaaatctctacagcaacgaagataaataaatgaacttgttttatgtaacgaaagggttaataattttatattataaaaaatgtattttatcttcaactttaagataagcatgttctacattttatagctgtctttataatcttccttcagtattattcaaacaaagtgatatggtgttcatgtaaagcaaggtctatgatagaagttcataagggacacatgaatcatcagagcaacaaccattcaactttgaaaaatcaatctacaccggaaagactatagacatatctgtttcatttttgcttctctcttaatgaagtttagtgctagttagtaattacccatgtttcacggctataaacaaaataataccataactgacctacaaaaccttgtacctggaaaaaaattatatttcagatctagataaaattatagaacattattatgagcgtagtgtcaatattataatttatatgaaaagaaggcttagccaactttgaattgattctatgagatcttctcaagtggaacatgatcctcaaagtaatatatcatgttgtcaaaactgttgtaagttacttgttgaacaacttacaaaattttcagtttttccattctcccaatatattctgggatttctcctttaatcatgcattttctcaataccctgcattatgatgtccaaataaaatataggtcaattttataaagacttcaagagaaagaagcatttaagtcattgaacttacagtgtcttcatggatttcaagttatttagtggtgggaaagctgagcttttactagcttttaggtcagttatcctcctaagtatcaaagaataaataaaacaatcacttaacatattcatcttctatgaccaaaacataaataaaataaagaattacaaacatacaaatcacttaatcttgtcaaggcagaaatgctagaaggtatgggaccctcaagagagcaaccgtgcatatgcctgtaaccccaaaagaaaaaagttaacatgataaagtagtctatacaacaagaatgaacgaggtaggaaacttacagcttttcaatcaatgtccagttactaatgaaatcaggaatcttcccaaggaaattattgtcacttatcctcctaaaatgtgtttcccaaaggttaatcagtatgcaaggaaatgtcaaaatttaaatgtaacaacaataaaagaacaaaagtgataaacaaagctacagattctttaattttgtagctccttatatgaattgattaagaaacctgcagtgacttgcattaacacctcactacctaatattaaatagaatcaaagtggctcatctttgtgtatctttaactgtcagattgtaaccatgtgctagaatatgttaaattgataagaacttacaaatcaatcaacttggttaacttggaaagcacgggtggcaatgctcctgtgaatccattggatgacagaatgctaaacaaacatgatttactcatgttaaaacactacagaataatatgtgagggggaaaatagaagcagatattgagattccaaatttccaataagcacacaaagaagatcaaaagaattacagtttttctaaattggtcaacttcccaatctctgttggaatgtggcctgaaaattgatttccttcaatactcctgtaacattcatacaaatatttaatttaaacaaagctgcagaaataaattggaaattatactaaaccaacaatcctggatcacctatgccaagcttcctttaggtaaaagcaaatatattggcaaaaggtaaaagctacctttagatattccaaatatatctttcacttcttttttttactttctatttttctttaaaaatacatccaatttatcactaagctaagtgatggagtaaacatacaattcatttgaaaataaagaaatgatttcaacatacaagtttctgagggttgtgatattggtgagaactttggggaatggccctgacaatttgtttcccataaaagagctgcacattcaattcacaagaatctttagtgtcactctcaagttgtttactgtatacagaagaaattgaagagacaatgcagagaaaccaaagggtgcaaagcagaaagttcttacagatcaaccaagcgcatggtaccccattgtggaggtatagaaccagtgatgatgttacgactaaggtctctgtttgaaagtgcaagacaaagttagtggacttcaccattccatagggaacatcatgcagagcaaaaaaaagtcatggtttcaaaactgagatttgatatcttacaattcttggagatgatgaagcttggaaaactctggtgagagactaccagacagattctgagccttcaagaatctgttcatttagaatatgaaataaaaagcagaaattcagaatttataattatatggtggttaacatgattattccaagatatccaatcaataaacaaatacagtacatgaaatgagaaaagaaacaatcttgtgagtcccttgtgtacaaaagttaggaagtcctcacaaaaagattaaatctaaaaaattaaccaaagtagaatttagaattaattcaagaatttaattagaatgtattgacagcaggaccgtgtttaggaattttagggcattagtcaaatttttaaagaaacttaatattatataaattatttcttaaaataatttttttagttttttgtgacttttttttaccaattaaactcatgtttatatattctttttatgaatagtaagacatttataagagtattatatattgagattttttttaacttatttttattttaacttttgaaaaccaagttcctactttctatttgatttttttctattactacaaaatataagaataaaaagtactaaataatataaacaatttttttataaaaaaaaatctgatatcaattaaggtattaaaaaatatgaaaaagagataaagaaacaatgagaatgttgaataaatgttatttttaattaaagaaattgataagtcatgcattaatatctttagcccttaatgctattaaatttttctatctctaacattaataaccatgttcctaattaatggtataattgcttataataaactacaaattcaatttttaattatatatataattttgatttttagttttttcacctctaattgttacttaagacaagtagctaactaactttttataaaacatcattgttcattgtaatttgaacaataaaaacagatttatataaaaacttacataataataagtaaaataaaattaaaagacctaaggtaatattttaatttccttgtactatccacgatcttcgaccttgattgacaatattaaagtatcttacagtatcaaacaatcatgaattgttatgaatgtcaaaattgctgactttcgtaataattatctaaaaactaattgtgttatctatgaaaaataatactacatatttttggtcattgacctgtctgtgagactagtgattagtaccccttctgtggtaaccatcaacactcaacagctgatctagtgttcagtaaaccctttcccattctttgaacataaattaatcaacatttcctatttaaaaaaatcaacaaattactttttactagacaaagttcgacgtaacaaaaaaaaaaaaaatagtttgaagcaaaaacatgaatgtatagcccaacagatgaaaattaaaaaatttaagaaaattttgacgagaaaaaaagataaagacagcacatccttttcaaagtcaacgatttgcaacttgcatcaggtcggttgagttgtcgattgagacccgtgtccgacatttcaaacttaatttttttgtatgttaatgagttctggtacttaaacataatgaaatcaacattatacatgataagtatataattaattttgtctctctcaaaaaaaaaaaattgtcacttatttttattttttatttttctggtatacatttattttaaaaatatagtccaagaaacattttcctctcttcaccaaaaaaaaaaaaaaaagaaacattttcctcttctcatttagtgctacgcgttactttgacgagtcacaaccacaaatgtgcatgattaagattcgcgatggtcaattttttgaagaatgcaggatatgcataaatctttggaaatattctaggtaaaaagaaaattagtagaaaaacacccattacccttttcttcctttttgcttcaattaaaaaggttcttggaatccagctatgaaaacatgaatttataactgaacaatttttttctcttaaaaaaaatatgtaattgcacgtgaaggtttgatggtaactttaggtgctgtctgtagtaataaataaaaaatagttgaagcaatatggccgtgaagattaattaattaatcaaaacttgaagaaaatcatcttcattttcctaagtgcacatgtgattccatgtgattatcgtccataatctgagttctcgaaaacacaaagaataccaaaaacttgattgaaacaaattaagagagagagaaagagcattacatgcttacaacatggcaagaagaattgtgattgaaggaacaatcacatatcacagaactctcaaagcctttcctagcattagacacattccaattcccttttccactgcaaggattcaccccaaagtcccagtctttcttcccaatcttgcttcctatttccttcaatgccttcactgcacacaattcaaccaactcaacttcatcgatcagagaaaaagcaaacaacattcaaatgagtcttacggtaccacagatgcatatgcatagaattatagaattagaagctatgatgaaatgaaacaaccaatccatgattttcttttgctgtccatagatccaaacaaaagaaatgagagagacaaaaccacttttgactctgcctcacttttgcaactctatgttccgatccaaaacatgggaaagcagaaaggattataaactaatgttatgaagtatgaactgatttgatacaagtataaaaagtgtgtgaacagcaatgagtgaaggaatgagttttacactcttgagtgttgagcttgggagtggctgcagaagccaagtgtgagaggaaaatcaatgaagtggaaccaaggaggagtaaaaagagcatcttggaataatctaagttggtctccatgaaagtgttttcactctttggtggttcaagctggaagaaaatgatagggagtgagtcagagactattatatgctatcagatgaggatagacactgggttgcataagtggtgatgttagtagcttttgtactctggttgggagcatgtgacaaaaaaaacaaaaaactatgccaaacccaatatgagtatttatattgtgcattgcattatttttattttttgttgtgaaaatatctgtaaaatgctcagttgcaacttgatggaagacaacttggtaaaggatccagagttaattctgatccttctgatgaggggttaatgcctcttatatcttgattaacaaccttcctaaaacagatctcttaatgtagaagtagttgaatagtcttgaatgaatcaattaaattgtttgtggtttagacttatatagtaataattttctggtgagtttctgctaatagttttaaatgtaatttaccccccacccaattttattactttaagggtagaccacccaaatcaattttactactagctttaagcacaaaccatcttacccaattttattacttcaagcataaaccaaaaaaagttacaaggaagaagggggtttgcaatcctatcgcgtgggaaacgtgcgtttgagacgctaaggaaaatgctcaaagttggatgtgggaaatgtgtattcaaacattaattatagaattcggattggttgcgttgtggccatatcttgatatcgcttgccttcccagggttaaaaaagaagaaagaaaaactccaaaaatttagattgagaatatttaaaattaaatcaagtctcctgttatagtagtataacttctactttcttacaatttaaaagtaactaaaaatttatttttgtgatttacatttgtgtggataagaattaaaacagagtaaatcattcacaaaaattataaaaaaattcataagaatcaaagatactgagaatttataacaattcatatattttgtataaccaattagactcctttggttgtaattttcaaatgtgtaacaattaagaaatgagcaacatagctcgaaatgatgagactagataacattttgttttcttttttcaattttcacaactccatcgagcgtcgtattgcattgcattgcatccaacgtttatcttcaattgaaagaaaagcacggtatttgatctatgtagaattgaccatcagaattcaacattagaataattggatctgttaatttaatttggaagtgttaaacgcactacataggtttgcatctattcatgattcacgtatctttgttatccttatggctaaatacataaagacttatgctgttgattttttatttaatattttaattgaatatatctcaacctagctctagtccaaatttaacatattttaattttgtaaagaaaaaaaacttactaaaaattttagaggaacgaaattcgaatattttttaattttatgagaaaaatatcatatttgtcctaaatttaaaaattgattttagtttctacaaaatataacgtttaattttggtcatcataaaattcaaaagcttaattttaggtcctcataaaaattaaaaagttgattttaatgctcataaaaatgtaaaatattatatttttatttttaatataatatattaagtaatattaaaaaaataacataatattcataactcaataattatttttttttatcctaaaagaagagttacggtgacagcggcactggaagcaattttgacccaaaactagctcttgagcagttgagccaacaaattaataacaactttttttctacacaaatctttcgttaatctatataattgtattatatctttatcactaacattcataaattattattttattcctataactattttcacaaatcatccattaatttttattatctttctttttattttaaaaaacatagaaaaatagttaaatacgaagtatccattttcttctaatagttaataatgttaatattacttccttcatttctaattataagatacttttcagaaatttatttgtctttttttataaaactattttctaatttttagattcattaatttttttttacatatccttaattattctctcttaaaatattaatgaaaataattaaataattagagataagaaaattataattttataatgatactgtaatgaattaccagatttaatgtaattaattaaattaatcattttcttaaaaaatataaattaattaaaatgattttataactaagaattgaaaaagtaatatattacattaataaatcaagttgacctcgtccatcttgtcccatctattattgggttttaatcgaggggtttaaacttacataaataaccttaacaaagttttgagatgcgtagaatcaaaaatatatctgtcgcaacccatccatggtcattcctaacaaagttatgaatattatgttgtttttttcttaatataatatattatattaaaataaaaatacaatattttatgaggactaaaaatcaaacttataaaataaaaatataatattttatgaggacaaaaacccaaacttataaattttatagtaattaaaatcaaatttaattttttaagggagaaaaaaaattatcttgtcatatgtgataatcatgtaccgaagtgaatgacacatgacagatattcattcaaaatgttcactgacgacatttttgatgaaaaaaatttaagtgagttttttaagttattttttatgatttttatagtattttttttttgtttttattataatgtcatgtcatcttaagaaattcatatacaaatttattttaatggtaagaaattttaaaaattttcaaaaaattcacatttttatattttttccacttaattataatttaattatagtattgttatgtgtagataaatattatttttattattaagaaataatttcttgcataagatacaaatcttattttatataaactcttcttattgagtaaaattgttccaatgaaaagaaactataataagaaacaaattttttacttaaaagattcttctataaattcttattaaaaatgttctaatacaatattaatatggaactttattagtcacaacaacaatccactaatattagatgtttgaacaaaaattaatacgttttaaatttttaggaactaaaataagacaatatattttaaaaaaatgaaaattgaacttctactactttgaaaggatgaaaaacatatagtatttatcctttttttagggaacattgcaatgctatgaatgcaagaataaagggaaaaaagttgtttgttattaaaaaaaaaaaaaaaaaacaacttgctaatataaaaggatgtgtctaaacgtttccaaacatttaatgcaagccttatatgaccaagacatgcatgattaacaattttctgctcccaaggaactataaattagaacacttgaagaaatataaaaaaaaaggagacatttcacattttttgtccaatacattcaaattctaagatactgtatgataatcatattaaaaaaatcataatcccaaaatctttttgttctaaaatgtattatttatctctatattataaaaattgattaaaagaagaagaatttctttatatattttttattttggcaatcacatagtttctttatcattgcaaccgtaattcagccatttcgatgtggtcaaagtccatgctccaaacatctttcggctcggtgggaggggaagttcaagtcttaagcaactgcgaggtaaaaaattatttaaattaatcatcaaaaactttatttaagtttaattcggttgaaaaatattaaatttaatttaagttaaaccaatattttataatttgaattaaatcgatttttccagtaaaaaaaattatatcgattttttattttctattttatgaagtagcaatactcttaatttgagaatctatagaaacaaatgaaaattaattacaattaagaaaatattgagcagttaatttgacctaatggaaccataactgccaagtattggcattttcccaacctagctttatcattgctggattgagactcctgaggagattattactttacaataaacatcataaggtattaatatttaagtttttaaataattaattgacaagtgcaaaagtattttttttcctgtaaaaaaagtgcaaaagtatttataaagataaatatagttttattatctgaagtgtttttttttctattgaaaagtttaggtaagttggatttctcattaatgttaaataagtcctaagaacatttatagagttatttacaaattattcatcaacaacaagatttttatacgaagaatgaaaatcaaatccacacgtctttttgtgatatgaaattatttcttatcaattagaccaatctttgttaattgtttatagttttattttaactttttaagtttccaaacatcaaagaatgtttaaatacagatagtaaattatgcttaacaaaggacatcgttaaaataaatgggatgggatacgcatgtggattaaatgttttttttatgagtgaaagtgatataaatggttaaaattataaattaaaagaaatatttaaattaaacttaaccaaccctccccttagggtgtatacgggttggtttgggttgagtttgacgaaatttgttattcaatttaattaaatttgaacggattgatttaagtcaatttttcaagaaaaagaataaaactcaatccaaactaatccatttataaatggtttgacttgggtcaacaggtcaaattatttaaatttgtctattattttttaaaatctaatatttttaaaagctaaaatctttattaaatgaaataccgaatattttacttataattattacttatagttaaataatggaagaaaagataaagagaggaatcacattgtctcatcatcacatatgctaatatattatattaaatatgatatacaaattgaaatataataaacaagtttaaaaaacacactcacaaagcctaaaaattcaataactaaaattattacagtatagtttgaaaatttcaatgttatcaaattatcaaaccatgagtagtataattgaaatttcaactaaatctaaaatagtttaaaacaaataaaaaaaaagcaaaatagatgttctatcagcagctaggagttgaaatcctaattttgtgagagtgcttgagtgaaatcatgagaactgagaaaaataatctcactcttaattactataagttttataataatagtaattgattatttaaaatttaaaaatattatatatatatataataacaacttaatataaattaacgggtcaataggttggatcaacaaataagcggatctagatattacacttataattcaatccaaaattcaatgaacttgaatgagttagattggatttgacccaaacacaaaaaatatctaatttaaattgtttgaattgatttgaattattttaaatttgccgatgacttgtagcctgacccctaactcccctcccacacatacgtataaaagtctacctgaaaggtaaaatttaatatggtgtttttttttttactagctattgcaatactagtagtagtatcatggatttatagctagctaatagtggttgaccagggtttgaagcttgaaatgttacctttaatttataggtatgaaaaggagttgaagaccaccttcgtttgcttgcatttgatgttaagtagagacattcctatgtctcaacgttcgaagggttgtcaacaccgcgcgaggactctctctatcagcaacagctacaaaaatattcagaatccgcactgtttcttttccaatgtcctacttgtgattcttgataaagtaataatgacttgcatataactctcaacagctaccagaaggataatgattcggagttcggaccaagggaagaagaaagtaacatttttgtgtcgtcttgcattggaaatttggaattaaggaggaaagggagatagcgtgtggggacatacaaaagaaagaggcagaaaataaatagaatagaacgcgttttaatttaaggaataaaatacaaaagaaagaggctactgaatgtttaatgctcaatgaagtctcacgtacgtaccctgtgagtgaaaagaatatcaattctaactcgaccattccaaattataattttgagaagaattgaatatgaatcactttataaaaatgatctataagtttgaaccaaaactatttttataaagtaattcagtttagttctttaaaaaaacttgatacgtatgaggaaaagaaaaaactaaactaaacaccgaaccaagttaaagttaaactagccactttatgatgaaaacaattttgttcaaaataaaccattttaatagagtgatttggttcgatttaaaaaaaaattatgggcagcactaatctacttaatgttgtgaccttggctgcattattgaattggagattgatatttttcgtattcatacgtacgtgcagtaatctaaataaagtgtgtttgttatcgagagagagtgcatgaagttgactgccactacgtacactgctatgccagctagcttaacttggtagtactgcaaatgcagcattccattttggactctactaactactaccatgcttcttcttttgacctaaattattaaactgctacttcgagctctaaatttcttgtggattcattgggtacgcgctatttcgaatttttgtttttataatactaattaaaatgaattattatcgtttcgtcatttatcatttctagaagtcgtactggtatttaacattaattatatttgcttgttacaggaagccagtcatgaccaataatgaatggctgggctgtaacatttaagttaaatttcaaaaaacacacacacatacacacacacacacacacatatatatatatatatattgctgttttctgttataccgatgcataaaactacgaggtagcgctatatataattagaatgaatggaaaaaaaagatttttgatttatgtttaatatatattttaaaaaaaggatatgcgatgtttacaggtacgggtcatccgtgaacccgaactgatctaaactatttgggttgggtcatttatgtatttgggtcaaaatcgaaccgaaccgatcaaaatcgataatgtagggattgtgttacggatttagatttatagatccgttgactcgttaacccaatccgtgaacctgtaaataataatataaattatatatatatatatatatattaaaattaaaaattatttttttcccatagtttagcatatgacccaattaatttgtttcttttgccaaaaaaattaatagaaacaacattttatttgttactaaattcggacaaaattatgaataattttaggcagtagtaatgtagcacaacaaatttttaatagataaatagtatacttatattttggttattttaaaataaataatattaagcccaacttttcacttctaataaaatacttgagttcatgtacatgcgatgttctgctcatttgaatttaattattagtgatggattgaaagaaattgacctatccattaaaaaaataagagttgcatgtaagtttgtgaagtcttctccaagtagatttgcaagttttaaaaggtgtgctgaagaagtaagtatatccactaaggccatgttaatacttgatgtaccaactagtggaactcaacttatttgatgttagatgttgctgcaacatgcattttatctctatgagtatgttgaagcttcatatgtgttaaatctcatatctagtgaaggggaaggatgtccaaaatagataggtatttggaggatgatgttgaagatgaccaccctgagtttgacattttgaattggtggaaattgaagacatccaaatattatattttttcctatatgactagagatatattggtcattcttgtatatactgtatcatctaagtctgcatttagtacaggggatagaattctggactcatttcgtagttccttgagtcctactactgttgaagctcttatttgtgtccaaaattggcttagatttactaagcaaaatgttaatgacttgcaaattgaaataaatgaagcggaaaagattgattcaagtgtgtaatctcttatttcattttttatatttgtataaatatcaattattttttgtgctaacggggttgtgtttaaatttttagagttgtttggtttgacttcaaatactgctaatattgggtctccaagtgttgaaactgcaagtgttgaaacttcttaatgtattactttcaagtatattgttatttgtttcacctttttttcatattttgtttatcgtgtttataatattaatgaatcattttctgttcatttgtttgtttcagcaaatctggttacaacaattttggttatagcaaagctcaatttgtaagaaatagttgtgaatcagactattatattaaatcttgttcaagaatcttttgttttaatttatattataagtctattttagaatattatgttgatggtattaaatgaatcaatttactactttcatacatttgataatattgtgttaattgtattgaatatttgaaagaatcatgatataaaatagtagttctaagaaaataaattaaaatgggtaacccattgaaccgaatcgaaccgatcatgaacgggttgggttgtgtttcaattttttttctaaaaccgaaccgatcaaatttgattaggttgggtcctaaatttgatcaaaatcgatccaaaccgacctgcgaacacccctaaatataatattaaattaaagttaattgaaatggtgaaattaaaaagacacaatagtttatgtttatgcattattaatgaaatttttttttatcagcagtactaattttattttattttgtttttttaaataagtaatgttatataaaatataggataagcgagtcaattcatttctaatcaatttggcaggcctgatccaacttattgagtatgatgattattgtttgagtgataatattttaattaatctaagctaacatattggttttaaattatggatagagctcatcaataaaaaaaatgggaaaaaaaagaactcctcatccatccactttctcgtttaagcataaatgcagaacaatggttataagattttctttatccaatagttcaaatgacactgaatttgaattatgttattttaagtaagattttggatttgagttttatgaataaaaaaatatgattgagagaaaaaaaattcactaaaagatgattgatcaaattttttaacgtagattaattatctataaaattaatagatatttcgtattaataatgggataaaaaaaaattgttaatactttacagaggatgtaaattgacggattgtaaagttatagttcatttgcagacgaagctgcgagaatgtcgtttacaatatgttatggacctggtttataagtcgaggcccaataaggtaatttagaattctcatggcccatgttattttcacatctcttttatttaagatcagaacttattttctttgaaatatactaaactataataccctacctttcccttacatcttcttttttaaaggacgggtaaccactatagtcccttaaaatataagggggtgataatttaattcctggaaaaacaatttttttgaaatagttcatgaaaatataaaaaaagtgtgtaaaaaatatcatattgttgtgtagaacattaattttaatttatatatctattttgtggactgatattattaagttataatgtttaaggattattttaatattaaattataatttttgaagatcatgttaacattaaagattcaaagattatttgaagtgggacgttacgttaaagttaacgttctacagttaataatatgaaattgatgatgattttttgcactttaggtttaggattaattttaccctttttatcgacccttcttttcacaattaacaatttagtggattgttaatttttaattattggattaattttttttatcatttatataaatttatgaagaaaatatttatacattgttattttagtttgtgaatattggttgtttaatttgaatttatgatgtgagtgtgtctataataggttggaccatcacatgatatcaaatgagacatcacttatctaagttatctcgactaataattataaaattgttacccattaaacaattttggatgatataatattatgagaaacactacaatgtaattttaattaaaaataaagaaatctgatgaataaagactacatgatcctactaaactaaacctaatcatcatcctaaatagtgagcaataagcatgatcggtgctgttgcaattgctctctcccactttgaacgttgaaggaataaatattgtcattggctatggcagtgacaccgacatcaaattatagaagaatttattcttatttatattataaactaaaattcatcattctcttaattagatattttcaacactttcttttttcttttatataaataataaatactaactttgtgagtttcagaatcataccccctttcagatagaagcatgagagcatagagacctgtttgaaattatcaaatatgattgatacttggaagtcgacttcaaccatgtgattagtttaatcatctcctacagagattcatccctcaatgttctatgtatcattttgtacggtatggtgtattaatgacttaataaattagatttcaaaagtggaacgtagaatgtgttggataatttccgtttttagttgattgataatcttatctttatttgataagatatttatttgataagatataatagatatcttttaattgataagatataatcttatttgatttgatggcttaaagcccagcccatttcaccctataaatagatgagtaagggtggaggcaaaacacacagaaaattgagagcctcaagtgacagtcttgagagcacatttgagcaagccttcatgcttgcatatttgagagggcgttgagatactccgccatttgatatttgactgcgtgagagattccgcagtatttgagcaagccttgtgctgtgcataattgagagatctctagagagagtttgagtgaaacactttagggagtttgagtgatcaccattgttggagaggttgagtgtaccaccacattggtgtatttgattcattgtaacccattattgttatagtgaatatttgatctggacttggtcccgtgggttttcctcttcgtgttgaagaaggttttctcccacgtaaagctatttgattgtctctcttgctcctcttttgatttccgcttccgcatttgatttgatatttgagggtccgtgattacccaacagtggtatcagagcccaggttcaagggttctgaaggagccgagatggagaccagtggcataactcatgacggagatatgttcaagttgaccgcagataacttcaactattggaggtcgatgatggaggatcatcttatctgcaaggatttatatgatcccattgttcttgaagaaaagccgactgggaagtcggacaaggagtgggagatcctgagtcggaaggccgtggccacgatcaggaaatatatcgacaaaagcctctttgagcacgtgtccgagttcacgaacgcgtacgaattgtggaacaagttagaatccatgattcagaagaagactcccaggaacaaagcacacctggttcgccggcttgtgaagcttgagtacaaggacggcatgagtatgattgagcacctcaacacctacaaaggtattttgaatcaactgtccaaagccaacatgaagattgatgacgagatgcaggctttgttgttgctgagttcactaccggaaagctgggatactttggtggtgactttgagcaactcggttccagaaggaaaactgacgatggatgccgtgacagacagtctcctgaatgaagaagccaggagaagagaacgaggtgtatccagcacgtttgaggctaacgttgctgagaacagaggaaagaccgactaccggggtcgtgacaagggcaagagtcgaggtggacgagatacgtccagaggccggactaggccaaaatatgatttgaagtgcttctactgtgggaaggtaggacacaagaggtcggactgctgggccttgcaaaatgatgaacagaatggctgtgtgaagccagatcagattgttccccagaagaagaatgatacgagcactacagctgtggctactaacccgaataccgagatattcctcctcagtgagaaaatgttgaacatagcccatgatgattgcacttggattgttgactccggtgcctcgttccacgtcaccccacatgagggattcttctccgcttacaggaagggagattatggtgtcgtgaagatgggaaatcaggtgaccagcaagattgttggtgtcggtgatgtaatcctgaccacaaatgtcgggtgccgacttctgttgaaagatgtgaggcatgtacctgacatgcgtttgaatttaatctcggtaggcaagcttgatgacgccgggttggtaaactacttcggagaaagtatatggaagctggccaagggaaatttggttatggctcgtggaaagaaaaatggttccttgtatgtgatgcaaggaaagacaattggtggagaaaccaattctgtcagagatggatattccctggagttgtggcacaagcgtcttggccacatgagtgagaaaggactccagatgttgagtaagaaagaactattgaccgggttgaatggccaagtgctggagagttgctcgcactgcctagctggaagacagcaccgggtttcgtttgtgagaccggatcagcccagacgacgcaagaggattcttgacctcgtccatacagatgtatgctccatgaccgagagatcactcggtggagctctgtattttgtttctttcgttgatgatcattcccgcaaagtgtgggtttatttgatgaagaccaaagaccaggtactccaatgtttcaaagaattccacacgatggtggaaagggagactggcaagaagttgaaagtggttcgatctgataatggtggtgagtattgcggtccctttgatgcttattgtaaacaagccgggatccgatttgagaagatgcctcccaagactccgcagttgaatggacttgccgagatgatgaaccggactattgaagaaaaggttcgaagtatgctatccaatgctcgattgtcgaaagcatattggggagaagccgtcagaacagcagttgacttgattaatttgtcaccatcaagaccacttgaagaagacattcctgaagaagtctggacaggtcggaaagcgacctatgatcacctaaaggtgtttggatgccgagctttagtgaatatccctaaagatgaaagggcaaagctcgatgagaagacgaaggaatgcatctaccttggttcgccgaaaaccgagtttgggttcagactgtgggatcctatcaagaagaagatagtgagaagccgagatgtgatctttcatgaagatgagactcttcatgatatctcgaagccccaagaccgggttactgtcagacgtgaagaacccgactctccagtccgaagagaagaacccgtctctcaagtgcgtgttgaagcagggggagaagctgatggagaaatcgctgaaggcgatgatcggctagaggccgacgatgctgggatccgagatgatgaagaaccgggttccgaagaggctgatgaagaacagccgagataccccactagagaaagaagaccttctatgaggtacccacctgatgaatacaccgtcattgctgaagatggtgagcctcagagtgatgatgaggccataacgagctcggagaaagaagcgtgggagaaggcaatgcaggacgagatgaattccctgcatgaaaaccagacttatgagttggcccagatgcaaggctactcggatgctgacttagggggagattccgactcgagaaaatcgacgacgagatatttgatgagatttgttggaggagcagtctcttggcaatcaagattgcagaagtgtgtggcactatggacgaccgaggccgagtacgttgcagaatacttagcaaagtgcacaccgatttgaactggtccgatatgatgaccaagccggtaccagcatgaaaatttgaagattgctgtgaagaagccgggctgatgaattcggcacattgaagccgagaaagaaggccgggttgttgaagttgaagacccatgtctcactgaaaaacggaagggggagatttgttggataatttccgtttttagttgattgataatcttatctttatttgataagatatttatttgataagatataatagatatcttttaattgataagatataatcttatttgatttgatggcttaaagcccagcccatttcaccctataaatagatgagtaagggtggaggcaaaacacacagaaaattgagagcctcaagtgacagtcttgagagcacatttgagcaagccttcatgcttgcatatttgagagggcgttgagatactccgccatttgatatttgactgcgtgagagattccgcagtatttgagcaagccttgtgctgtgcataattgagagatctctagagagagtttgagtgaaacactttagggagtttgagtgatcaccattgttggagaggttgagtgtaccaccacattggtgtatttgattcattgtaacccattattgttatagtgaatatttgatctggacttggtcccgtgggttttcctcttcgtgttgaagaaggttttctcccacgtaaagctatttgattgtctctcttgctcctcttttgatttccgcttccgcatttgatttgatatttgagggtccgtgattacccaacagaatgaacatctcacgatgcatcaggacattttctgcacaacaattaagttgtatatgaaatcaaaattaacccatcatctgctcattacattacaaatatatatacggcatgacatggctcatgcagaacaatgcccatttcttctccatctatatgcacggggtataggtatacgtatacatatatgtgctacaaatcaatattgctcagtcatactcaaactttaggaactataatttgtagaaatccatccctgaaaatggggaaagaaacaacaaattatcagcttcaaatgtttataggtacagcacatatctttgaacttgtgcaaaaccacacacatcacatactagtccctgaaattattcaagtcactttcgaccccatgcatgcatattttttaaaataaaatgatatgaagtcacatacaaattcagtaaaccaaaacaaaacaaaaaaagtacacttattttaagctatatggggaaaacttttcagttttcagcagagcagaatagaggagagaggtaggggaaagagttccccttgagtagatgtgataaattatatagcttttacattgagttgaaaaatttatgaatcatcatggcagtattctagctgccaaacaaagcattaggattggcatagattcagtttttttttttttttttttttttttttttgtatttaaaataccataatgatctaagtaccaaaacagtataaaagtgatggccatcattacagtagctagttgcagcaatagtgaatcagctattttagcctaacagaacattaaatatccaataaatttctcagtgaactcaattgaacttcaaggttacaatttgactctccattttgtgttagtaaaagagatcactaatgactagcctggtattgttggcttagcagtgtgatcgcttgcagccaaaatcttcctaatgtatgttaggtacctaggtattttattactacttccagtttgaactttgttagtaatataatcatttgagagtcctctgactgagccagaaaccaaagttactaaaaaattaaataatgcaatagaccaaattagatgaggttttatatatatatatatatatatatatatatagtttcagaatggagttaaaatatgaggctataatcaagagacacgtgcataacactaagatataacttacaaaaattcagctgatattctgtccttgttcacacccgcaggaagtggccagaccaccccatatggtccatatagtatttccctccgatgatatgaagaaaaggaagcatttggacaacctgcaactgtccaaaagctagtagagcgtctacctttaacacacaacctgtcacagttcacacattggctcttttatcacaaagaaaggaggtcctatactacgaaagctctatgatcacgaatgtccaacattaaaatttacatttagcgtttcacttccagaatttatgctttatattacaatgcagaaataatgtataaagtttgtattaatagacaagaccctcccccggtacacaaatgaaagaaaaactcaaacacaataatgacatagacaaaagtagagcatccaacaatattttgttttgccttatcttttccttcaccactcccttttctattgattagggagaactaaatgcttaataccacaaattgcaaagagtattacaattaatatgcgggtgtatattagagattcttcttacttttgttcatcaacctccactcttatgtcactgatactgacacctggaacttccactgtgataacatatttgccttctgattctgcaacatccatccttggagaccactcaattcctgcaaaaaacaaaggtcacaaaaattacagagtacatagtctatgcactggtttgtgattggttttttcatgttcgttcaatcacaagtgatttgttaacttttacaatattaccttaaaaatcaaattaataattatttcttatatgttgacaatataaaaaaatttacactaacaatgcatataaattaaactcaaaataatatacttcgatctgtttcttatagctattcaactattattacttcaaatgcctttccgagttcaaagttctaaccaccaatttcagaatagcacgttttcttttcagaatgtaactgatctcctctaatctgtctggttggcctagcaaatgtaggaggatcaagtgtactaaaatcacagccctgctcctgagccattggttggaccactgaatttgtgaaaactgattctgcccttgcaggtctagcaaaacatggtgctcttgcattagaaagacaatcagatgcagtagcaccatgatttgttttaggagcaataaaggaagttgagccaccctgaaagttagtgtatttgtattaaataagccagtgagaaatgaatcacttacccaaaaaaagtaaatcgaacactgttaagtatttcaataataagaacacttaagtacctcttcaattgaagtctgcctcataaaataaccaagagaagaagaagcttggcgtgcaaaatacaccttattatcacatctccggagtacagagttcagactgccactgcagttctgatagcggtaggaaaattgatgaacaaaatgaattacaaacaaatattcaagaaaaaaaaaggatagtacgtacagattaatttattagacattgtaaaacaaaagctataaaaccaaattaatggtctactaaaaacatataataaaggtgtagcacatggaaattctgaattacggaaacacttttaaatatcaaaaagggacaaagatgaaggaaacacttaagtttaaaaactttgaagttgcttgtagcctacaaaaatgcattgatttgataagagtgttcaagttattattgcctaagccaatcataaaagaaaagggcaacttaaacaattaaatttccaatgctgaacatcaagatcaataaacactttagcataataaatagtgacatcaactgtacaagctaatacgtctcctaatttaacgcaaatatgcaatatcaacggggttaaactatatatagaaaatcagacactgaataggtgatatttcccaatttattcaaagctagctgtatgagatgaaagggcatattttctcgtattcaaaaccaatgagcagtcgagctactttcatcctttagccactaaaaaatgaagtgctagtccactttatacaatactcaaattatatgcagtttgattgtcctacgatgacaataaatgaagattcctattagatggttttttctgttcacatgaaaaggagaacaagggccagttagcacaagatgagaaacataagttcaatttccccacttagctatatctaactcccaaataattcccatgtgtcgagaaaaacataactgaattcaaatgaattcctttattttccatcattatctagtgaaccatgaaccagccatgaacaaataagtaaaagaacataatatgttaccataggcagaacgttggtagttgaaatatcatcattgggtgcaaagtgagcagcaatcatgtgaattctgcgcttcacgggctcactctccatttctaccaataaaaatgcttcacaaaaatttgagctaaaaagataatgcaggatggcaccagcatcagagtatcaaaatataagcagagggagtcacaactgaatggaagatatttttaagaaaataacattagtggggcccattaaatctaaatatcttagtgaactgaagataatgtcagtcagatgccaccatagcacctggacccaaaatatcagtttgagactactgtagtctgtagtacttcttttttagaattttaggtacccttgattggcattgttttattattatcattattatttaatatttatttttaaaaccttacaaaaatttataattacccataaaaattaaaataatataatataaaatgaaaaaaaatgtaatagaaaatgattttttattgcgtgtcaatttaatactaagtaagttataaattaaatatcagtttattagttaaagaaattatttttatcatttatatagtgtatgtttaatttctttttgttttcattaaaaaattatggaccttaaatataattacatagtttactatgaaaattttaaaataaataacaataaataaaattagtaggtttttttttttactttaaaacaaaaatacaagcatactctttcttaattaatatcatgttttattctccataattattattttcctttattttattaaaaaccaatgaaaatatctcccacctggttgtctcattcgtgcagaaacaattcgtactatatatatggaaaattttacaaacaagataacccctctgtgcctgtccgtggctacaggtttgaattctgaacagtttttctctgaatttttttttggtgaaagttgttctctgaatgaatggccaaagtatagagtaactaagacaagaaataaagcagagtacaaagacatcgaagctgtgcaattctatatacctatatgcattgaacagaatatcacagaatacactgctgacatagagtaagtgcttatttgattgtcactacaaatctatctcacacgttacatgagttttaatataaaatctgtaactaaagataatcattttaatggctaagcacgactttcaagatagttatagtaaaaatcaataaactcatcctaatgatttgtgataaaataacagtataaaagtactttaatttagatatacttgtttaacaattcaaaatcaattctatcaaaaattctaaaacaaccaaacactagctagtaagtagtaaataataataataataataataatagaatagaaagaaattcataaccatattttcatttccaaagatcaaagcctttatgttctagaggggtaaatactggaacgtggcttgttttatggtataaatatctgtgcttccaaattcaaataatcaaatttaaccactcgagacaaaactgtagaagcctaacatttgttgtgagcattaagaaggaagcaactgagaccattaagtcaaaatgcagaatagaagcaaactacttaaacagacactaaaaaatggaaacgatgattgcagctttgtgatcaatacaaattattaaaacctgcgatgtgatgcttgtgacaaattgtttttgaagtgtaatattttaacctttagctagtgtcaagtgaaacagtttaacttaccaataaacgaaaagtgtgacactgatattgcagctttatcaaattagttaataaaaacttccacgcggatttagatttgagttgtgattctttagaaaagttttctagttttcttaggccacctatgtgaaagttttcttttcttgataatatttgttaatagatgctgcaagatttgcataatccccaatgtgtgtactctgaatcactcttgctccaatgcccctgctcctgctcaacaaaaagaaagaaaagcaaatgaatcaatattcttagctagcttgattctttgaggaagctccccgtggctactcatgctgattatcttcacagccaacataaggtgattcatggtgtacggtggcgatctatttttaatgttcctttgcgtaggaaattcatcatgtgactaatagcagaactttggctgctgcattgtttatgccaatttgtgtgcactaaaatatggatgtcataatatctgactcaatatatggtttgtgccaatttggtgtttcattgcaataggactttgggagcatttacagttggattgaatgataattatggaacgcaatgtcatcatctctaacgcactagatatgggtggtttttatatgctgtgggatgcaggggttctggtgtggaataattttttatcaattgaagtaattttgtcccaaaacttaaacactccttgtgcttggatattgttctgtctgttattaataaaaatgtagccttttcaaacaagggagcagagagttcaatcgcatttcaattaaacattatatggcaagcagagattaacttttgacacctgcaacttgtgtttattaaaaatgatttatgataaaataaattggcgtcatttcatacaagtagttgactccacccaggctcccagttaaaatcaaaacttgattgttgctgactaagccttcaaagaaacagaaaacaaagggcaagaataagaattcaactttactcgccacaaaactacaaagtaaaactgtagtctaattgcacctgcaacatgatatttcagccttctcagccaccatcttttattgcacgttaggggcctaattatagtcagaaatataaatttccaagaattgtatccaatataagataatgatatgatttgtgctacaaagatgacacgctagagaaagaaacataagaacgaatactacaattcatgtaataaacagaaccattgagtcattaattccatcaaactcactagggtactttacaaatgtcctcatattccacagctttaagtactctgccatcataggctcctttctcaatctgcaccttagcacaaaaattatctgtatccacccccaacagcttagcaattgatcctcgatatgcaccattgactatttttacacgccccccaacttgtggaatcacagtttcaagctctgcctgatcaactctgagcacatgcttgctttcaagcatttctatttccccaacatacttgtcaattaccttccggacaacgcccttttgcttgtagtaccccttctctgccaagactttgctcataatcttgacaacaattccctcatgcaaccaataatccttccgattaatttcttcctttttcttctcttcttccctcatcatttcatccaaagcagattttccacctccactttctttcctcttcaaattgtttctgggattcctttcattatatttctcttcatcaccctcatcaaacaccacccttgacgcctcatgtttttccttgaccacaggtttagctgatgatgacccaagagaaaatcctatcttgattccatcttccatattcagttccctcggaggctcaacctgagaaggctgatcagcctcagaagtagttggctgcatcatttgctcagccttttcaatctgtctcctgatctccttctcttgcttttcttcatctaccatatctgccttgattctcttattcttcatcctctccttgaaaagggtttctgaatctctatctatatatgtaatgaaccatcccttgggtgtttcctcaaccttacatttgccagttcgacccaagtacttaacaaactcagtaagcgtagcccactgagtggagttcatatgaacgtggtgtctatcgtttatgtattcgttataaactacagtggctgccacacggctgaatcggtgactgcgcttcatgtgctccagaaaggtggtctcaaactcttcggaatagccctcaactatcctgtgtgggttttgtccaaaaatctgcatttgacgctggtgcccttcactcatgcaatggcatttaaacccattctcatctcggcactgcttctgacacatctggcaataccaccgaagcttctgcaatccttttgctttgattcggttggcaattgctttaggtgtgagaaactcattttttcccatcacgaatctggatgtcacatttcagatcaaacaaaacgttatcagtaatcctacacactgtttccttacagctgaaatttcgttataaagcaaaaaagaacacaacaaaaacagcattagaacaaaagctaaaattcttaaagcattagaaaacaagaagcagagtactttggagcaagcatccacgttaaataactaatgaataaagttttgattagtatacaataaacaacttcactttttcgctcacacgttaattgaaatccttcaaggtcgaaggtcatcgtcaattggcaaagattcccagaggaacccaatgattaaaacaactttactttgattctcaacacgatgcaacaataaatcaatggtttttcaagcattctctgttccaacatctttggctcggtatcctattctagtttgcttacatctcaatttcttgaaacacacttctatccttctcggtctttcaatcacagcattaccaacgaagaatatcaatcgtccaatcaatatacaaacaacgaggggagagagagagagagagagagagagagagagagaacgaacctgaaattggcggcaactattccggtggtggcgttcgcggtggtaacggcaactacaattgcaggaaccctagatttgaagacggagagaaactaagaaagcgatgggatcggaaagggttttgtttttccgttcacgccgtgcttaattataaactagcttggtggaacgccatttataaaataaaataaaaaaatatattttaattactcttgttgtaaaaaaaagttgtattgattaataactaaatagcattttaagtaagattgataacttaaaacaagtaatatttattgacttgaaaattataataaataatatgatatggcaatctgtaattggttggcaacacaaggaaaattttaagtatattataagtgtatttttaattaattaattttttttagaggatttaagtaattaattttaatatactattgattgatatagacgttagtcaatcaaataaaatcctatgacttttaaaatactaatcacacaaataaaccgttttcaattatatggcgatttataatttattgacaacataataaattttacatttttattggctccaattaaatatgcatacataaaattgtcataaaaaaatagtgatgttaggctcataatttaatttatttgcaatttaagtcttgcttttaatcctcatagttttggttaaaaatttcttaacccaggaattgcaacgaatactgcgaatttaggggtatattttctgtgtggaatatctagttagaattcaattaacttggggtttgtttgatttggaaaaaaaaatgtggtattggatgggataattttttatgatttattactcgatacaaactacttaaaagaccaaaatatctattttttattctcttttttctctcttctagatatgttagaatgtcaacatcaccgatttttaataatccaccgagttcctggttaatcttcctattacatttgcgtctccacaatatatatagttatatacacactaagaaaaacaaagcgcaaataactgcagaaaataaaaaataaaatgatccagaaacattagcaaagtcataattatgtaatattaacccaaatgatatggggggtcttgtcctacactcaaatcagaacgctgtctatgcaatccggcatttttcacctgaaaatctacacagccgacttgtatgtctaatgctcaggttttagtagaataactccctccaatacataaagttgttcttctaacattacacattctcatcaagacatcagaaaaacaatccctaagaagagagtgattcaagacaatcagttcccaagtacaagctggatattgaattgcgtgcaagaagctcggagtccatatcttcagattaacagtaagaaacctgccacaataatttaaagttctctattactatatgcaagcagaattcagtcagtctcaatcaagagcaatcacgataattttcaaataatcagtgaatgtgctaaaagaatgcagtccaacaatgacaaaggtaaaagatttcacaagtgagacagaatacacaggaaatgatggagaaaagccatataaatcccttgttaagaatcttacataattctactatattaagtttaatatggaacgcaaaaaattgatgtttcgaagctaaataatattagagcagttaaaattcaagtcatagaatgagacaaggatgggacacaaatacagaccacaatgagacaataaccacaaaaaacaataggaaaatatatatttcatagatcaaatagaagaccatatcatcaccatatattttagacaatagaccactagcatctaaaatgctggttacagaagcaatgtcctcaaccatgctaaatcattagttaaaataaaataaatatataaattggacagtaattaagatgtcaacagtaatggatacattgattcagtgaaaagtaatttgaacatgatagaaatggttgtcaaactcacaagtcaagaaaaccagttgagttacattgtttttttttttaagaagaatttattagacgtgcataaattcactagttcatgagggaatctgacagtccacaagcttgagtcatgtaatttctcgccaaaaggcagtctagtgagtagcattgggtagacatgtataaattctcaagtccaagagcctgaaaatctactgtcctgtgaatctatttttcccaaaacacagtattttgacgtaacaaaatttactttttgtcatttttggcctgatttgaaacatacagttcacggctcatccattaccatgatgcaaatcaagcaacactgtagctaccgaaactaggatgaacactcttgaaaataggactgatctagggtggaggcatggggcatatattcagggcaatggcaaaaaaagtcggaactatgaatgtttattatggtgatgctattaaattatttttggatactatgaatctatgataggtttttttatgaagtaaactcttatcagttcaaatatcaagtcaatggatgttccaagactataaaatagactcatatatgactataacatgatttttacatagactcttgagtttgccaacattaagaataggcagttctcatagttgtcaatcccaaatattggctgagaggcagaccctgaaaatactatagctgaactgcgggatggcttttattctaaccaattagaataaaaagattaaaggataaactttgaggagagttagaatacaagataatacctgttttagagggattgaaaaacagaacatatgaacagaacaaagcaaggcagcaaaggtcacatttcgctggaattaaatggccgcataattctcagggatgatcataaactatggagagcagagcagaggctgcagatgttggggatggccaactggacagaaaatgctgagaaatactggatatgttcccagaaaaggatgggtttttggcagcgccaaggccgccatggcggttcttttttttgccaaccaccatagacaacaatgtgaagggaagcccactatggcagcaccatagggtgcaatggcatgtttatgtagcaaaatttggatttcagccatccaccattgataacactgactgcagagctattcaatttttgtaaaatgctccagccacaacactttgcgagcacgggatagcaacactatttggcactattgacaactatgctaaagcatgctcctttacaaaggtaaagggaacagaaagaattacacatttgccttaccaccatttggatcagttagcatttaatttccttggttagcgtttgcaaatagcttatactagtttgcaggaaagttatctttccttgatgatttaccaacaggaataacaataaaacaccaagaaagccagcttagcacttatctggccacaaataaagatgatgcatgatggaaaggcaaaagggtgggaacgtatgtgtatacaaacacatacaatatacatatatatcttctcttaaaacagtatataaaaaggtaaattccaaaattgtttatggcaaacagcatactataattttactctgcaactcaaaagtcacaatcatgtcgaattatcgatagctatcctaatgagtctagaaacttgactaaaaggtattgatgttaaattttgcttcatgcccaaacataaatttgagttggtattattaatagccacccacccggctccaacacccttacaaataaaaacaaaggagagatttatgataacaaaattagtttttccttgcaaaatgcatgatctcatcttaatcctaatttaccatttaattttccttctagacatcactatctctcacacaaaaaggaagagtgcaagatacacataaaacatagaatctgtgtctggatgctcagtggatggtaaacaaattgattccgcctcttgtcaaccatggttttagaaaagatacaaatttggtcattgtcagactagaggtgataaaaaataaatttgaaatttaagtcgcaaggtcaaagttaatttgagatgtccatggccacaattgtggcagacttgtccacaaattccaacaatatcaaggaatgcgatggcagcagcaatttaaaactttgatgttgaaaaatttaaactaaattttacatcaaactagctattatagtaaaatcaatcaaacataaataacttaaaaatcaattttacaaacgcacactcaaacactcacacacatacactcactgactcactcaattctgcaaacacacactcaaacacataaacagaggattgaacaaaacaacaaatacaaacctaccaatcatctctcccattactgttgctgttgatttggagggtttgggggaggaggcatgccagggcgaggaggaccaaacaccggaacaccgctgccaggtggcggtggcatgccagggcgaggtggtggtggagccggcattccggggcgagggggagccggcggtcctctcaccatctgtccaggtgggggaggccccatgggtctctgtccatactgcggcggaacttggaactgtggcggagggccaccaggtctcggcggtgcaaattgcccaggcggcatcggcggtggcggacccctcgccatgggaggaggagcgaattgccccggcatctgccctggaggcctcatcacaggcggtccaccgccgggatacgacaccggaggtgcgttgagctgcggcgggcgcgagatctgcggctgcatcatgccaggggcagggccgccgacaccgcggacagggccggcaaggcctggctgagcctggacgacgggagcggatgggatacctcttccggcggcgcggccaataccagcgccggcgagagcggcggcgccgactgccttggagcgggactcttccggcggaggagggccctcgacggtcatggagatgacctcctcgccgcggaggaggacgaggccgagcgtacggcggtcctcgcggtcgccgccttcggcaggcttcttgcccttgggcggaggaagcttgcggaactcctcgcaatcgccgaggacgaggttcatgtggcggtcgaaggccatgaattttcctacgagctggcgaccgtcctgaatggtgacacgcatacggtagttgatgtactgaagcatcttggaactcttcgacatcgacattttgtaaaaatggaaattttcttctgcagcagcttcttcagtgagagtgttttagggtttaagaaaaattgggaccttggaggagggaaaatattgttcactccatacactcgtttagaataacccaactaacactcttttatgggttgagcttcctgcaccattaacttttctcatacaccattataaaacagtgcatttccttaattacccttcccactttcacttctaattccgttatagtttgtgaggtaagtccgtcgtgttttaatgggtgcatttgtgtaaggaggaggcttttgtgcgtgtcgtgtgggtgtgtggtgggttgtttgtgcttaatggttgtcctagggtggtatgtggtggtcggcaatggcggaacggaggcttggatgaccggaagctggatacggatccgacaatccgcaggacatgcacggatccggtaatccgtagagacctcacggattgtgtaatccgtgcggttcacatggattgttcaatccatgtgaacttcacggattacacaatccgtgaagttcacatggattattcaatccatgtgaaccgcacggattacacaatccgtgaataataaaaagtgtcaaaattaattaaaatgaaatttaattttgataagcttcatctttaaatgtaaataaggatattttaatgaataatgaatgtttaatgaatatgatttttgtgtgggattttaatgtaagtaaatgttataatttagcgtgtatgtgtttttacaaggtatgttaaattgttttttgttttgttagaatggacagtgatgagtggatgtacgagagtataatgagtgaacatatttacatgaatgaagacattggaccagaccatattgaaaaaatttgaagaaatttgtgtaaacaatggaaaccacaagtaactgtgcaaagagcatcaaagttttcaaaagagcgatctatgtcagctagctacaataacaagttctcataacagctttcaaagtttcagccttgcaattacattatcgtattagcacatgttacacaaaattatgttaattggaagtatgacacaagtagattaagggcatattaagtttaatatacttctagctgccatcatatcaatgagtaacggcatattaaggtttaaaccactggaattcagaagcttcctacatattcaaaattaaaaccaaccaataaatccatttctaatcatatgtacacatgcaaattaactattttcactaacaagcacatatattggttgtttttccttagttatttatattggctgtttttccttaattatttttcattttttttcttctgaaaaatcctttttttagcaaatagccactgtacggattgatagatccgttggaatggcacggattgtgtaatccgtgcggttcacatggattgttcaatccatgtgaaccgcatggattacacaatccgtgaagttcacatggattgttcaatccatgtgaacttcacggattgtgtaatccgtgcggttcatgcaccattacggattcgggaaaaagtcattcattaaggccattttgggtattatgaaaaagtcaaatggtgtatgagaaaagttaatggtgcaggaagctcatcccctcttttatacagtgcaagatccaattaagttgggccaaggcccagagcccaaaagtggttttttttttatataaaaaatgagtcttttcatttacactggcataaaaattatgattagataagaaaaatattaattagaggataattgtgattaaataaagaaaattattttttacttttttatatttcttttgttgataaattatattttaacacaaattgaataccagtgtagggagttttcctttatatattaactttaaatgaagataaatagagtatggccttttatattttatttttctcatccatttgtgattattttatatatattttttcttttttaggaagttattcattataattgtttttcagaaccctttcaaatataactttttatgtgcatgtttaggtctccgctaggagatcccaaacctaggtttgtaaaaataattcctctaatactattggactcaacttacgtttgaggggcttccaccagtttcccaaacatgctttttatcttcattatttatgaatgtgctattagttggagagcaatgatttaacttattcttgctttgtctaccaaaaaagtgaagtatatatatatgtcattaacaaaaggagttgaagaagatacgttaatcactggaatttgattttcgatttagacattgaatcataattaaaaatattattttatcctaatatggtctaatatgggaggaggagagttagatgagtattaaataagaagtctcgaatacctgtttgtcacacaaaaaaaaatgtatgaaattataagatcttattcatgatttgggtttgaatatgtaaatacatattttttgttgagatattcatagtgcattgactttagctaaaaaatcaacctatgatgctgagtgaatttcgtgagtgtatgtaatttgttttccataaagaaatagccacaacagtcaatccaattgatatgttgactaagactttgttttctaatcaaaagttcaagcatatattggatttggtaaatgatcgtataattcaagacccttcagggttagttgagaggatagtatttttggttagttacgatttgatgtgtttgtatataacataagactatttatatgttatttgtgcaaaattatatagtttcatattttgtctccctttgagtgtaggttacgttgatcgaaccaacataaaatccttattttttttctctctctctatctactcctttattgttgtttatgaattagattgtctaagtttcatatgagtttaataacattgagtatatttacaattacaatcaacttaactcatcaaaatgaaggtaatgacaaaatgaatgatttgtaattaaccataagaaaaaaataagataagatggtgtttgatttgagtgttttttgtttcaatttttaaattatattgtcctacatactctaattcatatagtagattataattaaattttattaatatataaaaatatttattatactgtcctacataatctcatatatacaattgattagtaaacactatataattagttgattaatttaattatcaaattattattataattattaattaatatattatatataatctatgttacttataattgattattgattgtaattatgttaattataaatgtaccaatctatgttaattataaaaaaattaattaattgattaatagattggtaatataaaattatttttaatgaaatataaaaaatgatagcttaaaatttataataatataaaaattacacattatgaagtttaaatttaatatcagtataacgcatgtgattttaagctggtattgagagaaaaagatagtttttgaattttgaactttgaagataaaatatatatttagttacaacttgttaaatattatgttgatattaaaaacataaaaggatacattaaatgcatattaatactgaacaaaaaatcatgttatgcctttttacgtaacttctatatcttattatatttcatcctatttttgctcatttttgttaaaataacgatgcatagatattttatgttatttgataagagagaaaaaataggagaattaattttagttataatgataatatgaaatatgatatatacaaagaaagacttcattattattttactctctcaacttggggattaaaatgttttagtcttctaaatttctttttaatctttcaattttgaaaactgccatttttaatccttttcatgattatgataattttaaaatgcaaactttggtagcttaaaattaaaaatcaaattatggaacctaaaaatcatcacaaattatcgatctattattctcagcttggcaagagcctaaaacgaaatttaaattaaaaaaataagaccctaaattagggagttaaaacagtaattatgcgtaaaataaataaaagaaaataagaagcaacaaactatataattaatgaatatatgtgcatattactttttctaagaaagtccacatatcacatatttcacttaagaagtaaatatttttaaatatgctataagtattgaatttactgtttcacccttttgatgggagcagcaaaacctgtatctgcgattctctctctaccacttcaccaagcccactgtttttatcatctaatttcgggttttattggattaaatttttaagagattattttagtataaaaaaatctttataaaatttaaagattatatatgaatattatgagttatcagatttttttataagacttttatgataatttgaattttaatagatttatatcataagaatttaatttttttttaaaaactttatagatttattagatttaaaaggattctataaaattttaaaaatacattcataagagtttagtgaaaaaataataagaaataatgaggtttggataaaaaagtaaaattaatatattttttaattttttaataactatattgattttagttttatgtcttcttatattaacatcttcttattttcacttttgaatttaaaagtagatttaaaattatactttggttttttattattttaaaaatattaaaattattttatgataaatttaatgatatatttaaatgggatgcaataataaaaatatactataagagagtagttagagtgaaaaattggtaagagagttactaagtatgtggatgatgaaattaaagatgacagtcacaaaaatattgagttgaacaagtgatgaatataatatggtaatttaattagaaaacaaaggaaaaaatgcagagaaaaaaaaatataattaacattttttttatttcaaaagaataggagaaacatatgatacacacatctttaaaaatattaaaaagagaaaaaaatacgtgtgatgagagaaaagaaaatatgttaatcaataaaaaaataagaaaaaagtccaatagaattttaaaaatttggatgaaattatttgataaatattttatactaaaaagtacaataaaattcatccaaattttaaaaaataatctatcaaattttaaaaatttgaatgaaattatttgataaatattttatactaaaaagtacaataaaattcatccaaattttaaaaaataatctatcaaaattttgatagatattttatcctaaaaattatgataatatctgtcaaaatcttaaaatataatctatcaaaatttatatgtattttttaacaaaaaactttttataaattataaaaaatcataattaattaacactaaaatttattatttttttaaaaatcttaaccatcttaattgaattctaaaaagtttatttatattatttaaaaatatttaaaaatcctgattcaatctaaaaagtttatttataatactttaaaatatttaaaaatcctgattcaatctaaaatgtttatttatactatttaaaaatatttaaaaatcctgattcaatatatcccttcgtctcagcatctcccaaaacagattcctagtcatcgatccttaaaaagtttaccatatcttttctatttttatgcttgatcttttctaaattaaggtaacaacctagtaagtttatcggattctgccgcagtaacttcgatttgcactaaactaaacatctgaggatctcagaggggcatcacattcacattgagccaaatcatcacagcaacattctcaaatcacataaaaaaaatagtgctcagtccgtgagagttcgtatcacggctctgacactgacacattcgcacgggatccctactttcttctctcgtttttttattctcccatcaattgtttagcaacccattaaggttctcgtcagaaagtttagatttttattgttagtttttaaatatatttttcatcgtttcatcagtgtgatcgcacaccatgatttgcaccgtgaaacaacccgccatatccatcagaggttctgatcttttcctgcgtaaaaagtgttcagcttcaaccccagttcagtcatgttcccttgtttcaccttcttcaagggaaaaaaactctctgagatcattggtgtcagtgcaaaagccactgcacctttctcgtgttggttttggagatttcgttgggtctctggtgaggcgtgagcgtgctgatttcgtgacatgtgaggcttatgaggctgatagatcagaggttggaggggctggggctccatcagaggctgctaagaaggtgaagattgggatatactttgcaacatggtgggcactgaatgtggtgttcaacatttataacaagaaggtgctgaatgcattcccatacccttggcttacctcaactctctcccttgcatgtggctctctcataatgttgttctgttgggccaccaagatagttgagcctcctaagactgatcttcagttctggaagaatttgttccctgtaagtgactcacttttgtttgtttcctcaggataaatttgatgggagaaaatgaaagcatacttttttgtttgttcatttgttataatttacgtgtacttgttctggggaaaacattttttttaagaactattttgtcccatgttttgatatatatatctgtgtgtgtgtgtgtgtgtgtgtgtgtgtgtgtgtgtggtttgacttcagggaagcttgacgatttcatgaaaaagagaaagagaaaagttaattcatttaaactatgttgatgaatgggaggaggtttaccagagagattttttttttaacgatggaaatttaagttttggaaaggttttagaaaattgtttgtgacagtgattttggccgcaatgtcaaggcttttgtggcctttgtggctgcaattcgccgcaatatcaaagatcctgatgaaacctagaccgcgtctgtgaccgcaatttaattaagaacttgaatcgttttggcttttccccctatttatttatttgtttattaacatcttgatatggattgggaccttagtgtttgctgttttcccccgcaggttgctgttttacatacaataggacatgtagcggcaactgttagcatgtcaaaagttgccgtatcattcacccatattattaagagtgctgagcctgctttcagtgtaatggtttccagactaatgggcgaggaattcccagcgccagtctacctgtctttgattccaatcatcggtggatgtgctcttgcagctgtgactgagctcaatttcaatatgattggtaaagaagttgcttttctaacaaaaaaatgatttgttatctaattttgttctattttgtattttgttgttgaacatagtataaaagttggatatgagaagataatctgagttgaactaaaaaatttgacccgagagaagataatttgatggcaagttattgattaaggcaatgtcataatacccttccccttcttcctccacaagcaaagtgattattactggaattctatgtatatattttaattattatgtgttcatgcttgtgttgagccaccaacggaatggatgatttactattatataagattcttgggtgtttatgccattagcagaggttatgatggaatgtacataacttttcatcttttctgcataggagtccttcacaccctcctggttttgatttcattactgttttattatatttttcaggttttatgggggctatgatatcaaatttggcatttgtactccgtaatatctattcgaaaaagggcatgaagggaaaggatattagtggaatgaattactatggttgtttatctatgttgtcccttgtaattctcacaccatttgcgattgctgtggagggaccacagatgtgggcagctggatggcaaacagcactctctcaaattggaccccaaataatatggtaattacaaaatgtctactctatctgatgttatctatgctatgtttctgtaaaggtgatatcttgaaattgtcataaattcataatattttttttccgacaattattgtcggcatcttgtgtccttttcagaaattcaaatttattggatgttgcgcaaattattagttcatttgtttttgtaatgtgtacactatctcagagcaggagaaggtaaggtggaagtggttggattgtttatggaattgctttgtagttattagaaattagagcaaatcttttttcgtataactagtcatagatgatcaacattaaaagctacataaaagtagcatgactaaaaagttgcatgatttttgttttaaatcttaattgttcttggttattttgagaaatgcaaacatttcattataaaaatttgattttaaattttcagttcaaattgtttatttaattgtaaacctcacgtgattttttcctttttaatcaaagatcatgtgagattggaaattaaatatgcaattaacagtttatttcaatctaacagttgtaatccaatgttttcatttctcacaaaaattaagagttctcaccttcacatacacatatgctgctgaccgtgaagctggtgtgaaacctgatttatgtgtttggattttcaaacgggaaattgacctgagttcttttgtttttgattttgagttatctaatattcttgtcctttcacttgtggttctgaaaatcttctgcattgttttgtcttatgattaaacatatggctgctacttgtgcacaacaggtgggtggcagctcagagcatattttatcatctgtacaatcaagtgtcatacatgtctctggatgagatctctcccttgacatttagcattggaaacaccatgaaacgtatatctgttatagtttcttcaatcattatcttccacacaccagttcagcctattaatgctctaggagctgctattgccatcttcggaaccttcttgtattcacaggtattatctagatgagaattttctatagtgatattttattgttaactattgtgccccttggccatatcatgcactaaatgaaccatatacatgctcatactcttacctcttattggttggagccttggaggatccttttcaaaggttgtattaggttggttttggaggctagcttcaggggtgacatagattgtgttgttagacattgggtgattaggtggaggaacctacactgtctaatactagtgtgcaaactgtcttggaattatacttcaaaagatatttggtggaacaatttgattttgtaagtacactagaaggaaaaatttgagatttatagtcataggttagaattgagtgatggagctattctaaattaggtgatctgatttttattaagtagcttcactttgaattgccgcctatgacctaactgctattggtttgaacccaccatagtttttattccttttctaaatctatgttattacgaattagcatatcaaagcttcaaaagttgactgcaccaatccatttgttcacatgtttagtatctttttaaatatagtttgttgtggagggccttgaaatatcaagaaaaagattggtggtaagaaagtaagaaacagagtactgactatgtggattgcttataatgtggttttcttttgaaaacaacaattttagttgcaggtatacacaatctctcattctactcattttttgcaggcaaatcagtagggttgaggaattgagaattatccccgaacttctttacatgtggtcatacaaggtcaccgataaggaagttagttttggaatgtggtagctggattatggtatgatgacacagctgtggaacattattattagagattattagttttttgcccccctctatttctgaattatcattaagtttgaggaataaacatctgtatttgtttggtctgaggataatttctcaagacatgcatggcatattataataaggttttcttaataataatcaaagtacggtgatcttgtttataatggtcgttatgattcccattaatgcttgctaacactagtgaagatgctggctggagctttaatttatatttttgggtcattcttgctttaaattaacctttgattagcagatggaggcccagttaactgccccgtgtccgtgttgctccgtgattatacttctgtcctatttttttttttatcgataaatgttattcgttagtttttgttagtgagcgaattcgaacttacaacatcttttttccttcaaccaccaaatcaactttataattcttacttctgcactacttaattcatgcactgtcaatctctctctaggccatctaataataattggatttcggtcaattttttgagaattaatgaagaaacataatctaatgtatttataatatttttaatggcttgaagattgctcacctcacctcacaccatcagacaatttatgagaatcattactttggggtgggtgattcttgtatgtagctttggtttttgctgtgtctcaaattgagctaacatagactcagtgaaagttgtatcaggagcttatgaaattttgagtgagaaatatgccactgacaaataatagattagtaatatgagactaatctcatttaaaaaatgaacttcatttcctaaactacctttcatgcttactgatgaaatacttcaattttaggagaacttgtttcgaatgataatactttctctattttgaaagtcatacgattcatatcgcaataatataaggttgttaaaaataaaatctaaattaattaaagaatattttagaaagaataccattaaatagagtgaaattaattaagattaatttgtttatattttggatcaccacacttaagtttagatttacttatcgttgaatctagatagtagcataaaagtttgagcgtccatgtctatatggtcactacaactaacaagttccatttgaaagaatcactcttatgtatgctgtgaacctgataaatgtaaacccaaaaaagagatggcatgaggtggaaggaagaaagagaaataaagaaaaaagagagataaagtgatagatgtgatgaaaaatagagataaaactaaaatgaaaaagagatgtatgaaaaagaaagtgtgtaaattgaatattttcctatatgctatttctaggcatgggtgtttcttcattttgtcaaatcacttgtatttactacatgtttgataggaaaatacataagatacactcatttaagccttgagtctttgaagctatatatattcatgtagttttattgagactaaagtgtttaattctcgtgctcaaacaaatttctttgggttggatggaagtgagactcagtgctatcaaggctttgctttccaattgtaacatgctggagagtttgagttttaaaaggtgttggaattcagacaagtttgacctaggtaaagaaaaacacatggatctgacaaagctcgtcctggactaatgcggctttgattttgattatttcaaagtcaattactgaaacaaatctcaaaattttcaagtattgcgggtggatgaactttgacctagctcatagaaattgattcactcgcaatggaagagatagatcttgatttctctctagaatattcatttgaaggatttggttatcctatctacagtttcgtggaagatgtttgtactgctaaagttttgactgtaagtagttttgtgctaaattcttcatgatcatcaccttttcctccctcataattaatttgtcaattgttatcatatattagtactagttttataattatgtataagtgtatagttacgcttatagtccatgataactttcactcttttgacgtgctccatttctgtttggatgaactgaaatatggattaattacaatatctatcttatctaaattgttttaattaacgtattgtgtgtgatattttaaggtgattcctactggtcccgaacgtatggaacctgacatggatgtacatgtgatcatgaagatggccttgcaacataatgagttgtttgtgagtatcaattacgtaaatccaatttgtttttcctatatacatatatatgtgtgtgtgtgttaagttttgaatttgcttttaacacatcaatatatgttgtggttattttctattaacaaaaaaggagtctaatttctgttgtatattgtaggattatgaaccaccgttttattttaacagcacacaattctggattgaatatttggatgtttgtgaatgattgagttcaagtcgagaagtggtggaaattaatggctttagaggaactctaaatgaacacctcttgctcaagtatttgatctttcgtggatttgtcttgaaaaagagtagcataaacatgttgaaggatgattccggtaagactgtggagtctcattgccgtcaaatggcagaaactcagagatatcaatcttttaacacatagttaaggaaattacactcgtatcccttgtattttactcaaatttcacctgatacctctctcttttttcatattacttttacctccttctgttaacgcagttaactaacatcaattaaaatatgtgagcagacgaaattatccttatattttaattgtaaaattaaaattatcccctcccaattagtttcaaaatttagggtttacctttaattcattttccttattcacaagtaatattcatcttcctcttgttggcgagttttctttaatgtccacagggtgcgagttcctcttcctctcatgaagttcacgttctattcctcttcaccattcatgagttcttcatcgtttctcttccagtacgcgagttctccactgttcctctgtttctctttatgttccacgatttctgttcacactagaattctgcttgtaagtgactattgaaccttgtatatagattctttttaagaatatttatttaattttgattgtttattgttgtctatttctgaatggggtttaaatagaggatcagtttgggaccacttatgatatttaaaatcatttgtttatcattattgactaaaatagtattgatatttgggatgaactgaaaatcatttgtttattattattgattaaaatagtgttgatgtttggttccataagaacacaaatgtaggaacaaaatactaaatttgaagcaaatgattatattcaatcagagaaaaaaactgaactaaaaaattgaagaagaagaaggaagagggttaatactgcgtatcaagaaggtggattcacgtttaacaaaaagatggattcacatttaattagagaaaaaaataagagtcttaaaatattttcaggttgagaggaagaagatgagggtattttaaacataaaatttcattaaaagtcatatgaccagcatgtgcctattttctgttaaattattaaacggtgtttaggatggagggggtctgggtgtaatgtgagctaaacaattaagagattttttgtaggtgcaaaaaggaaagagtataagatgaaatttaagcaaaactaggggttgcggatgtaatttacattttgaagaaagtgtttaaatgtcttgaaaaagtactctatctttaatattattttatagaaccttcaactttttattcaaaaaaaaaaaaacaacttaccatgttatatgtttaagtgctaatcctggtctttgttgttatgcatttttagtttgcaaacgttacttattaatacaagacatttgtctatattatataaacgcattttatttagatttcacagatttcattagatgcatatatatatatatatatatatatatatatatatatgttatttaaaaaattcattttacaataatagcttttaattgtgtttcagcttaagatttttcattcttttaaggctaaaatttagtatttatgtgcattctaatatcaatatatatatcaagcgtggatattgacagatacaatctaaaagctatgcagatttatgttatgtagtattttatcaaaaggacaaagaatcatgaagacagaatccaagtttgttgcttttatggcaagagaaataataatttttttttctttttattgagatagtgtaatctaaaacaaaattgatatactaacttggtagaatttgcaaagtgtttttaacttggggtaagtcagggagcaagtggtacttctcatctatggcttactttttttaaatttaaattatagtaaaaactttataactagtatgctactaattataatatatatatatatatatatatatatatatatatatatcaagtcttagacatttttaggcttaattttatttttgatacattagatatatcatgatttagtgattttggactctgaaggcacagttgcgtgaattgaatcttttaaatgtcacaattaattatgcatttttagtctttttttcatactttttttaaaatatttaataaatttttcttatgtgacactaaataagcacatgtcgatgaagtgacatttaacatgttatttaaaaaacaaattgacatgtcttaattatatttctagtattttatgtatcataattataagtgattaaaagtgtaattatgtcatatcagtcatatagaagttattgatttaatttacattccaaaatatttcttaagattttaatttgtggttaagtttcaaaattctaaattaaaatggtatatatgttaaattatttttcaaatgatattaaattcttaaatttgatttaaatacattattttaccatataaaaatagtattattaaaaaataatatagaagtttttaaatattttatcttttataactaatactgattttttaattaatattatatataatatactatttgtaaattatctttaaatttttttatttatgtttaagtttcaaagttctaaatatatatttattaaattactttccaaataatataaaaattattaagtttattatttttaccatataaaaatagtattattgaaaaataatatagaagtttttaaatattttatcttttataattagcattaattttttaattaatattatatttaatattaacaaagtctgactgacaaatgatactaaagtcaaacataaaatatttcaggtaataaaaaaaaaaggttagatagtgaaatacaaatggaaaatattacacatatggaaaacatattaagccaacaattttttctttatttttgaaattcttattttaagttttaacattaaaataaattttaaatcaaataattcttagaccaaaaataattttattgaacttcttccatcccaaaataagtgttatatttaaaaataaatattatcctaaaatcagtgttatgttaactttccaatttaatatcaattactttttttcaataatactcctaataagtttaatttagcttttcaatataacattaataataagtttagttttataaaatgaattttgtgattctaagaacactaattaagaaatcaaaaataggaaaatttatattgaaaatcatgcggagtgcatttaaatatcataggaaaacacttttttcactgtttccaataatatatattatcctcttttactttcttaatcttaggatactcattaacattttttttttataaaaaaattactactctttttttatctatttattaactttctttgtctgtgtaagaataaaaaaacagactgagatttattttgaaatgaatagagtaatttttatttggatgagaatttttacacaaacaattaatatttaaaaattagactcttaaaataattaatacatgtacaactaattaattaatcttaaaatattaatgatcctacactagttcacatttatttgtttctctttcttcttttatttgccctcacattctctctttcttcaattaatacacacacaaaatttatataaaaactgatcatttactttatgcaacatataaaaactgtaaacgtaggttgaattcattaaaaatatttgaaatacaaataacaaatgtaaagtaattgattgcaaatatttcttaaaatttattgctaaccatggaaaccattgaccgtaaaaaaaacaatggaaaccattgtgggacttgaggaaattaattaatggatatatacaatctacaaaaaagaaaaacacaaatgaagaaaacaatcccattaaaattttatgcattttcaccaaaggttgccttcattctaaatccaacagtaatatattatagtaattaattaatatatatatttatgttttcctaaaaaaaattctaataacggcaacgtatacatggaatttacagaaaagaaaaaaaaaatacaaaaatccatatagaagtatgcaacattgttttctcactgaagcaacgtctgttgcatatataaggtagcactcattggccatttcacacacacatttcaatcccattggaatatttgaagaaaaattcagtaccctaatagtcttatccacatctttattatcaatcaccatatcatatagctagaaccatggcaatgagcatctattcgttgccaatggaattgcttataactatcgtttcacttcttcccttcaaggaagctgtgagaacttctatcctctcgaagaaatggttggagttgaacgtttgcaagttcacaaaaaacatagagtttgatgaactcttttttgttaaacctgatcaacctaatgaaacaagagaaatccaaagaaggacttttcttgacttcattaatttgtggattgaaaatcacaaaggaactttggtggagaagttctcttttaggttatgaaatcctagaaatgctggtgagatcattgatcaatgcgctgtttttgccacagaacgtggggtgaaggagttggaacttgactttgctgatccgaactggaatgaaaattattatggtaattatgacgaggcgcagtttcaattgccagcacgagtttaccagcatggtagccttgagtctttgaagctatattcttgtagttttgttgagactgaagtgcttaactttcatgcactcaaagaagtttctttgggttggatggaagtgagactcagtgctagcaaagctttgctttccaattgtaacatgctggagagtttgagttttaaaagttgttggaactcagacaagtttgacctaggcgacgaacaacataagggtcttagaaagcttgtcctggacaagtgccgctttgaatttgatgttttccaagtgaacgcaccagatctaaaaattttccagtactgtgggttaatgaactttttcatcacggaaattcattcacactcaatggaagaggcaaatattgatttctctcaagaatatggcttcgaaggatttggtcatcctctttataatctggtggaaaatctatctattgttagagttttgactgtatgcagttttgttcttcaggtatacattcttcatcaccttttctctattgatattaatttcttaattgtacgttatcatatattctacttttataattataactttcagagttccactcttttgatcaatttgttccatttctttttcactgaattgaaatatctaattacaaaatgatttgttgatggtttcaattaacgtttttttgtgtgtgatgcgataagattattcctaccggacccgaactgctaggttttcgaagtgacatgcttgtgcaacatttgatcttgaagacggctttggacaagaacgagtttttgggaatcacattcttcctcaacagttgcccgatgttagagtgtctcaccattgatctatgttccgaaaaaaatttgtttgtgagtatcaatcacatacattgaatttgtttatcctttatatatattaggtttttgaatttgctttgcctatatgtgtggttttaaaatttgctttgcctatatgtgtggttttttcatttgaaaaataaaaaaagctgctaattttttgttacatataatgtacttaggattatgaaacaccgtttctgtttaaccgcacgcgattctggagggacaacgtgggagtttatgcaagcttgagttcaagtctggaagtggtggagattaatgggttctgtggaactgagaatgaactttttgtgctcatgtatttcatcggtaatggggatatgttgaaaagggttagtataaacatgttgaaagatgattctggtaggaccatggaacctcgattccgtaaagatgcagaatttttgttgacagttccaagggcttcaagaaacttggagatatcaatctgttaataaattagtaataatattttaatttgagagtattgtgaatgtgtgactgggtgctacattaaatgttagtgtataaactcgacaacaaagtcgatatgatgttataacatctctttgctgctaagactttatttcactgatttcatcaagctgtgtattcattttttagatttcgtaagtttaattacatgagggtattgaatttggtggttacttaaaaatacgcaatttacatcagctttatatgacatagtacttgttttcttttcttaggaattgtgtattgggttcctattgaacacgggaggaaggctaactaaatgttcctttaattaatatatattactttgcgcatttctttctctttttaaagatgaaaataaatataaaataaataaaaaatgaagttcttaaaaatatataatatatttatattttttacataatgtaaaaaaaatgtaaattaaaatgatatttaaaatttcttttaaatgacatgctgttgcatttgatgaaaataaatatctttctaaaaattaaataaataaaatttgaactttttaacaagtcaaatttatatgtattagataaatatcaaaattttaaaatataaactaagaatattatatgaaactacttttagttgacatgatactattgctttgttttttatgtaaaaatatattaaaatgaaggttacataattaaattagattaacgattattatgaaatcaaaatattaatattatggttcttaatatttcaattgaagttatatatatatatatatatatttaatatagactattattttaattttaataacaataataatcaaattattattattatagtatttaagatttgaaaaaaaaagattgaatataatcacatataacttattatttaatttctatccttaattattaatttaaaataaaattatatcataaataaaatattactatccaatattaaaattatatataaaaataatattaatgtcaataacttaacttttccttaaatgaattcaggaacattaaatttagttaaatttaacgactattataaatttaagtgattcatataacgacaaaaaaaaaaaggaaaatttatatatatatatatatatatatatatatatatatatatatatatgcttttacaataaaaacattcaacataattgcatcactataaatcacattcaaagatattacatcacttcaaaatcaagacaaatataaacaacacattacacattcatctaggttttactctttattcagttattctcactcgtaatactataatttcttagaaatattgaacaattataaaagaaaatgtgttagagagtaacattaaatgaataaaaaaaatatcatacaaaagttatatggaaatagaatttctcctttatcagggcacgtagaaataaaattatcaagacctgtgggctttgacctcagccacaacaggggtaagcctaaagacgtatagtcaaaatggcctatatattgagacatgtaaattaggtatctaggtggtgaatggtgataggtcccagccaatatatatgaaaaagttgacttgttttctttctttctcattctattttttattctcctttgtcctgctatatacatacgaatcagtgtgtaaagaacaatttagaagtcaattatgggttctccaagtttcaaatttcgttccactgtccatggtaagttaaagagcttggccatgataaacttgaaaattttgttgacatttatgttgtgggttgcacttgaaaagaaaagggttgccttcatcgcccttgcatatccccttgcctgtatttatgtgacgtaccaggttaaacattgaaaaaccaaggaatgtgataaaaagttgtagtattaactttatttaaagtgaaagtagtgaactgtgaacacatcactgatccgactttaatcatgtaagccccaaagttaatgttaaacgcggaaacatggaactttcataaatgacacatgctgaggttccaaataagactcctatttattactagaagaattattctttgttcccgagtcaataggtgaaaatgaccaaggcaagtaaagcagcccccatccatatatgtactatgattaagagaaattaagttaccaaaacctaatttgcagcagtaattgttattatttcattgatttacctctgttacaattgtccattgcacatctgggggaagtctaacaaaatcgtcaaacttggttcctattagaattggaattgcagtctgcaaattgaacagattaaatgtcatcagaaatttcataaaaaatacgtcaaaatcttcaaaatttggatattatcagcctaaaacagaatatttagttatattaacaagccattttgatatcttgaaaaaatagtataccccggcaagtcaataatcagagttcatttctctgtccagtcttaatgaaaaaaattaatgtcactttcctgtggatactcaaaccatttgcactgctacttcaaaatttctctcgtgttttacaaaaagagtttccatgccaaaagcctttggaaactacactttaatttaaacagtggcagacactttctgaaataaaatcaattcatgtaatagtactatatataagccctgcaaaattattttttacggtaccttattccactgtcttgcttcactataccatcgaacaacactgcacgaacataacaaagtacaaaaaacgcaaatcatcattatttctaccattacgtttctaagaagtaagaacccttcacctaactcatgacacagataatagtatctcttagcctacctatttagtgtacaacgactggtgagatcgaacataatcaaaatcgcaaccgcatctttacaagccatgggaatttgatccaaggaccttttatctcctacacacgccacataatataaagtcaccgtcaataagtcaattaactcaaaccaacaaacccagaacactaaaaagaatgaaaactaaaaagtatacacagacaaaacagagaaaaataaagggaaagaaaggtaaagtttaagcaaagaacctgcaacatcccatattctaaacgaaatacgagctccttgaacagacaaagttttgtccattagattcaatccttccatctgtaagcttctcttttcttgctcattccccacatacttgatctgagaataggaattcacataaccacaagctagttaattagacccgttaaaataaaagactactacacttgaccaatttcaaaagaaataaataatatatgtagggagaatctaatcacaaactttctcatatatagtaaatttgttaattctcatgataaacaagcttaagaattttataaaagtaattttttaatattacataaaaaaattgagtgctgagagtattctggttgagagttatctactaatctttggagacaaaaacagtctcttatatgcatagacctgaaattgaagcctgaatacaagcttaagattcctgtttatttgttaattatgtcataccatgttgataatgatgtaaaagtttttaaatttctagtacacacttgttaaattcttccaaaaaccaaaacaaaaaagaaatggtaaagttagaaacatgctgaccacaaaagtagtttttccaatatggcaatcacccaacaagctgatcttgaggttcaccaaatcggaatcggagtcatagtcgccagtagtggttgcaacggaggagaagacgtcgtcaacggtggccagcggcgaagaagaggggtcccggagggctagtttccggtagtgagatggccttccggcgacagagcaaacaagaagtctgttccaaatgaaacggaaaaagtggccaacgaaagatacccttctgaggacaccccaccggacttcgacctgaacgattttccggcacagctgagacatcttcctagtggtgtcgtgaatgatcttcttcgccatcgagcatggtttcttctcggtgaatattcacataacagatagatagttagtacctaatcttcttctttgttgttcttcttgttgcggtgcgtttggtctattagtctggtttctcggtcccactgtttaatataggggacagttgaccggtatttttcatttcggtttcctaaactctccgtattgccgccttcttggtttctgcgtagagatgggtaatatggtaaatgaacctgtagtagggggtgtgcaaaaacctattccttacaaaaaaaaaaaaaaaaatcgaaccaaatttattctaaactgttttaaccgattcaaaagtccaaatagtcaaattattataaataattggttcgaaaattgaattaattttaaaaattaattgtaaattgaattgattttgaatcagttttaaatcaattttaagaattgaactaattttgaacgagttttaggactgttttatttttataaaaagaaaaaaactgatttaattggatgaaaattggtttattaacaattaggttaaccgaacctctttagtacaataatatagttcttttttaaaaaaaataatttaggtgaaaattggttcgattacaactcgatcgattcagtctgagtgttttcttgcacacctttaacctgtagttgtagtattatttatacaaatatatttttataaaagtaagaaaaaaatagcactcattatttttttatttttttatcacatcatattttttattatatctttttttttttctgttttctttcttccactcttagatgtcaaaaaggttcatggctgttcaagaatatttgtgttattttatctcaaacttatcccttctcttatcattttatttcttgtataagaaatcgaacaagagtgttatggggtgtggtatgagagaagtatatgtatctttctcaattgtcatgatgcattcggcatcttatgaggatatataggataggaattgaaaaaccgagtgtgatgaggagttatctgctgtggagagggcgcatgatgtgaccacgtagcgtaatttcttgtttaattcccgtgctttaaataataacattcatgactgaaagagttggaaattattttattttgatatttcttgctgattattattagcattctagtattagtttgaaattgaattgaagacatgatgagaatgattacatgtattaaaggattgaaccgttagtgaatggtcacgttcttctcaaaataaaaaaataataaaaatacgactgcactgtttaagagtttctaaatatcagaggttcatacttaatattctaatcatatttatcctttttgaaagaaaaaaaatataaaacataattatatctttaatttgaattaaatattttataagctaaatatatttgttgaatataaagaatattccaccccattagtacaatgtattattattaaaataaacaatattataagtatttgatttgatattaagattataaaattaacaatgtaccaaaaaattataaattaaaaaccaatttgaaagagtgcagaattttttattaaaatattatatattttatattttaaagtttaatacattttagcatgaaattatgaaaatatatactgttatttaataatagtagtaaacttaaacgcgtctaatatttaacaaaatatctactaaaaaaactaaacatttaatatttaacatgttaaacacgtctagtatttaataaaatatttaccaaaagaagcaaacgtttgttatttagcatgttaataacacaaaaaattttatttagcatgttagacacgtctaatgtatgtgaagttaaacgcgcttttgaattagttttgctaaagtcaattacaaatgataatagtaaaattaattaaaaagaaagaaaataaaatgtttacatttgattaagttgatttcagactaatttaaaaagtgaagaatagaccatgattagattctactagatttatagtatttaactaattttcacattaggaatttaagggagccacagaaccgctaattatatttgggtttgtgttattattagtggaagtgggtacagtataccatcaatttgttggtatgattagacaaattacagattgctgctctgattggtggatctgaatctactgatcacactgagagcaaaaaagtgaaaactacatttgataaagaaaaaggctgctgcaaccctgcaatcttcctatcttttccctgacaccaaaatgtatgattcaaatttaaaatatacattataaaattcaaattaaataaccaactacacatcagatgtggacatactatatgtatatgggtctcccaattggccatgcatgattctcctttaaaatattattacttgcaggtaatatttactcaaaattatactatagatttgtagataacattacttacaccagcgagaaaagaagtaaagtaaataaaaataggatagtaaaaaaatagaaataagagtaataaataagaaattagataaaattttagattcttaattaggtccaagataagtaaaagtaaaagaaaaaaatatattatgaaactgtttgatttggatagaagaagaaaagaggaattagattagatataaaaattctattccatcattgtatataaactctaaactctcacatatgaatattagatagttataggatccaatttgcaggacataatagattatctacgcataatacattattgggggcatacataacaaattttagtgtgcatataatcgactatagtagcacaaataatagattatcagagcaatggggcatgcctaacaaattatcggggttattgtaaataaagtagagaagttccgttggcttagggtgccttttagatccacgtacaggaagattttcacgttaatataaacactaaaatgacgcagaagctacttgtaacagctttggataaacatggatccagtatatattaacgctaatccaaatatgctgttagattttttgttatttcatcgctagttcacatcaaaattaggatttaggattcaatcatccaaaaaatttcttatttttttacttttttaattatttaattagttaatttaattctatttttatttttaaaattatttttcttaattttgagtgttttgacatatcatacgtctcgatccgatatttttattaaaagttagactatttgaaggatatattgtacgcttaaatcctaattttgaggcacttagagacgtttttttggaagaagaaaaaatagtggagcaaatctccttagggactttgcctagggtttcctctctgaattttaagtgttttgacaaatcgtacgccttcatcggacaattctatcaaaagttatgaccgtttgaagttttgagattttttttttctattgacacgtaattcgttgggctcttcagcgaaatacctcatgtttgccacgtgtcctgctcgttttgatcatgtatttcgctggcccctgtaacaaaatatgtggtcaccagaattacgtcacgtcagctcacatatttcgctggactgcatagcgaaataggcaatgtgacagtctggtaaaatttactgtacgcgtgacatttagacaatatttttaaaaaaatgtggcacgctggtcgatgacccaagatagagaacaccacttcatatctaaaacctatttgctattaatttattgtggaatatttgtaattccaaatgttgccctaaatgaacctagctatatccatgactgaccttatactttacttagggatgctacccttttttgaatgtggtccatctataaaagtttagactctagagcaaggtatctagctaaagttttattgattaattatataaacccaccaacctatctatctttaatatattttatatattttaatatgaatttattttgttagttacatagatcatggagttaggataatgtaatgaaatgaacgaaaaggttctcaccaaactgacattagtatatatatgtaaccactgctaattactatataagtataattaatttcgctaacttacacgtaactacgaacactgtcgttgataattaggtttactaaattgaactcaggatcaactaactagaattaggtttactatagtttgcgttagatgttgatgcctagaatacgaacatacgtgttgacaaacagaaagaaagtgaaatgcacacgacttggaattatgcttaattgcaagacctgtaatcggtgtaattgagtgatggggtcctttgtaaattgatttttgtgttatttgatcgtggaagtttggtaaagtttcaaagtgggttttgtaaaagttggggtttttgtcttcctaaaattcaataatgcgtgtattgtacgtgaaatactttcggtgggtttgcatatcatctttatacaatttaatttggaaatcttgcacacttcatttgttgagaagaacctcaaaagacacacttaatagaatgatttttttttaaaatataagcactcaaataatcaactatagaaccataaaaatttaacttatttaattttctaacaattgtttttcttttcaaattaagtttttttaaatagtacatatactcgtggatataataaaagaaatagtaatattggttgtttctacatttattattaaaattatttgaataaaatacagtgacctaaaaactagcatgtgcatgtcaagactttatttcttatacaatgacaatctcctgtatacaatcctgcaaggatctcctctacttactcaatagtttattatatcttgtaatacgtatgtttcacaattatcgtagaagaagaaaaaaactcaattttttttatggcaaataaactcgattgagtgtcaatatctgaaacactatcgtcctcaaagggatttttgagcttaaaagagactttttcttccattagttttagtccacaataagctttgagaaaaaaatcttaataagtagggttttaatataatttgataattagttatgtttaacaaaaatacttgatgaatcaattggaagttataaaaagttttaaatatacatgtttttaggttgaagttgaactcttattattttttatttacagatcaaatattgtattaaaaataaaaataaattgaattaatatagtaacaaggaagctatatatgagaaattttattaaaatattaatgataaaaatgaaaatattatgttaaattatacgctacaaattacgttattttaagtagaaaataaataaacgttataagctaatgagataaatttcttgatcaaacacgtatactttagtcaaataaattcataaagttattagataactaaaatagtttaccaaactcactgaaagtgacatttggttgttaattaaataagattaatgtggaaatggaataatacacttgatcgaattcatggatgagagtaactttatggaaaacagaataaagcaaaacctcattttgacacagttttttttaaaggttgtctataacctaattaaaatgaccaaatctaacaaattattcccagaacttctcaatttgttcacatgttttctctaaatttggcgttagccattaactctcccactatttatttttttggctttggtctcgtcaccaccaataaagaaaacggtttcatgagttgaggttcctgcctattatttccttataaacccaaaatgaacaacgcaatcaggaattaattggaaaaaaaatcacttctcttaaattagaattcaatcactattcctaatgtcctacaagccgagcgtacatacaagcatgagcaaacacacgacacaaataaacctacgttttttttttttatattattaatgttatgaattaagaaaaataacaaaattgttctcatatttcaactagctgagcaaatgctttctgacttcttttctaatttaaataaataaataattgttaattgttcaacactccttacacacatttactaatgtgtaaatattaagattttatttgaataaatttatttataagagaagaaaataagataaaataaattcaagttctttcaaaagttaaaattaacttttacacttaattgtatagaagtttgttttttcatttaatttctataaaatttatggtgcataagttgattttagattatatagaagttcaattcattttatcttgttattacactctttctagctaaatttttattattagttgaactttatagaaaacaccaaattgctttggtttcactttttatttaaagaaagtttttaattaatcgataaaatagtgtatgagaaaaaagtgtgttagataatatcctgcgctaacactcatctatatttggtggtcagaagaaaggtgttaggatcaactgttagttagctttaagccttcaaccgaataatacagttagttagttaaagtggttgtacatagattgggccttgaatgtccagttcaaacaggcccagtttgattcatgggaccttggacgacgatgtttcaagaggatttttgtcatgaaagtgaaaccaagcagaatagaaagttcagaatgggcaactgtggacaagtgaaaaggcaaagacatggtagagcttcttctacgagcatcacctcctccacctcacccttcttcttatccgaggtaacaaatccaactaatatgtccccattttcatctttagcaatatttaatgttctaattttgttgctcaacttgtgtttatgtccctttatttgtttttccattctggaacaccccttagatttttcctttagaattttctcctaattccaagtattttaacaatgattttttttcccacgtttgttgcagactcttttttctgtttttttcttacatttaattttcggttccttttatttttggtggacttcaattttcagtttatgtaatgtagcttttccatattcatatacacagcattcctgaatgaatttcctttatatactcccagaattttgtcgtgtaataaccaacttttagtgaattagattgcagactcctttcttttttttctttctttgtggtcctcctctttcattgggattctaagtgcatttttttgtctcttcatttgtagatactgttaaatatcaactctgttgctaaaacatgatactcactcaacctgggatcgtatgattttttatttttatttttgtaatttatctttctgttgttgtgcaaattggatggcattttgtttacagacaatgcaggatagtgtcaggaaggacattggtgaagttctcattggaagtcccaagtaagtttctgacaaagcatgtcttatctgggcttgctgcttccttgatatttatttctccagcaaatcaggtttgtactgtattccacaatccaagagtgttactacttactattgaaatttcagttaatcatgcaatttcaagatgtgatatgtccaatacccatcaggaggacctacttaacgttctcacagtattttttttcccaaatacatgatagcaaagttttaaattgtggtgacaattgtagtttcatcgcgatccttgatgttgcgggaaattgtagacaaatgcaactgatgtggctgcaaattgcaattgcgattgcgattcagttgcagtgactctgaaaaccttgatgctgtggccgaaatcgcgatcacaagttgtttgttaagactttgctgatggtagtgtatagagactttagctatagtggttcataatcttttttataactccataattacatggacattgcccaaagcaaaagccattgctattaaatattaattattttgcattatctgatgccattactttctgatgtggatcactttactcgcatagatattttgtatcactcttgaatttttcccatatttgagttcttacaaaggctggatattgttgattgataaaaaaatctagaaaatagatgtatattcttatgatgaatgagctgatctaatgtgtactcatttacttcattaacagactattgcagcagatctatctcgtgcaccaaataatatatgccaacttgccggtcccagtgagaatgcagttacttcaccatttgagaatgaaaaaggttcaaatctaatgatgatgagaggaatgacagcgaaggactttgaccctgtaagatattcaggaagatggtttgaagttgcttcacttaaacgtggatttgcgggacaaggccaagaagactgtcattgcactcaggtaaatgctaaaataaatatagcagtaaatatagaggacgtcatttggtttagaaaaagcccattatatttatgctctttcaacatctttccctaatcaacttcatattattcataataaattgttgaatttggaggcacagacagaaccctaaggttgttcattatttattatgcatgtgtggataattctgtcattcagtagtataacagttagtacatcttggagataagatttatcatttaccttatttggcttcgacaagcttcttgatactaatttgggcatactatgacatttcagggtgtatatacgtttgatagggaagcaccatccatccaagttgataccttttgtgttcatggaggccctaatggatttataactggaattaggggaagggttcaatgtctttcagaagatttggagaaaactgagacacagctagagaagcaggaaatgataaaagaaaaatgctatctccgctttcctacattgccattcattcccaaggaaccttatgatgtgattgctactgattatgacaatttttctcttgtttccggagctaaggataaaagttttattcaggtatttactgaactaaaaaatatagcttaagtttgtagttattgaacttcaaaaggctttttctgaattttcaacgatggcatatatgacatctaaagctaatttattattaagataaattaaagaaacaatactgcatcatacagttctttaattaatagctattaattaggatgtaagtgtatgatttgattttgcttgtagtgttaatttccctgtgatctatatcgcagatatactcaaggacacctaaccctggacctgaatttatagagaagtacaagtcttaccttgcaaactatggatatgatccaagcaaaattaaagatacacctcaggattgtgaagtaatgtccaatagtcagttggcagctatgatgtctatgtccggaatgcagcaggcacttacaaaccaatttcctgatctaggactcaactcccctattgcgcttaatcctttcacaagtgtgcttgacactttgaagaagcttcttgagctttattttaagcagtaactatgttttattttatacagatacaaaaaagttattaaatagataaaaaataataattttacaaaattaatcttaagattaatattacattaaaaaataaaaaaacacttgttagggatgatatttgtgaaaaaaaaaataattaatattatattgaaaagttaaatataacatttattttgagataatttttttttcttcaaataagacacgggacggagggattaacatttgactaaggttttaatctgtgttgcggaacaagttaactggggacggttttcactctcttgcgtacctgaatttttatgcaacacttagattgtttcactttaaaatttatatgaattcatattgccagttttcgtactaataacaccacttataacttttacgttaagtatcttacaagttgtacccattttggagtgcatatataaaactcattttatgaacatatacaatatacagaccaaaataaatcagcatttgtaactagaaatgttgttttccctctcggacttgcttaaaccacataatcggttatttgggaccggagaggagtaacgtaaaacaaacctacataatcattgttaatgtttactaaagcaatttcgagtaccccttggaattggttctttttaagttttaacattccctttttaatgtattcattgtccccccggaaagcgaatattgacgtgtatgattacaagtgtcaattaataataaaatcactaagactgtctacataaagtcgtctataattaagtcctaaaaaaagtcatctaaagttacaataatactatttgatacaaaatctttaacataaggagttaaaaaaatgctataaatgtctcacgatcaattgctttgtcagccatcggggtagaatacacgtctttaacataaggagttaaagaatgtatacggttgtagggtcatattgataacttgggtgtagatgttccaagccatattctttattgtgatagtaaatgtgcattgaatttggccaagaattttatctatcaatctatcattttaaaaaataatcaaaacatattgatattaggttgaaagtaactcaagatgatattaaagataagttgttctccatggaaagatagccattgctgaaaattaatggatatgttgtcaaggcctttgtctactgagacgttcaagtataatttggacttggtgaatgattgcaaatagcttgagaccctttgaagtcaaggtgaagaaatgttgatatgtattttgctaacggggacaattcaagttgtaacgcaatgtgtggagctcaaaatttgaaactatgagcctcatgagagggtaggagggcagagcctccacgatgtagaccaaactcatttttgtgtttttttttttttttttggaatatgaaccagtttattaggttatgagtcagggtaaaaatagaggtgttgttcacattttaagagttttatattgttctctatacaagaaatagaatctttctaactgcctctagacgttgattacattgactagatcatgtaattttttttctacatttttatttatcctcatcttctgccataatatgtttcaatgttgatttcctctacaatattgtgatcataagaagttttattttggttatatgcattatcattcatcactacgatgatgtaaatgaaggcattatgcttggcctatgacaagatttagaaagaggagaattctgttgcacaacactttgcaaagtcgagaggatttttttcttaaaaaaagttttattgattttattgcttttgatttaagatgtttcaattgagtaaaagaatatgattaggattttttcttgattcttttcacacttaataattattattgtacaattacattagtaattgaatgacttgaaccaaacaaaaataaatttgttcggattacttaaaatttaaaccgaacttgattaatcatcttggctttaactttcatattatccgatttgagaacccgatggcctcacctatttatagttgtttttatctcctcaacaaaaagataggtataattttgaaggaactagtatattcttaaaatgcacactatatggataaaatagtaaggtcctggtccttttcgtgaatgagacactccttagctttggttataacgattttgtttttccaccttatggaatgaaatctatggccaagaagtgaaatggactacccgtgagtgacaccaaagcaaaggtcgtgacaagggtccagtaggattggcagtttttgaagagtaagacacaagttcctcaaacttgctctctctttttggtagtaaagtagggtggcaataaatttatgcagataagtagaataaagggaagaaatggattccataacgaagataatatttaaatataccaaaggaagattcagctaacacaaatactatagttgcaaattaacaatttttttagattcggaatttaattcagagtgttttcataatcaaaagccataagactaatcttttaaaaaagtagagtactatttaaagagtaattcctttactcacgaatacttgttttttctcataatcaaaaattaaatgtctatcatgtatttaaaagattcaagctaatagtcacttgtctcacaccttgtggatgcaaattaagatacatgaatcctgcatcttggttttcctaatagcatggtttttggcttatttcaaaatagcaacttaactcattgatagatatagattcgtaaataatgttacatctttctcacactcctgcagaaccccatatgaaacaaaattacaaaatagatggagccaaccaaaataatccacaattcccttaacctgaaaagcactcaaataaatagttgctttcctgatttagttaacctactattccttgccaactaaaacaccaatttacttaaaaaagccaatggaagagatcgtcctacttttacctttcacatgaatcccatcagatccagagtttcaaataacgacctagctagtagcatgtacttaggaacatgatgaaacttaaaaaggtggcacagtagttaggactagagtgttataactgcaagcacatgaatgcagtgactatgtcatcaaccaatctcccatctatctacatagacctatgccatggatttcagtttcagatatagaacataaggtgaagcattcttgtgaaaccacatctcctgtaacaaaagaaatgcctcaaagtctctgcagtttcccctctagaacaaacccacaaaccacccttaaatcaaaagattttgctttctccccaacaccaaccaacaaaagcatgcataaatccactacccttgactcaaatgacacaaaagataaggataaatttcccccagtagaaataggaaccagaggcacagttgcatcactcataatgcaagaaattgagtacttcagcagaattggttccaattcacaaaggaacaagtcccaaatcacagaggtgagttcatccattagtacaagttctacaaccacaattgtatctacagtagaagaaagtacaaagaaaaagagaggaagtagcaagcttttaccaagtatgtgttctatggtggatgtatcagacagtggtaggccaaatgggacctcagccttcagttacaggaacctgaagtctggcacaaaaaaatttcaggtctagataatgctctcggatagcttcgaaaaaccgagcttcttaagacgacttgccaaaggtgtagcccaagccttttctgcattcccacattttatgtccacaatttcaacaatgttaggtatctttttatcatttttctccctcactggagttctgaccactgaacatttatcagaacctagcatgggtactctctgtgtatttctggcattagtttttgttttctggggcatgccattgccaggtcctctacggtttgtagttttactgcttccactgctaccggcttcaactgatgattttctttgttgtagtcttttttgggttgtactgccacagggaacagaaacaggaagtgtttgagttttacttcttgttgaagatacctgcttctttgatgcagaagagatgtgaaccaattcccttgtcattaaggaactgattgttccagtggtgcctagcttgatggatcctcctccaccttttataccttccagactctgagccatgctcctattagtaacacctccaattcaatatccaaatgttccagtctttgagatgaatgctcccagcagaattattcagtgatctgttacacttacaaattagtgtcaccctgtgatttgagatgtaaagtcataaatttctaacaaattatttggtttggtttatctttcatgtattaagactatgtttggataaatttctatacaaatacttatagaaaataaaatatgaaagtaaatgaattgaacttctttcatacaataaaatcattttatacactttaactttcctagaaattagcttctataaaagttaaagtgcaaaaattaattttaatttatgaaaaaagttcgatctattttacttttttatttctttttcctataagtacttaaagataaatttacccacacaaagcctagctatagaaataaagagatatgcgtcataattttcaagagaaagggggatggggtggagagttactagattcactaacaaaaacatagttccagcatcaaatcaacaacagcagaacaacaattctgaaataattcaaaaacattatagactgtgcatcacgatttcaaaacaaaacaggtatttatacagtgcaatgtactctctctttgtatgccatgagacaacaacaaccacacttgatacttcaggatgagaatgccaactcaactataataatttatcatggaaacaaggggagagaaaaagaactaacccacatagcaaaaattcactaccaaatcactatggttgggatgaagcagaatcaaatctaaaacactacccacattaatagaaccagagaaggataaaaggaatacagcttcaccaaaagacaagctaaatcaaacgcaagaatcatcaaatttgacaaactaaaataagcatacatacacaaacagaaaaccaatgatttcgtttgaacaaaaaggcattaacttcaaattcaatcaaattgcctcacttcaaagtgtggaaatctaattctaacaagtaacactgcagaagaaagaagcaacattttagatccacaaagagaggtaagatcaaataaaggaaaaacaaagttgggtatcgtacacatagcaagcttatggctccacacgtatgaaaattgcagatttgaaacagacccaacagaggtagggaacttttttgctaactttttgagctaaaattcagtgaaattgaaagttcggaggcaacgagtttgagaaactgcctctgttctagaaaaaaatcatcatatcatatctaatccaaccaactttgaggaacaggctctgtgtcttattttgtagcgtgcgcatccaatgctgtgttgatttgactcacaaacatcatcgtcgtggaaaagttaactttcccaccaaatattcactactcattatggagaaatcaaatcataatcatcaacatagaatactgggtggaaattccaaatggaatgccactctctagcactatctttcttttattacttgatttaatagacaaactgctaaaataatttgctacaataagttagtaatgtagatggatgaattaatgatgtcatattttttttttcttaacccttcactttttattgaaaaagggaaactggactaatataaaaattgtctgtaaaaattgaacttagttctatgattcaattttaatctgaacatattaataattcatttatgttcaattactcaattactgattacaattgtaataaaattgtatgtttgaaataagagaaagaaaattaaaaagtaaaataaattaagtttttttataagttaaaatcaaatcatgcaatttaatttttatataaaaagaatccatctaaaagttgtgatatatagattgattataatttataactttattaattaaactgttactaaaaaaataatccaaaacctaactttgagatcccaagagaaaagggcaaaaagtcagaaattggggctgatgagttcacagttgggcaaaacaagaatcacgtggtcacaaaccggccaaggcgacaggatccgacttattacttacctgccatcatcctaaagtacacgctccactctattgtagtactacaatgttattcacatgttcataattttagatttaataaaaatttataaattacgtgatagtaatttttaaattatcagaacattttataaaactattatttattaaaagaatattcaatggggtaacttattattcttctaatggtaacataaaacaaaataaacatttcaacacacttgtgtttttttctctcttcataattgaagattataataaaagtttatcacaaataataaataaataagagaatttaacataccacactatgactctcgagaataatttttaattatgataaaaatttatttattttattattattaatgttaattgctagttacatattttcccttattctttttcttaacgcggtctcttttttatattttttctaacacgtttttattattaattaaaattattggaaattataaattgtttgagtcttaccctttatttaataagttcactcaaaattttgtagttgtcgataaattctggccaataaaaaaaagaatgtgttagaatctagagagtgagttgctcctctttattttaagaaaattgatttctataataatattcattattttaatttactttacaactaaatcactaaaaggattttattactgtaataacaacttaataattacgtttttgttttgtttttcacatatatcctcttttagagacaatttgttcaatgtacaatttcatagtgcacctcttccaacaagaattcaaacattatttcatcatattgtgagggattagaagcttatgctaaacccaactttcgtcagtaattacatttaataatttgcaaaaaatcattggatgtcaataatgaaaaaaaatgaagaaagaaaaagaatagaaagaaagtattttgtgattaatttgtacataattaaggaagaaaattaaggttttggtgaatttgatgccaaaatttgattatttcgaatttagaaagaatgggagtgtgtaaatttgagttaaaagaaaaaaaatccttgaattataaaatattgctagttttgttttattttatttaagttgatgatttttttaggttattattattgtttaatttatcttgtaccttgactagtttttttttttgtattattggaagcatatttatgttattattttttattacggtttatttccgtttaaaggtatttatattattttataatatatctttgtttcttattttctactcaattaaattagagaagatgaacttattttcctttcttttcactttatattctaccaaataactaaaaaatcattttttctttctttctttccacttattaaaccaaacatggtacattttctattcaccacaccattcaaggtccaaaccctaccacatgccctatacaacaagcgcatggttccgaagtccgtacgtttggaaattgcggcttggaaacagacccaaaacaatactttgcactgaaattaaccgaaaacgaaacttctatttggatttttggataaaggaaatgtatgaagtgacaaagctttttatataaaaaatatattaactcttatattttatcataaataactaaagcatataaattatgtgagtttttttttttaaattatataatttcagtaattatgactttaaaaaacttttcatttatatataattatgcagttgaaatttacttttgaactctccacaaaattcctctcgcaataaatatacttaatacaatgtgtcataaggtcttcaagaacgtcatatccaaccagcattttgacacactttcctcgtctcattatggagtgcacgtccactgctttgatttgattcacatcattgtggtaggtgtgccaaaattagttttccccaccaaaaatattcataattcagtacgaagaaaataattttaatcatgaacataaaaatagtgggtggaaactggaatgcctttaactagcattaactttcttaattcaatggtatttattattaattttttttatttaaactcaagaaaaagtgaaagtttgtgaaaaataaaaatgaattatgtttaataatagaacccacttacgatatgtaaaatgtaaataaataaaaaatactggaatgggaagtgaaagtttactctttcacaaaaatagaggacaattacgtagtttgcactacatagattttatatatgatgatcaaatgacaaacttttcatcaaagaataataaggtaattagctcctgccaggcatgcataacggttaaagtaggtccatggtccattcttgtatgccatttttgcgctcgttcataagattcataaattcatttgtacagaatatcataaattcataattctgcttgatattactgaaagttgtcaaccttaattgtcactggctatactgatcatttgtgcatgcaaagtgctatttgagcgtccaattatcattgcatgatgtttctacaaagaagtatatgtttgcaacagatcaacagaaatgcagatagattctttttataataatttatatacaatattgatatagtttgcatcttcagaaaagtgagaaaacaacaaaccggtacatgatgcaaggcatgaaaaaccggtatacattcaaaatatagaagcaaaaaaaacaaaaaaaaaaaacaaacaaacaaaaaaaactgctaactagagaagtaaaacgccgaggccagtggttttggcctttttcttccttcaaagcaaaacgtgttatgctttggtatattatcaaaacataacactggaaaatttcctaggatgtcaaaaacctctatagaaatcaacctcagataatgatatttaaggcataccaattctgccttgaaaatagaggcaccagagtagcagtatcttttgattgcaattaccaaaggaaccatgcagccaaagatatctgaatgagaaaaaatctccaaacagttgtcatggcttttcatgctgtataagggactaccagtctaccactatttcccagagtaccagttttgagcacacttggcatcaacagagaggtcaactttaagaatgttcttgccgttgaagggtttggacatgcactcaacaactatggacttcgcaacctcagctgattctgttggtccttccaatatgacttcatcatgaacctgctttgacatatccaagaatcttagtgaaaaagtagcaagattggaatagatatctgaacacattcagatttgaaataacctcaatatcagaacatactgattaaaaataatggttgatagaaattgtaactatatggttactaatatcgtttaattgcttttagattaaggaaattgcctcaaaaagttggcaaaacgaactacttcttgtggtggaataattcaccaatggaacaagttgtaatgtaactgcaattacattggttgataacaagaactacaaccaagataatgtcattaataatcaacaggaaaagaagaagaaaaaaaggatggactacataggcatcacttaatttctccaatgatccatagaaaatgttttgagaagacagatgcataaattattgattacatagaaagcttatagaatatgagtcagccaagctcttgtttgcgtattaatgcttatattcctccaatccccctcccaacttagggaggaagaatggatagaattgcttgttgattcaagactctagaataatggcaagtgagataaggtgtaatttgcagacacactacaataaaagcgagaaagaattatttttttaacaaaaaaaggaaatttagggggcactaaattacctgaagaagtaacttccacccaagctccttcaaccgtttattcttggaaatttgcaacatagcacacatggcaacatcagctgcactaccctgttgaattctacaaatcagaaatccaaaaagaaaggtatgcatgtgggaatgggttacatggtaatagcatctccacagaaagcattgggctattatgagtcagactaaatcttcaacatttcagacagcaggatagggatttaatgacaaagtaatgtatttattttaggaaatcatgtaacctgaagccattatccaatggttaagattagctcataccattaccactccacaagggcctatttacaaattcacaatctccccattcacaggtagcatgatgcatgaacagcaatgaatagtttctactaaatgtaatttttgtcaatctaacaattgaatcataattagttataaataatgatggtgtaaaagctaattttagataaattagacattatcagtatatttaatcaaatagtaaataatttcttatattttcagtaataatatatttatatttatctttacatttacaaactaatggaatatatttacaaattctatgggcattgtaataaaccaatcccaaaagctataagttgttaggtaaagacacattttttggactatataaatgtactcatctttacttactatcaatgaatgaaatctgaattttatgattcttctttatagcttttatttgtaggtttaatggtgttttcttaggagtagtggtagagtagaattagcactctatccaatggtgctttcatcatcttactccccctcccaaatccaccacaaccaccatggaagacaacctttaaggtattttccgaaattagatgccttccagaaccaactcaaccactatgaagaaaataaaatatctcagcacactacccatctaaggtcccaggattcctttcatgacactttcacctccaccgtgcatagcatgatgaagcaactctctgctctcgatcttcaacatcagacaccacaaccactgccgcaatcgccgccactgtcgccgccgtcgcaaccaccgccgcaacagtcgccactgtttccaccacaacaaagtttctcctctccgtacccttgctttaacaatatttcccatacaaccgttccactcatgaacattttccccaaccccaaccccaaccgcatctctgtatcaccttacccacttgctgggtgttgcaacaaaatctattttccccacatcaaccttttcaatttttgcaaccccaacccaccacccacaatccccttcaccgttcactccaaatccacaatcacaatacaccaccaaaaggcaaccaatgttttgcgcttgggaaatttcccagccgcaccgatataacccgtccaatctcattgcaattgaacctaacctccttccccaatcacacccgtccatcatattagaaaataaaacatctagatcaccatgtgtcctttcacccatgtgcactcccacatcacagctggctcccactctctcaattgcatcaccatcccttagatctccaacgatccaattaccacacatctaagccgttaaaatcccaccccaaccatgccatgtacatcctccctaaaccatctccacttaccaaattttttcaaaatcctaacaaccatcaacaccatccacgtgtctcccttatcccacatagtgcactttctcataaagttatatttcccttccaaccactggatcaaaacaagtctcataagccttttcttttttcatgtactgccaccaatttccaaaacccatccacaattattttcttgcccccaaaagcaacatactcatcatttgcaacaagctgttgctctcaattccagttgttttcaaaccttgaggacaaggttgaatgtgaaccggtgggtaatgataggatgggctctaggcccaaaattaaatggtccaaggattatataggatggagttaaatatgtattttataattatagttttttttttaaatttgtgttagaataatatgatgttgacacttggataattattatccttgattgacatttttaggactacataaatgtactcatctttacttattattatcaatgaatgaaatctgaattttatgtttatcttctttatagcttttatttgtagctttaatggtgttttcttaggagtagtggtagagtagaattagcactctatcaaatatatgtaaaggaaatataatttcacccaataatggatttcaaaaaaggagattcctgatagggaacagtactaactagactaatacaagatgacactattgtaatgttaatacaatcaaactctattcttattcacagctctatctggactatcatttcaatataaactatggaatatgatattttacaagtgggctctcaaaatgtgatctcatcattcattgttcttaaaagggaaaagttccaaactagacaagaatcacaagataaataattcagtacattttttatttactagagtgtgcaaagacagttagatagatgagtgagggagacacagtattgatttgtttattagaaagagctaaggacctgcactggagtattaatagcagctcgctcaatgtgacctttctgataggtgttagcttgggccatcaaagggaaccgtcgagctctccctagcaatgtgtaaacacaatgtaacacgcgagcttcctttttacgctcctcttgccattgcaaaacctcttttctatcattgtaccaaaggtcaactgttttcttagcttctttcacagaaacctgagagtgaacaatcaaataataaatcaagggcacttttcacctttgtaaatccctcataataagtaaaagttcagggtaccttccaatccttggaaagccccacaggagtcttcccatatgcaattgagaagttaagcattttagcttttcttctttcagaagcaaaggcatcctgacatggaaggaaaacaaaaatcaaaacatgatcaatcatgaattagatggttataagttataacagtaaaatgctaaaacaacttttttatatcttgagggaagggcatcaaataacgttaaactactaaaaaagcttattaatgcctggtgtattctgatttacttctattaatatacataaacatcattaaacacattatatatcaaaaaactcagtgaattcttctactaccactgcaactatgttttccccctaaacagtgttctaatgatcagtagctgtcctttatttctattggaaagttcacaagttatttgtatttgttctgatttttaataaattatatttattctattttccgttgatggatctcggtccaatcagaataaggattagtcctccctcatgcatctgccagcactctggtggtcactatatttgacgtcatcagctacaagaaataccaaactaaagacaaagccactacttccacatctcaatgaaatggtacttctatcagcggacagttaccttcaaaagaggaactgggggtttatcttcaccaggctgaggatgccactcaagaagcacttcctttttctcaactgctttacgaatatgtgggtacatattcattgcagtccttgaatggaaatctccaccagcttcaaaagcttccaacatgctcttacagtctgcaaggtgtgccagaatcctaagttccagctgtaacaataaacaaggcagttaacagaatgaaatttcttgaaaatagttcagttagatagacaatatagactgttaacctgtccataatcagcaactataagagaattcctgggtgcagcaatgaatgcttgacggattttgtatcggtccttttccagagcaggttgattctaattcatgaagtgtatgtgttaggttctatattgttttgaaattctgattaatctagtagatgtaatacccacatgtcaatgtcaaaatacaaattgaaaatgaatgagatgcattgtgcagtccaaatttaggatccaaatcattgtaataaagtaacagaaaaggcatcaagaccaagtagacatcaaatgattacataaatgtgtattgcaattagcaaggctgtgattagtccaaaaacactaattttaataagatatttttaactgaagtaataaatgaatacaaaagaatgtaatttgagcagagatgtcaagaactgactcttgacctcaagatatttgatagatgacggcctaaaaagggttttatatttttaacacgctacctcacacaagaataattcaggtttgaaacacatataatccacagacctatttcaccttctgctgaattttatttttttgttcaaccttactgccaaaatttagttaagaaaaacagcagcaaaaagatagagtggaggtccaaaatggacttatatgtctaataggaagaaaccctactaaaaggagaaactacattttaggttaaaagacaaaatgataaagccatctactaagagtttagcatcaaggaaactgtatgacaccaattagtgaacatacaagcacacagatgaaggttaatggtcagatctcaaatgtatagcacttaaaaaaatttgaagttcacaacaactactattaaaatgaaaattcctaatcaaaaccattagagaattctgattaatctaattagaataacctgcagatttggccttcttgctgacaagcgtcctgtctctgtgttgatatttaaggaacaatgaacacgaagatcgtttcctgatatattatgtccctgacaaagagaaactgcagctattatagagcacatataaagagcttcagtgtaagaatacaaatatttactaaaagttctaaaatgtaagtggtagcacaataagcattcaaaaaattagcttaaactcagataaggaaatgatttccctagccatagctaagcagtgggagaacttagtattgaccatctccaatgagtattttaaaagctcaaggtactgtggtacttgtgagtttggtgcacaggtgagttgtcaagcatctcattgactgatgtttatataataattataattgtctaaaaatatcctttctagggaaaaaatagaaaaatatcatcaatttattagggacaatatgaacagtatggaagtttgtatactagtttcaaaataaaagaaattccaagcaagctcaagaaagttcatattgcaaaccaaacaataaaaaaatacctgcaggggaaggatgaagttggagatcaaagagttgattgaacagacttgacataaagcagcaattgcatggcaagcttctctcccttctttctctgttggaaaagctgcataggctgtcccatatgcagatttatcaatttttaccggtgcaacttgactttgagaaggattttcatcttcatcatcaagatccaagttacaatcctcatcaaaaaagtcataatcagcggaaatacttccagccagagcctttaaagcatcaccactaactgacggccaaccagttgctgtgtacatctcagtctccaggttataacctaggctcgtcaactttatatcacgaaatttttttggagccttcttaccttcttcaatcacattatcaacattgggaattttgaatatccgttcagttggaagcgtctgattggagtcctttctgtaatgaagcatgtgacaagtgaaatgaaaattttacttccatctatatccttcagctactttgttgtaaacagaaaagttcataaatatcaaggtaggtaccagtagtagtaccatcattcatgaatagtgaatacattaaacttatgaatatcataaatatttcaggctttgactagcaaatcattaatttaagattgaaataaatgctacacgtaagattttaaaaatgtgcacctgttcacaatgccaccaaaaagaagctggcgcaactgcgaatcacttcccacattcatatactgggcatcaggacaatacctagtggcccatttgcggaatctattaacagctacctcttgctctgctttggccaccttttctatgcattcaagataagcccggtcaactagcattccctcagattccatcatgactagaagctcaccaaatggacgccaatattcattgtagaaatcatacatggttttcccataaactggcacaccatcaaatttccagggcatgtctgaaagatggctctttaggctctcatacagcttcaaagtgctgctagcatctaaggcagaataacatatccaaggtatacgctcatctctctgtagctcttcaacaggagcaatgatacttgttttaccctcagatccatcctttttcaattttttcttactaaatatagttttcattgacaccttaccaatcaagtccttttcatggttcagctgagccctagacatgacccttctgtcacctgtaagtccttcaagagaataacccccatccaaatgtcttgaagaatcccataatcgtgccatgtgcattgtatcagcatgaaatcccgaaactttgaatccataattctctataacatgacagtcaaagctataattatgccagacctacagaatgcaccagtgactcggttatttcaaatatggtttgtaatctctggtcacgagcatagacaaacccaggaatttaatgccaatatgattttataaaagatagatttaattttctattactacaagataagaatatctaacaactacacaaataaaataaaatagaataacaaatcatgctagttcacttctatcataagatgaaaacttctctgttctatacaataaaaccatgcaccaactatcctaaatcaggtacacattaacttaacattaggaatgcaagttgcaacctattcttagcatattattgaaaaattgaatataccacagaacacacagtaaaaatcgatatggctctctgtataatatgacactaaacttttagattacctgaggttaatttcagaacagattgtagctgattgtcatttatcttaactaggaaggcatatttcataaagtagcaagcatagaactaatatttgagaagtgttgcatgttgaggagagtaataggattaagaacatagaatggatagaagaagaaaagttcaccttcttgatggaagaatcgctaaaaaattcagcaaatttttctaaaatctctttgcctccaccatcaagaacatctacccagatacaggactttccacctccaaaatcagcttctggaccacaataaatgctgaagcatgttatctccccatgatctacaggagtttcttgtttgacatctatcttggctacctttgaagacaataaaatcagcagataatgtgttacacaaataaaaattagttgaattcatgtccaaagtacacaaacagacacacgtgcacagaagcaacaaaggagataatcttgtgatatggagtaaccataatacaagtaaatacagtaaaaagaattatacctcggtatcacatgcataaataagatgctggaactttgttgtaagcatcttagcaacttcctctgcaagaggaatattatcaacaaccagaatatcatcatatatactacaaagcctatccaggagctttgattggtcagtaccacatgcctgtttagtaagtgttacattagttgaatcctttgcagttccatccaaaccatgatcaccattgactacagggactttttctttaccaatccccaatgaagatccgttatactggtgaatcaccctttcagaatccattaacacctttgaattgtttaatacagaatagttaacagaagatgggacatgtgcaccagaatcctgcagtacaatattgctatccccgttcttaggaacagcctggttctgatcaatggaagcaactccattagatgcactaaaactgccattttcactctcaaatttatttgagccgttcatttcctttttattttcagttaacttatcttttgctatagtccagcctctataatcaccaccagacaatttttttcctgaagtggtttcggaaaattcattgttgcaagaagccatgcccatcgtcctaacttgggcttcacatgaatgcaaagagttcagctcttcctcctcagtcatttcctccaacgtgctagttgatgcatttgaagttttcatagatgaaatgcaaactggactcttgcacagaaaattacacttacacctcacgccattgtatttatttaaccccgcagatatcccctttagacagcatgagaaatctgctctacatagtacataatttctaagcacagcgctatttcggagggaaatttggaatgactgcatttttcttctgcaattcacatcatgcaacaaaaataaaggttccaatcaatgaaatgtagccatccacaagctaagaaaaagcttcatctgtaggcatgtgtggtacaaagagaaaatatatctcttcatcactctattcccacatttactaacaaaagttaatccccggatagaatccttaatattaacctatttcaggttttatcatcaacaaattgtcacagcagttacaatacaagtaaaatttgaaaagtcacacttgacttaatgttaataccagtcacaacctttcaaaccagtgaagaacaacaaggcacactgacccattgaagtaaagacaaaaaaacaacaatcagcatattttactgtgtaacataaaaacgttaatttcttaagctaaaagcagaatacccagttggaaaagatgcaaaatttaaggatattaaagagatgggcgaggtcagaagcaacaaaagacatgaaatttgaagtgaaaaaaagataaaggaaaaagggtaaaccgctgcagaggctgagaaggtaaaagggaaggaagagagaagggacttgagaagcagcggcggcataaagggcagtgtggccttaaagcagagacctccattgaggcagaaatcacctccgagtgctcctgctccctccacagttaaacagattaggagccagctacttgaatatataatatataaaaatatacatacatacatatatatatatatatatatatatatatatataaaaggagacaaaatatttgaaaaaccttggccattaatataaaatacgtataaaataaaaccccaaataaaaataaggtgttataatatttaattgccacgtaatcttatgattggaaggctaggatgccctctcggtcggcggaggcataaataggagtcttaggtgctgtttggtgtgcttttaacataaaattatgaataaatactcatttttattttgaaatttatatgatattgataaattcatttctaatatatcaaaattttaataaaatttctcgaaagttaaaaaatgcatcaatccattaatttcatttattatcgttaatgaaagagtctagatgatatattcatggacgaatttgttgcgctttacacactaaaaaacgaaattgtcaacactttaaatatttagagatgaatttatcagtattttacctaaaatataatttaatttttattttttttattcattacaaacataaaattataataaatatgtaatcacatactaataaatccctaaaaatagtgaaaaaaatggaacaatgtcattttgttatcaaataaccttcttttatttttaatgcttaattgcataatttacaaacctaactgttattattttgtaaattttatcgcctattttttttaatcattttatcatcttatcttcaattttcacgtattttactattcatgtttttttccacattttatcattatatttttaacaaaatgacgtcattttccacaaaaaagtaataaaaaagttataatttttttgggacagatcaacactttattcactgaattggtaaaatgtacaaaaaaattttaaaaaatacgataatgaagcgtgcaaataaaaattggatggttaaagtcttgaagtgctgttaaaaaaaaaggcttgaagttaaaacaaaaattggaggtcctttttataaatttataaatacatctgaagaaataatataaagattataagatactatataacataatttgagaaaaatattgaattatgtaacctacttgtgtaatctatattatttattttcaatgttgttttgtttatgcaatgtttatttttgcaatttttaataaaatttaattgaaagaattgattatgtttttcaataaattatttcattaaaagacaagttaaaataaattgctaaattttcaaaatatttttcattgtctcaatgttaagaattttgacataaaaatagataaaatatacgaatgtaggaaaacttataaaactcatttaatacttttttgtttaattgtacattttattactttattgtaacaattatttttcacttagggtgcttttaatggatacaacataagaacaacacaagtcaagttactagataatttttttatcttatatattatttgatggaaataaataaaacaaactaaataatataaaatttactgaaattttctttttaatattaaattatctaagtaatctattatgagagcatcatagagccctaggccatcttcattcaacccttcattacactgtatcctgaaatgggtgaattttcagacattacaagtgtttatgtgccgttgagagaggcaatttaaaggatgagaacgtagattttcttttttttgaaagtgggaccaaagagagcaatgtaatttattatggttaatttgaagacatttcttcagcgacttttccatgtgtacaagatgaattgcttccttattagcaaatatatatctttattttgtgaagatagactaaagtttatgttaagtgcaagtttatttctgccactaatgatggatgataatgttctttctgtcaaaccaaaaggaggtttccactttgaactggaaaccatttttcattatcatctgaaagaccagaacactcttcatgaaaccattttactctagataagccagtttaaggaggaaaggaattgcattgacctcactgctttggttttatgatcaacaacacaagatatatggagtcaaatgttttgtcgagtggtattttccattatgaaagctgaaacaaaaaggaaacgttgtaacagtattgattagagaatctcgaagagtaggcaattatgaatctggtaacaatcttgtcattctattatcaatatctattatctaatactactactcaataaatcttgaacatgcaaaaatatgtaaccgttttgatcgattttcataaggataccaagtggcatcattaagaaattttatagaatgattctcaaacttcattagcagctgctttttcattcattgtccttttctgtaatcctctactgttttcaggttcgttttgtcaactacattccccatgctcgaaaaaagtctcttttgaacgttgttgtcttcccacttgtatatgcctctttgctaaaacatcaagagctgtaactacgtcactaatcaaaggtcgggtatctgcttcctcctgaatacacattgctgcaactgctattgcttggtgtagaccctttgttgggtagttccctttcagcaatggatcagccattgatgaaaatttccttcggtctttgaatagtggttgtgcctgaaaacaagaaacattatgaatgtcaattgctgaacatttgtgcatattaatggtctaagcttaaatttttggactagttttcatattgattagagggtaaaaagtgttttaggtccctcaattttcagtcaaagttaatctttgtatctatattttaaaaaccatgattttattttttatagtcatctctcttaatgtaacatatgatactagggtcagagacgaaattcaccaattacaaaaaatacgatgaccaaaattattatttttaaaatatggggactaaaaccaattttgaccaaaaatgaagggacttgtgatacattttgcccttgattagattataaatcctgaaattttaggccagagaaatatgattctaggcacataataaaagcttcatgacatacccaagtgaccaagttttgctcttcagatggtcttgactgatcaattgctcttcttcctgtgatcatctctagaaacactactccaaagctatatatatctgattttgtagtcaattgacctgttgaggcatactcaggtgcacagtagccataagttcccatcaccctggtggatacatgagttttatcaccagttggaccaagctttgcaagtccaaaatcagagagctttgggttgaagttttcatctaatagtatgtttgatgctttgaaatcacggtatatcacaggcggatttgctacttcatgtaaatattcaagtcctttagctgcacctgctgcaatgttcattctagtacgccaatccaaaggctttctgttcggaggtagttctgacaatcatttttcttttcttgttggtcagataacatttaacatgcttatcacaaaaaaaaaaatactagggtaatgttttgaaaaggggaacttccacggtgccagtcttgcagatatacttggtttctcacacaaatggaaagataaaacataatctacttaaaaccatcaatatgcaagttgttttatgttgtaactaataagtaataagtaataaccatgatgatccaatgtgctcatctggtcacactgccactacagactacacttagtttattgcatttattgaagtttgatactcaaagtggatgttactctcatttttatccgtgatgtattgcattagaagacataagaagcatttacttaccaagaaggtgatcttctaaagagccattcaccatgtactcgtataccaaaatcctttgatcaccatctgcgcaataccctaccaaattgacaaggttaggatggtgcaacagactcaaaatcaaaacctctacaagaaattccctgtttccttggaatccattcctattaagtttcttcacagcaacaacctgcatgaaaggaacacagcatttagaagttttttcttagcatgatattagcataatattcacatagatgcgagttgaagttatacctgatttaggcttttgaggcgtcctttgtacacccttccaaagcctccttcaccaatcatattgtcagggtgaaagttccgagttgcaacacataactcgtgataagaaaaagtctgagaggtaatattccctttcccaatttttgctatttcttcttctatgtacttccgtttgctggtatctacaagataaatttgttcaagttttaagcatcggtattcatcattgagaaaaaaatgtctgagaaagctgaaatccactatatagggcactataagaccactttgcacctttagcttagcaatatattgtaaaaagtcaaaactccagaggttaacaattgagacacaactattgaggttgagagtaagagatccttaggtttatgataccctaattggtaaggataagactcatagctcacaaggatgtgagtttgaatcctgttgtcaaatgataagacctcattggtacataatctgtaagaacttggtggcacaaattgtttcaaaacatgttatcaacaagctaagaacatcattaaactaggaagggagcctaaagagatgcacaagatatgcatgtacttctgcatttcacatcgttgaggcttcataataatcaaaaagttgatgaagcctattgtgatggcataaacctttcatggatttcaattttaggatttcatgttgagataaataagattgtgctagaggaaaataatttgtcgtggaaacaacattaaactgtagatatgagacattaaattgaaaaaatgctggcccgaaaatcgatacaatgagaaaattagcattggagctaggaaaaataccagatttaaaacacatgttggctaaccatggcagagcttttgcgtgatggtagttcttactgctccttttcaatgagttattgtcgatcttctcttgtgacgtgcaacatgaaaagaaactcatcttccactcctaaataattgatctaaccaaacccacatttacagaattgcaaattcatgcatctgtttttcaaatctgtctcttagcatgcaaatgttagccaatgatccaatgcatgcagtcttagaccctccagaagtggcttcaaatcaatttaggaagtttttcattgaaacattggccctgcagaaaccaaattgatcctgagttctagcttcacacaaactttcccatatggcatggttacttttccttcattgttattcaaaggccatagttaggaaaagaaatgaatgtcaaatatgctaatccaaaaatgaccgttagggagtcactcatctttaatatcattatctaaagttcctcaatataggatttcattaagtgttctctcttaggttgcactttattatgccaaccaaaatggagaggatcactccttaatgaaactagtcaagaataaattatgacaactattttatatggacagcttatatctactttgtatccttcctatctacctcagttatattctgtttgattaagcatgtacctaattttgtgtatgatctatacaatacttctttaaactttttgaatgacaataaactcatttaaatgatatgatgagacatcaattttaaaaaaaaaaaaaatggtttttacttaaatgttcattaatataccaatctctttaatagtacttaggtggaatattatatgtagtatattacattttaaattataattttacccatctacatatctgtattcctaacttatacaaaatatatggatttttttttcactttgattaaatgaatattttcttgtattcttgttcaataaaataaaatatttgtaatatttttatccatacaaatcgaagagaaatacttagaatttataacaacaacttatatattttattcaatcaatagagttagaatcatcattttaatcttacaagtattagtatgctattatgttaatccttcaaatattatgaatctaaaatgtcactgaattcttctgtataaagtggtgacataaaattagttatttttattttttaatatatttaacttaccaaatttttggggaaaataatatagcaatactctaatttttgaaggagaaaattaagtgtttagtttttttataaaaaaaaaaaaaaaaggaaagaaaagactctctctgtacacgttccaaagacaaggaacactaataaaaagccaattttgcaaggaaaattaatagttcagtcaaagttgatgttataacaaaaatcacagattccagagaatatattctttttgaaacttgcagtccaaattcaaaaattatttggaaaaaaaatatgatatactattaaacatgtgatatgccgaaatttaaagttatatttttgttgagcacgtcatttttggactaatatattgttaatttttcatgaaaactggcagggagcggggggactgagattccaaaaaatacagcaattgtgattctaattcctgttagatgaggtatttacatttatactctgttcggatttggacatataaaaaaaaatgagaaaagagaaaaaggataaagaacaataagattgaaaatttgaaatattatattactcggatggataaggagaaaaataaagatgaaatcgtgtatttctggggggggggatgttttctgccatatgtatcattgttagaataatagtaggattaacttttttaatttttatgtcaatttatttgtcactggctgctataatatgggaactaagaaaaaaaggatttaatttctctaaaataagatttctctaaagtgaagaaatgcaatttagataatgaaataaatacattcacaattatttattagaaacatcttaactaataagaacttttcaattgtaatatcttgttacaagttttttaagaccaaaatgctgaatttctaagtttataagtattttaaaaagaaaataaataagattttttaaaaagaaattgaagtatacaagttaattttaattttgataaaaaaaaaattaattcattttacctcattggtttattttatttcgtcttttacaagtatcaattcaaaatttcattcaaaaaataaattaaattaaagataatatttgctgattttgcgttccgtcatacgactctttttaccaacaagggttgcaatgatttcttccccattattgtaaccaaaaagcttcatctttgatttgaactgaagaaatcaaaagcaataaaacatagctagctccaattaaaggatctaaaatcgacaataatcagaagataggttcagcaatctgttcttagattagtgaaagcttgccctaattaaagtttctaggtatctagatcacctactgaaacaaaaactgtaaatgctacacgatcaggacattaaacatggggaaaaaattgaattaaattgcacaaagccatcgtgataaattttcaggtctttcattaacatggcaactttttttaggaactcttcacctgcctcaaactgtattgaataatgtatttatttacaattaaattcaatggtatccgttagcaataagtgcaaagggaacttaaaaaaaaaaaaacaataagtgcaaaaggggaccatatagtggtaaacaaaaaccaagcaaaaagggaaaatgtgtcttaaagataggcctcgacttaataaccttcatctatatatgaacatcaacttctgtcctaaaatatggcactatgtggagcctaaatgtggtacaattggtggactgtggacatatatataagactaaaacataaaatgattttaggaatatgaactggaacgacaatacttctgaaaagtgcaatgctaagtaaatttaaagttattataagccttcaaaagtaacatctaataatgacacaaggaatccaattataaccccaactaaaaggatttcaatttgctatgactgtgagacgactatactcacatggaattagaagaaatggctccaattagtcatgtataccttctaaatctctgccagggcattcagctagggacttgacttctcttagatttaattgttttacaatgaggttcagacattattagctaggttttaataagattggcacttggattttccttctgataaactctaatctttttatcttacattggatataatgctcacttgtatattaattttaccgaataaaatctaaattgtagattacagatgactacttttgttatggtaaactgattttcagtagcatctgtatcatacaaggctatgcaggccaatatcaagtgatttagatagctacatacctaagtagtaagtaaaagggaaagagaaaaaaaaaaagtactaatttaactattaaatgtgcctaatttcttcagttgaatctgcataaaacaccaaagttcaataaactttctgccaagaaaacactaactcctttgtatcatataattcaatgcatgtgcctagggataatatatatccatttatttaagtataaaacaataaaataaaatgtacacaacataatactaatccaatcaaatattcaataacacaattttaacaaaacgtattacaagaactaagctttttctctaatagccaataggttttatagtgaatcatttctaatggttcgatcgtacaagcagatagcacaaacaatataaccataaattaaacaatttggtagggtgtgccaggcctatactgtattgcaagaaataggcgacacttgaatacttaaaccgataagaacagatactacactgtcaaaaggccgagaaaggcatgctttggttagtatattgttgttgcttttatttctgttacatgttctgctgctttcttgactaactgatgtgggactctttggcgaatacgctgctgttgcaaacttgcaatagtgaccatttgaaatgttagttcttctaatccggtctttcttctaaatgtgttttcttatttaggatgtgacagtgcgtacaaagtccaaacctagtttgctatgtgttgaatgtattaagaccttcatggaactactgcatgcactaaaggatgctatctgagaagttaaaagggataggatgactaatttagagacaactcattatattatggattctgttgctgggccatatccataccctgtgatggtaagagagtttcatgcagtgattgacaagtaaaccagaaagcaagctttggaaaaatgcataagaaaccaaatgtgttgattgcatgtgttggtgacaaaaaaagttaggtaaggtgtgcggatttagcttggataattgcaagtatgcagcaatattaatttcagatatgtgatatataccaaaggatgctgcctcagaagttataatggatagggtgactaatgtagagacaactaattatattatgtttctgttgccgagtcatatgtatagtaccctgtgatggtaagagagttccatgcagtaattgacaattgacaaggaaaccagaaagcaagctagctttggaaaaatggatagatgaaccagatatgttgaatgtgcaatttttttctctctagaaaacagcttggtgtcgaacctgaacatggctttttgaaagatttagggcgcactgaatatcaaagaatcactggggaagcgttgaagagggtactatcttgtgtgaattgtttattaaaaaaaccaagtactatatttgaacatgtttaaaaagtaaaagtgcatacatattggcgaggactgagtattatatttcaaactccttatttaaaagataagtgaaaagaaatatttccaacaaaggggtgaacataataaagagaaaatttaaaaataagcattgaaataaatgtgatctgttaaccaaatgaaagaaaaaccaaaatgccatcattctgacacaagccaaaccatatagaggaggctaccagctgagcaacccagcaaaatagagagagcagttgatactctaatgtagtcttccactacaattgcaaattcttttaataactttcttgacaccaacatagtatcacatagttggtatataattttgtttcataagtacgtgcacgtggttaagaatttgaattcgatcttttatccataatttatatgtatttaaaaatatatgttaaagaggtcaacttattaaatagatctcagtatatcaagaaaataatcattattttttttggtatttatactgttcacgaatattcatttttaatttgtttttttataatttaactcataataatttttgcattcaatccacaaatgcttattacaacaaaacaaatagatagaatttaatttttgaaatgaattgaaaaattcaacctgtatttcaagattttgtttcattttaaggaatataaaaaaaaaatacatcatgtttttatcattattatgatatttcatattccaattcaattggatgctagaaaaaaatgaatttgggatagtaaagaaaagaaatattttaactacttttttataataaaaaaataaactttcttgacgaagtttatgaaaataagttttatggtaaaatttagacaaaatctcttacataataaaaaataataagcaattaataaattaaattgtttatccaaatatactaattgcttgtgtaggtggcttttctaacataaacaaggctcgaaggccatacgctaaaggttggaatattggtctcttcaaaattttaaaaaacaaacaaagattgcacaattcacttttacattgaaatttaaagagaaatgttatttttagtatgacatcatttttatttttgcttaacagcattttatttctttattataattaatatgtatttttttacaaacaattttttacttgaatttagtttttttaattaatacatttagatcttcggtcactttttcgttacataaagttttcaagtccttgtttttatgcaaaacgttttaattttggataaataagtttataagatattaaaataaattatagacaaattgaaatgtcttattagacccactctgaatattttttatttcataaaaataagaattaaacaaaaattgttctaaatataataagtacatttcttttcttttttttccttaacaaatgtcataataagagcaataatttgcatttggaaaatgtaattaataaaaaaaatattattaaaatttaattggtaaaagaatatgcaatttttttgaaatgtaaagaaaacttatattttaattatgaaatatgaaaaaggtaaaagaaaaggggatgaagttaattgataagatatgtattgtgaataaatgttattcgtttgaaattaataggaagaatgtatttgtttgatttgaaataaataagagtatatctgcaaattaaaaaaagtataggaagcttttctcttttatatcagagcctggtttcgatccagggacctgtgggttatgggcccaccacgcttccgctgcgccactctgattttagaaattattagtatatattttattacttctataatatattgtgcagagtactgtattctttgtttgattgaagtttttgtgcaacgtcacagagcaatctgctacggtcaccaattcaccaaaacaattgcaactttgacgcccacgatttgttttgtttgaaatttattggatggcgtggttttccaaactttttagattttccgtctacttgccaaacttgtcacgacattgttgctaagtaaatatgttccttgcacgattagccaacagtgggagcagaattcgataaacagatagataaaaataacattattataagatatattaatggtataaagggaatataccaaacctgaagcttccaataaatccctaatattctatttatagttaaaaaaattaggataaataatcattttttatatgtacagagtacttacaaatttatctccaaaaaataaaatttcaaattttattttttgaaaatgaaagaagtacaacaaattcatcaatctgttaactttcattcattattggcgaaaaagtttgtgtcatataagaacgaaaatgtcataaaaatgattgtcaatatatagatttgactaaaatgttagtaaatttttattggaccaaaatgtcattaaatttttattggactaatttatcatatactaaattttgtttcatttaaggataaaatataatttaattttcatcttttctcttttttttttattgttgcaagtataataatacaataaatactttaaaaaaaggaaaacaaacataagttaaaacaaacataataataaacataatttatttgttgatttgaaatttctaatctgagaataccttatcccaaatatgagactcaaataaaaacacatgtgtcacattttttttcactttggaggataaaatttaaatttgtatcttttaagaatgaatttgtttatgttttacatattgagacaaaaatgagtatttaactaaaaaaaattatgttaaacaagtagttgtgttgagcattatttgtaatttatggaaatctatctagttgtagtttaaatataaaaaatgtataaaaataataattttattatttgcacactgataaaaaaataattattgttatgaatatattgagattaagctactattttatcttacaaacattataaatttactaggatcgatgacttaattttggcatttatgttatatttggttgagatattaaaaataataatgtaggtcctatatgagtttcataattcttagtctctatcttaatttaaagtatattttttatctttatcgtgtcaatcgaatatttaatctatttgaaaatataaatgaaacaaaataagtatgaaccccttttaaaaattccaacacgactagtaagaaagaaacacacatgttggccagatattactaactcgaataaaatatatttcaccattattttcatagaaaaacaaacatatgagatcgaaagctaaccatgtggtaatgcgacatttatatacggtatatatgatgcctgttgagagatcaaacaattggttaattacgacagccattgattacatcgaccttttttttaattaaacaactctgctgtgtaattagcatcatttttatagtttaaacacgtgttggataagtatcatcacacattatattatttcaaccatcttttttgtagtaacatgatcttttggggttgtagtattacattatttgaacacatggacacctttcaattcaccaatcaccacctcacctatgattatcacagtcgtttttctcatctcatccgaaccaacaaaatatctgtcttttttatttttaatataacttatttttttcatacgtctgcaactgcaagacttgatatttaacctcaaaattttaatatcttcgtatgtttacataattttaatttttattttaatagtatacaaatttgagtaaatatacactatttgcttaaagaatttttatataattaatcaatcataagttattatacaatattaatttttttttaatgcatgtactataaatttgttgattttaacaataattactttaaaatatacttattacatttctaatcaattaacactgtaaacctttttatactcacactgtacaaaaattgaacagaaaatttctatattattaattaattaaaaatattataaatatgagttttacagtaattataatattcaataaagttattatacacgtacgttaatttatatataaacggtagtataagaacttttatattattaatatattttaattaaatattaatattataacttataatattgaatgactgatccattttcttttcaggtgtcctcaattaaagttgagaaagtatgggagtcagttggattatgacgagttattaaaaacaaagtgagagcattgaaggaatttatgagttaatattcaatctcctggcatctctagatgttaaaagcaattttcttgttattttatggtgcatttgaaaaaggcaaaatgagaaaatatggaataatattgagcttcagccacaaataaatattatcagtttttatggcattgcaacacttttctgaatggaattgaagcatgcgtgaagaatcacaaaggacatcaacatgcaacctcagcctccttaatttgaattaatctatcatgggaagcaccaacaactggtcgtctcaaatgcaacaacgtatatgaaaatgatgtcatcttgaaggagcataactattatggggttgttatttatctttgagataaacatggtcattttatcaaggtggaattcctaaccctcgtggagcaaaagcatgggctctcttacaaagcattgatacgactttatggtatgggagctcaaaatatatcttttgtatccaacaatgctcttagattattaatattttcagatttccacacgtttttatctaaatatagatcttatttattttaattttttggtgagttttttaaaagactaactaatcaagttattcactagttaataagagcatataaattatatgctagtgtttatatctttgatcatatactcaattatatttattttcttattatgaataaaatgacatatatatatatctctctttcttttaaaaaaaatattacaacttaaatttaatagatatacacttttatatataggcaattaaaaattatcattttaagtatttgatataatttttcatagagaacttgaaattcagatttttagttaaaaaaacaacatcccttagttaattaatcttgattagggcccctgataaatgacaatgtaaaattttactattagtaataatattttgtaaaaaaattatatttatttatttatttttataaatttaaaatttttattttattttataagaagatgataacaaatcatacatttttattcaatcaactagttaaattcacctttaattttaattaagataaacacgaaaaaattccaataatttgtatgccaaacaaaatagagggaggagcaaagtatgcatagttgactctcaaaaaacattcaaaagagtttcttctcctttcttcgatcgtgctcgtgccacggcgaagatgaagatagcgtggcttctgctgctcctcctggtatcagtctgcgtaacgggttctcaagtttgggccctgaaatcgccgtttcacccgcgagacgtgcttcctctgctgcccagacaggtgtcgtggcccatcctcaaccgcctccacagagcggtggatctcctccccgtcttcgtcggcgccgcctcttcgccggacgacagtctcaagtggaaaggcgcctgcttctacgagaacaaagcctggatggtgtttcacaacaagagcggctctcaatatggcggtggaacccttcacatcaaggtcgcttccttctcaagtgtgggaatggaaatctatgtcacttctttttgttgaaaaaaaaaaaaatcaaattttatgataagtcattcttgttgtaatgaacttttatttaatactaatcggtgaaggactaggtcaacttcgtttcatgaaatcttcattctgagtggttaacaaaaattggtcatactcttgaaatatttcgtagtttttttttgttttttttttttttttttactttaaaaaaattgcttagggagtaggtgtcattaagatttaaagagtgtttttttaatattggaatgcatagattatgttatgtggttgagttgtaatttggtggattttggttggacgtgttgtcatttgaaagcgtattaaattattagaggagactaagttaagtggatttaatgtcgctcagtattttgtatgtcattagagtaatgaaactcttactccccaaatatggtgtatggatggaaataagagagataaagagaataaataaatagagaggaactgatagatgtggcaaatgatgtgatggaaaatgaaaagagaaataggaagaaaaatgggatagatcatagaagtgagatggaagaaaagttgggtgtatgtttagtattttcctattagtctatgcagttctataattgtattctttttatccccccccccccctctctctctctatgtatggatttgggattcaacggaaactgattgataattatctatgtgctgatctaggttagcaatgctcacagttggacgtgcatggatctttatatttttgccaccccttatcgtgtaacatgggattattatttcctggcccgggagcatacgcttgagttcaaagagtgggaagggaaagctgagtatgagtatgtaagtgaccatctttcttctgtacactgtcactaagtagagttttttgaaacttgaaacacacatttttgttttggagatccttatcctctttgcaatcaggtaaaaaaccatgggttatcaattttcctcttgcaagctgggatgttggggacccttcaagcactttgggaggtattgcctctatttacaaatactggatggggggagaactccaatattaaatttttagagaagcatatgggagcttcttttgaagtgcgccctcagccttttgttacaaatgtcagtgctgatgacattcattctggagatttccttgccgtttcgaaaattcgaggtcggtggggtgcttttgagactctagagaagtgggttagtggagcttatgctggtcacactgctgtttgcctaagggactccaatgggaagctttgggttggagagtcaggacatgaaaatgaaaaggtaaaatatttaagttgcattatatctattggttctgtgcaagatttattatatttcatagcaccgttgtcagtatcatatgtttcacgatacaaaggcatacgattcgatttgagcagttggtgactcaattccttgagtgaaacattttgtgcttgaatcaccccatgaatagcaggaatcacataggaattgtagattgcacatgaatcatgtgattttggtgcaagcgaccgcacaccaaagtggttcgggttatgcaggacccagttttgaactttgaagaaccctaaaattgtttttctttacctgaaaaattagtgaaaaagagagggaattggccaattctttccctctaatcaaccgcatggcagcccattgtctccttttcatgttttctactcattcttcttgtcttctactcttctttacctttcccaatctaccctacatgcaagctttgtggtccactcttatttagggtggtcatacactcatactgctgagtttgagcagctactggttttttgtccatatggctgttaagaattggtgattttttttttttgttttgaagcttatgtcactttgtaagcaatttgacttcaaaatgctaacacccccccccccccccccccaaacacacgtgtatgttttaacttttaatatgtttccttatgttaaaatgctcctatgtttatgtttttttaatgaatttgtgcttttatgtcttttttagttgtatatgttatgttttatgattaatcatacagttcaatttgctatctggaaaataggccttccggttcacaatttgaatctcaatttcactaccatgtttcatagtcaattttttttataatttcattaatatttatattttcttccttaagaaaattaacatttcttgaatcctatgcgatgtttaggttttgatataatttatgaagaattgttttaagttccttaagttaccatgtcgtcatcagaatagcaagattatgctctcagtttcagtttgaaattgtgataaaaagttagtgcatggtgattaccaagttaacatatatagattttcttttatgacataattcatgatggttgtttgattgtttgagcaatgatggtaaaagtatagtccatattggtttgtcaactccgcagcggcatttggagttaagttgctagcattttatttcctgcctcaccttttgtttgcagggagaagatataatagctgtgataccatgggaagagtggtgggactttgaactgaatgaagatgattccaatccccatattgctctgcttccattgcaccctgatttgcgtgccaggtttaatgagactgctgcatgggagtatgcactgagcatggcaggaaaaccatatggttaccataacatgatattcagttggatagacactttaaatggaaactatccaccccccttggatgctaatgtggtattaatttaatcagttgttctgcttaaatttcaattcatctgtttcattagattcaactatcttgagtttttgcactattatgccatgctttagcattttttacctacaattttctagcaattgtatgaaatatttcaaacagagaattatataaaccatggctttgatcttgcaagaactcaatgagctttctacttaagttgcttgaatagtataaagttttgcttgaattaccgtaccatatgctggtttatgtatagttatccgtctgccatccagaaagaccattgctattgaagaaaatgttatttcacataaaaaaaaaaaaaagtgatgaatgtggtatcaattattgattgtttgttttctctatcttctgccctttctgtctttttttggtttagccacatgctacatagcttaatgttttatgaatgagcatttacttttgttgctctgcaggttgcttgcgttatgacaatttggagtcaacttcaacctgaatatgcagcaaatatgtggaatgaagccttgaacaaacgacttggaactaaagtatgctgcaatcttgtttcttgctccaatacacacacacacacacacttgaaaaaggagaaataataattttatttcttgatcagaaaatgtattataattaatgctgaaatctcctaaatgtggaaactaggaatttaaataatacgcacagctacgcgaataattcacatgttacaaatgtataacaatgtcatcaatgtgagacaacacaagttggtgaatggatgtctacacacacaaacacacatacatatgtgatactaaacatttttgcttatgctagtaaattgaatcaatgtcttcaattgtctagcataagtcataagatgcttgtgatgtgatatattgcatagattagtaagcaatcagcaatatagaattccacattagtgaaaaaaagtgaaccatgtggcccttttgtgtttctacagggacttgaccttccagaagttttagtagaagttgaaaagcgtggatcatcttttgatgaactactgacgattcctgaacaagattattggacctacagtgatgggaagtcgacttcgtgcattgcttatatacttgagatgtacaaggaggctgggctatttgatccaatttctagttccgttcaagtgacagagtttacggtgagtttgctgggaagtttggtcttttgaattgcttgcaatattatagtaacttttgaatttcatcctacacaatttatacaaatgattgagcatatataatttcttatcatggttgtatagatttctaacaaaatcctttacaaagtgaaatcaggttgttgagcaggattgatatcagttcactacatatattgtttgtgtttctagaagtcaaaaacactttacagtagtatattgacctggcgcatatagacttatttttgtgcaataagtgcagataaaagatgcttacattctcaatttttttgagaacaattctagtcgcttgccaaaatggtgcaatgatggagacacggtgaagcttccttattgtcaaattaaaggcaagtatagaatggaattacctggatacaacaccatgcaaccataccctcatatgaatgaaaagtgtccatctcttcctccaaagtactccagaccccagaattgctagcagtcttcaattttttcctccaatcgaagggctgattgcgtgtgaccagagtttttggtcttctagctttggattgcttaggagatgccaaatgaattattgtttgtatccatttaatgtaaaaagaaattcaaacaattcgatatcgtgtatgtatttattattacaaacttgaacttatattagacattcatgtaattcggattatctatgtagccagattcaacagtgtaaatataagggacttgaatatatgtacatcatgcaaaattaactttaataagtgctatgtaaaatattttgtaagtcttgcatctgcattttttctctctctctctctaaaatgggtttggcagctttgaattgagaacttcaaaaactgtactgagttgtgaaagtagcaatttcgttgtttagtgtttactccaattcagcactctaatgtaagtgttacctgcttttaccatttaaagaacatagacatttgcagatagattaacgcagcgcaatacagatatatcacttttcaaatccggtataaccatgtaactcggaacattaaacaaaggtaagttttctaattttttatttgttttattttatggtcggtgcaagagaattaatcttgcatggccattcatgtgcactgttttgcacacatttccatctttttcatttcgcttcctcttctctttactttcttcatccccatttgatctcttgctcgacctcttgctttagcattaggatttttatactctaatctaatgtagtatgtttatgctctcaactacttttctttcttgctttattttttctctctcacaacactattaatgtctatcattttatatatgcatcaacgtatatctaagttgttgcagcgaaacatcttttagagttgtctaaattgaaggacccttaccaattatatgttttttcacttgaattgcttcaatattgtataatttttcctttgtatagggtttttaatggtcctagactcctactgttctgcttgaatttttccatgttttttttaacattttgtaaagtattttatgaaactcataacagtacgaaaaatacttttcaaaatacaaattaatacttaacatttcggaaagtactttcttagatgtttaaaacaaaatattattctagaaaatacattttggaataatggttatgtaacaatgttatgggtataaagggtatagttaataacaaatattaggtttaaatatttttttcatccctataatttaatattttttttttgctttcactcgtacaatttttgtttcattttagttcttgcaattttatttttaattttcgttcttaaaatactttatatatcactttgaatagtaaaaaatatattttaaatagtaaaaaaagtgttatctaaaacactttgaggaagaaaaaacacacattttgcaagaactggaatatattatttttttcaaagacaaaaatgaaaaaaaatgctaaattgcaggaatttaaacctaaaaattaagaagaagagtgcctctctatatatgaggtcctgggtggtcgcccactttgactgtgtttagggccatcattacttaggcatgcatatttgaagtcaatggttataattgatatatatgtgtgtgtatatataaagaaagctatagaagtgtcttgataattctagatttttctataaagctatagtagtcacatagataatagaaatgtctcgatagttcttaagttaggaaaatgctagaataatgtataatattatttaataatccacccacatatgtagtcagtgaagtgttgcctgtaaatatggaatatgcactctgttgtagtgtgcttttttgagagatcaacacaagctcctccactattgttgagagctacacggccaattattcactattacacttctatacaattcccttgactaagtcaattattactaacctctctaaagccaacgtcaacagccattaaacaatcaatccaattatcttattcctaaaatactaacagtactagtggttatgactgatgagttgatatgcgtgagaccaattttgtaggagatggaacttgctaatacttgtcctatgaaactgcggggtgatcacaaccaagttgtcattcatatcatcacatcaaatctagtctttcacaaaagaacaaagcatattaaggtagattgtcccttcatctgagataaggtccaacataaatcttgtatctacctcttaattatgtcaagacagatgaccaactagcatatgtatttgcaaaagcttttaatgaagtgcatagaaatttaatttgttacgagttgggcatgaaaaacatttatactcccgtttgagtgggagtgctaagagtaaagttttagtctgtatacggtcttgacctatgtgcttgtatgtacttaacctagtaatataaatattaggtaggagtagttatacattataaagtacccaattaaagtttactcatatacccctctatctctatctctctccctctttcactttctctctacaaaatagaaattaaagcttactcaatatcaggtaaatctgatacacatgaagacaacatacaccaaataaataaaactaaaataaaaatatctcagacaatggactgccatgtcttccaaactttggctggtgttatcagattgtgtttcgggagattgcatggaaagcaaaggctcatcatggattgagaaatcgacctctcttacatcaacatcatcaccagatgttcagggatgtcatacttttgacaaacaatgggtctacaatgccatattatacatcatcaccatattatacacgctttatgaaagtcaaagaatatgaaacacatacaacaggaagcaatttaaggaagactaatcaaaattgtgctatatattttcgttcaaacacaaagatgaaacatcaactctgcggctacagaaatttccacaattattattaatcctaacttttcttgaacaatttcaaacatgactaactatgtattcaacaattttaaacaatgtaaatgaacagatatcaatataaacaatcatgctaattttgattcagtgttgcactgcgtggaacctaatgtcgctgattgatgttgtgagggactgaatgatgcaaccaaattctggtggtcaatgcggtgagggacggggtcttgtaaggtaatgtcattaatacttcttctttgacctctattatcggaggcctgacgaagaaaatacttttgggcatggctagccacctgagtaggagttcttgtcttgacaacctttcttgaaatgtttttccaatctcccttttcatataactcaagtccgtggagaaacaacctacatattggtataaagatttgaatcatgagagaaaaacaatgaaacagcaatattaagaaagaaaacactgagagagagacaaacagtacaggtgttcttcttcagtccatctcctgtgctcacgggacttccgtggaggaggccgcgagtgatgattgatctgagagcttggaaattcaacctcggctggcaacaccggaatggaggtgctgtgaagaaacggagtgagagtgttattcccttgatccgatggagacgtggatagagaaggaccctccgacgagacgagtgcctccctatgatgatcttgaagctcactgctgctgttccctcctaacatcgttctcttctaacagttccaattcaacttttctcctttctttctttctttcttcacccactgatgcagatgcagagtgtgtgtgtctctgttctgttgtttccattatatagggtttggcattagcgcgcgccaaatcctctttcctcctctctcttctaacggctactttcttatcaaatggcgccaatgccaagagaagcaaatcttcaccgttggctaattattaaataaataagctgttattaaataaaaacaatccatgtagacatattaagattaaatatatttttggcgttacatgggatacactcgagggtatttgctaaagtttaattttagtagaagggcatcaagtccagaacttttctagatttctcgagcttctacgatcgtgaagaacttgccaactagtctagaatcataacggagataattcctattgaatatgaggcacaactattcaccaaggctttaatagcatctccagcggtaattttaggtgggttgtttcttcttttttttttttttttttgacaggataggtgtgttcttgaagttaagaattgttcttaactgagttcaccattggatgaggatgaagtggatgcaatatgtgagaatcattcgtatataagaatcagtctttttttttttttttttaacgaatataaacagaagtagcctttatcatccaaagctgtaagcaacttatggaccaatttcctcaattcaaagttgaattggttattagacaagttaatgtagttgtccatttgcttgcaagggtaactactgttaatgttagttcccatgattataatcatattccttattttatacggtctttcatcatcaataatatgagctcattccgttttatgtataaaaaaatcagttattaaccatcaaaaataattaagagatgactaattagacccatttaaaaaaatacaaaaagtgctaacttgtgagatctattttaacccacgttactattgaagatgttttaacaatatgtttataaataaaatttagcttggtactcaaagctataaatatatttttcctggatttgaaaacatatcaaaactatttttctcaaatttgaattgtggatataccgcaaagagctcatgtagtattttcatttttgagcaataactagcttattttacttcttaggacgctatccttaactaaaaaaaaaaaaaaacttctcaaagttatgtgggttgggaacaaaatatatggagctcaaaagattttttagaattttaaagggaacttagaaagaatcaaaatcaaagcaacaatgaaaaacatggaaagatgaagaaaatgagaggaaattggctaattcggtaggaagaaagggggagagacactattttctttctttttattttttaaacttaggacttatttgataatccttttaaaacagtttctaattttgaaaataaataaatgtttgataatgtgttttttatcaataaaacttaacttttttatttaattcttattttgttttctaactttaaaatctgttttaaaacagcctcaccaaataaactttatctcccttctttttttcaaaacacaattttcaaaaatgattttacaaattatattttaaagaattttcatcacaagtttaatttcatggttagataagcacaacaagtattagctaatgcaataagcaaaaatttaattcctgggaggcacgcgttagaacctgatctagttgttgacaatgtaatttattccatatttaaagtagactcacaccaagaaatgtaaatttgttgaccagtcaaataaaaaggcttgataaatttcaattggaatttccatcgagtttgtcgagtatgcaacaaataagagccagttttgaatttaagcaacctcagtgataaggtgtgctaagctaagagaaaaaggaaagtagaaaataaaaagagctgcttagagagtgatgaagtactggcccaattctcctacgtgtataaagacaacgacaacacaacattgttccatactttgaaatcactaaagtacaatgatatatcttaaccatctaaggcatgcagatcaaccaacatatctgtattatagtaagcaaatatatgatatatcattatatcatcactcagccttggtggggagatggttgccgccagtcgctaatttgtagagataaaacagagtcatgagagcactgcaagaaaaagacagacaaatatcttaactccatgtacaaactacaggtgactgatgtggagcaattggacaaactcacaaaacataaactaagtaatggctgccagtgcttgattcctgacttcaaattcagaacataatatatagatcttcaaatcagtaatgggaagttaaaaacaaattttagaactagcagaaaacaagttcaggataatggcacataaaaatatttcttttattctcaaaataaatgggaatggtgaagccttgatcttttaaaaagagtttaaagaactttcatggatgcatttacttttaagaaagacaagttcaaggatttataatctacaaactaacaacttatccaacaattaaaacttaaaagtttaaatttagttcttacaactctgagagtaaaagtaaaactatgtttacaatgagtttgggtacttctaatcaatcctttgattacctgattccagcaacaagaccagcaggcataatcttggatgtttccaaatatcgctgccccatgacccaagttagtatggctgcacaagctgtttcacagtatacaaattagaaaaagaaagcatagaaaattactccggctaatatggaccataattaactcagtgatcatggcttatcagattttttttttttatccatagaaatcgaagacaatgtcagggagtttacaacaactcatgcacccttgctcaaccagagcaagacccccttaatatcatagcttatcaaatgaatacagagtaacagacatacattcccagtataaacacagagatactcattgatcctatatatattggtagtaatttagtataacttatgacttactaaaatattcttgcttaattttgagttttgacatatgataatgcaatgtgatacatctatacccctgctagagtttctgtgcatactttttattactaagtaggagcaatgcaagtcattaacttaatgataataaacttgttatattcataagcattttaaatcaaaaaaattctgtcaagaaattttactttcaatcgaataatatttgttacaaacacatccccctcctttgatcttttatatttatcattatattctaaaacatgggcttatattcgaagctaaagcaaaaagctctagttatagtcttgtaggacaaaccatgttccacttcatcaactatactaatgacaaaagtgtatggggcaagatccaagtctgataaataagcaatggaaatttgaaaaccatgcacccaatatatcttgatcaggttacatacattcattgatgcttccttggcattcaatattgtgcacagacaccctctttcagatctatgtatcactttccctccatcaggtagacaccctattaacctatcctaacctaacctaacaaatccccttccttttaatagaaagtagtaaatgaaaaagcaccatcattcaatatctttgaaacccaaagagcatttaggcagagtttcgataaacatttcaacaaacacctaacgcaaatccagagggtaaaataaaatagatcagacttctcccacaagttaaaacaacatatgcatcttaaagttttcataagtcgatacttgagctgcattattttaggagaacatggaattactaatctaaatatcaccatgacatcctaagagagagaatccaaatccagaatttcatacaatccgaaaaaatgaatccaataaatatccacatctttccatcaaataacaaattctagcatagaacacgtttcagatccagaatcatcgagagccaggtcaacaatcacacccaaaataataataataataataataataataataataataataataataataatgaaaggaaagaaattataggataccggtctctagaaagagagcgaggtaagagttttttcgtttgccgaaggcattgagactgagatagccggcgatgatgagaagcaaaccggagccggcgcctccggcgagagaagcgatgctccctttgcttatgtaggcgaacagtccaccacccactagcatcaatccgtacggaatcgtgaagcagaaatcgtgcatttttctctccttagatgccttcaatcggaagaaagattggaactgggaagtgacgatgggagcgtgtggaatgcacaagtcaaatattaacaccccacgaaaccctccacctgctccttaagaatcattcccacaatctaccgtctcatttttttaaactgttatgttatatttttttttaagaaaattcattttataaaaggagtttattttttattaaatcttaataaattacaatgacacctatttggtctaagggcatcactaatccaagatacctaagaaactcaatttgaatatcatgaaatatataaaatcatttatagtgatcccaaaatgtcatcatttttaagatactcacatgtaaattttctcgagaaattttttttacgaaataggttttaagaaaaacaaactaaatagagtagttttaaaattacttatatgttacgggttgtcacttaggataaggtgttatccaaatggtactttgtgttaattttttattttttagcatataagaggcatcgttttctagttttggttatacacttttttatatttacaacatttaaaaaaacaaatttcatcgattctaaatataattaatgtaaaaaaatatattgatcgttactcaagaaaacacatcctgcatggcaaaaacaattcatgttatataaatagttttgaacataactctatttatattatataagtaatttttttaaaacctactttagcaacaaaaaaaaaagttaaaaaactcacatttttatatttttaaattttcatttaattatgtttcaaacaaattataacaatttataacacttaaaagtcgttacaatatatttaaaatttttcaaataaattattaaatcattgatataagtgataccaaattcaatccttttaaataaagtatttaatttgagtcatgttgatgaataatatttgactgggataaaaaaattcattaaaaatgattagataaattttttaataaaaattaatcatcattaataaatattaataaaaagataaaaaaatttatccaaacaattttttacaatttttaacaaaaaaaagtaataaaaaatatcacgtcatcacttacaacattaaactcttttggaaacaaagaaaggaccaaaatattaaaggaaaaaaagtctgggaaccaagatccaagacccgtttccgaaatattgaagataaaaactataagagttgaaaaaagtttaggaattaaaaatattgtttatcctttaaaattcataaaaaaaaaaaaaaaaatccctattcaaaccgttttagggttttggtagcagcccaagctaataatggtggcttttcttggtacccgaatccggagcatcacctggttcaggttcaacccttcacacagccacaagctctttcagcggagagccctggagatttcgatgtcgacaatgcaacagggccaatctaaaagacccatttgcccttcttgttccaaacccagccgaacgtgtctctgctctcgaatcctcacaccgggtctccaaaattctgtgcatgtaaccatcctacagcacgcgctagagcgtaagcatcccctcaattctaccagaatcgctatattgggcctcaagaatctcaccgttgcaactgtttctgatgttaatttcgaagcccggttcctaattcggttgttggatccgaattcccattccggtcatgctggaaacgagccaactgcattgttttctcgccagtgttgggaaattggagacacccagaaattgctttctgagatagattctaacttgattgataccgatagtgctggaaaatgtggtttgagaaatgatgttggagatgttctggattctgcttctaatgtagaagttgtgaaacaagtgagtatcagtgatggtgaagtggtgaacgatgaagttgagaaaaatgcaattagtctaaagtgtgatttagctagaggtgtacatgaagagaatggaaagctagctgttactgttaccattggcaaatatggtgccattagctctttgtctcatatttggatgactcaagcacaatgtcaatcccccaagttaagctttgacaatattttggcgtaccctgaagcttgtgaagcactctcaacagggtttttggtgaagaagtttcagaggaagcaactgaatagggatgaaaaattggaagaatgtgatgaatttgagcttgaggttcgtcctggatcggtactactatttccctctgataaggctgttgatgttagtaacctggatgctataggttttgaggtgaagaacttgattgttctggatggaacatgggctaaggcaaaaagaatttatagtgaaaatccttggttgaacattttgccacacgtgaagttggaagtgaatgagacaagcttatatagtgatgtgagacatcagcctaaagctggttatttgtccaccattgaaagcattgtatttgccttgaaggcagttggggagttgaatcatgagggtttggatggtctcttggatacttttgagtccatggttggagatcagagacgctgtaaagaggagagactgagcaaacacttttcctgttgaggtcctttcttcttttgattgaacaactcgaagaagttgcttcaacccaaaatagaatctattggcaataagttatgaaccatgaaacttgtaagagttttttttgcctccatatcctttccctgcatgcaaaacacaacatgggaatcccagtggattatctgtataatgatatgcatggagaactccactccaatgagtttattgaaacttaacagattattgctgtgccacatctgctgaacaaggacaggagcagtctgagataaagcaatcagttactggttgaaattgaactatgctaagagggtgggaatttgtatcgatgttttagcacaattatatttttaagattggacaatgcactgaatgatgtctttagaatcaagacaattttgcagtttgtagtgttactactgctatatgacctgacctacatgtttacactgaatggaagacattatgtgattgcatattgctagagtctctcctcaagaaagtaggggagagcatgttccccgagaacttttggacagaatcatggctgctcatgcttgctgatttcaacttcaagccaagagacgttgcaagcaccaagctggaccattaatgattacagaaacctcagcagaaactgacagtgccaaagttacccattttctaaccacttgatgatgatgatgatgatgatgtgaaatagagttaattgttaacaaaacaacatggagaaacaaaacctaaaagagaggaggaaggggaaagatgttacctgcctaaattcaccagatacagatatttgtttagaactcagtttgtattcacactttataaaatcactgtgatggcataaatgtaattagattctatttagcagatttcatgtgttgatgtatattggataaatcagtttcagtacttcaagacagaataggccaacccagtagtttccacttaatgcttaattatccactctgctgtttttaccgttctattcttagattgctgatttacattctatcatatcccatttccctggtatcagcgaacaatgatttcagatttaaggcattttgttagttagaccttcgtgaatcccagtaatcttcacggctttactcgttgcatgactctagaatcataatctaaaatctcaatgtcagtcaagaatataaaacatacatgtttattgctggttattaagtacgctaagttttagttttctatatagaaatcagaaaccaatcttataagttcagacaaaacaagcaacaccatcacttgcaaagtgacaactagccttatacctcagtttactcactctgctgctagtagtgatacaaactaaactaaggacttgtctaatcatcaatatttacataacttttgctaatccacgtagttctgagtttagggcgtcaaaattctgagttcatgtgtcttctgatcaacgcatcctgaactgaccaaagaggttatccagatatcatcagcttttactggttcatcatcatcattcctatgccaactccagaaggcatgagtggagtttacaatcttcagctcaccatgaccaaaactggcttcacggaattctgaccactttggctgtgggtttatatacctgtcaacaaacaattatgtaaggatacatgcagcaacaatgacggaaaaacaaatttcaggctgcatacatgataaacctcaatatagctttttttttttttttttcacataataaaggattcagaaaacagatttctgtgggatgtttctggctgtgaaacttacttatgagctaagccttctctgtttcctccatcaccaatagttatatggacagcaccacagggatccaatcttccattatacacacgtttctgacaatgagatagagtattaaaacccagtttctactaaatggtgcttacagagaaaataaaatgctaaaacataaagacatactgaacgttcataagcgtgaacatgaccagcgataactaaatcaacactggcagcataaagcaatggctccatcgctgccatcatatcatcccctgcaccttgatgagccttgttactattataccatggcacatgaaataacacaagcagccaaggtgtccttttcctatctacctttgacagatcttcctgtagatgagggatgagtaaaaattaaagagtgaaaaaaaaagtggtccaaactccaaagtacttttctttttaaaatgatagagtagtgtaaaaaagacaaataaaaataataataacaagcatgattgtgtagttttccatggtcatggattggattacacttatccaatttttagtaactcttgatcaataggtgagatcaactaacctttagccatctgtattgttcagagtacacatcataatctgcataggagccaagcatgataacgtgaacacctgcaacttcaaatgaataatagagatttgaagttgatccactttcctcagatggcattttccatctggaattataggacacaaactcatccgttaagaatagtatgttctcctcttcatggtttccctctgtcaccatccacggccttgtactcgcaagcggctccacaagtttcccaaaattgtcccacagatgctgcatacaatcagcatatgaaaggtctcctggtagcaggtagacatcatatttacattggtctatgtgtgccagtgttgatttagtccaaccagtttgacccagatccccagccacagcaaaagtaattggaaattgagctggaggagttttgagctcaaactcgggaccttttccaccacatcggtagaagtacacagtattgtcttccaaagggccaattacggcatggtgtatctttcccgagctgtataacagatagttataagaagtgtactctccttcagctattgagtcatatctcccaggcaatgttccgtattctacatatgaaggtgaatgtttatcatcggttatccatgtaactctcatgtgcttgtctcctgccaaagaaatgtgtacctggaacaaaaatttggtatcaaagaaactgaaatttaatagtcaccataaaagaacatgcataaaagactaactaaagaggctgatatgattgcttaatagaggaagcacggttgacagttcacagaatatttgtcctagaattggcaaataattcatagaaagcgaaacaaactgttcaagttacataatattagctgataaataataatcattgtctgtacagatatatactataagaaatcaccaaccataacgaataaaaaatgtcttttgaagatttgtgactagaacccagatcatgaactataaatccaatacaagagtgacagaaaattattggatcaactttgaatttcataaccaaagaaaccgtgcagggctatatcttgaaccccggagacatgctcccatcgtcactgtcttaaaaatcatatcaaagacgatttctgaatgattaacaatatgattttttttattctacgtagaaattaaagtcaacaacttgaaatagagaataattttgaaaatatcaccctataaaaaaaaaaatgaaccctcccaactgaacaacataatccaatcaaaatacgaaagaaatcaggtactgtgagttgatcaagtgggaaataaataacacaaagtgggtgatgatatagtactatttatttatgaatatgaacatgatgaatgaaaaagagtttgattgacctgttgagggtaagaggagtgggccttggaaattgaatcccatgggatggttaaggttttacgaggaagagatcgaacgtattcaggcgtggcaatagcaaaaagaagcgttagaatcagaagaagcagttgttgtttgagttccatgataacagtaacagtaactacctggctgagacaacaatgtacttccgcttcaatctttgtttctatcatcacccatcctcatgacatcaccaaatatgtcgttgcctcactttttccgctttgtttcgtagataaaacgaaaccacgctttcataattttcttaacaattaaaatatatttttagttttctatgagttttattcctttaaaatctgaaatcaatatttttttttttgttttcattgttcatttaaatataaataaataatatttgttaatttaattaattttctcaatactaaaagaaaaaatgttaaaaaaaacatgatactataccatacaaatatatttatttcagtttaatttaaacaaaatcacttaataacacaaataaaatgaggaaatacaacataaaaactgcagatgtattaaactatgaagcacggacacggcaaaacaccgacagaatcgcgtcggacacgacccgacacgccgacacacaccgacatgctccgacatggtgtcggacacgcggtcaacatctccgactcgttgaccgtcgccaacacgcgaatttgaccgtgtccgacactgctctgctcgttcctctcttctcattcccttctcgttcccttttcgcgcctccttctcgttcccttcttgttcgcgcctccttctctccaccgttcgcgtcaccggtgctgctccatcctccttctctccgccgttcgcgcgtccttctcgccctctcttcctccgccgtttgcgctccttctctccctctcttcctctgccgttcgcgctccttctctccctctcttctctccgccgttcgtgcctcacacagataaggtgactgtggacatgtggttgtgttttaattgctattagcttagattttttaggttttctctttttagttttttttattaaaaaaaccatttatgtattctgcagtatttttttaattgcttgtgaccttgtgtatggcttgtgttatttgaacccccaatttctttaattctatctatgaacccctaatttctttgatatatttctttcactgtgaatctttgatataatgttatttttatttttataatacttgataatttaatgtatgtttgaaactgaatcttgtatctgacttgtgctttttttatatttttaatacttgataatttgttaatttgatgtatgtttgagattgaaccagtgaatcttgtaacctttttttgtgctatttttatttttttaatacctaataatttgatattattagtttagtttaatttttttgttaagttattgaatattaaatgaaatatacattatataaattaaaaatatgatttaatattaaaatgtgtcccaacgtgtcgaaatcaataattttttaagattgacgtgtcggagagtcgagtcgtgtcgtgtcacgtgtcgcgtgtcggagtcggtgctacataggtattaaattaggattttagaatattagtttggtataataaaccttttggattttacaagactttggatgaatgtagtgaattttaagattttgtaaaaatatttttatgattaaaactttgtagtttgaattttaaaagatttataacatattaatttataaaatttgagaagattttatagatttacaaagttttaataacttcactgaatttttagaaaacattataggttattagggtcaataaaaaaaatgttactgtttagataaaaaagagtgtaaccaatataaaattttccattatattaatagttaatttattctgtcttcccatttaatgtttcttcacataatttattaagcctatctgtattaaaatcttcttgtttatgcaattggatttgaaccaaaaatttaaatttatgatatttgttaattgataatactgaaaataatgaatcatatgttaattcaattgaaaattcattatcataatgacgttttttatgaagaaatttatgaatgtgtatatcatttttaacgaaaagaaaaatatattatgtgtgattaaataaaagaaaagcctgatcaacaataaaaaaagaaaaaaatattagaaaatctcaagagtttagtgtaataatttgttgagtgttatactaaaaaaatcttataaaattatccaaatttatgctgaaaaattcataaaaaaactgtattttttttaatactatataaggcttttttataagttataaaaattattaatgaaggttacaaacataaaaatgtccaaatccatcccaataaatcactatcaataacattacgaacaatctcctcactgttgagagtttcaaacttaatcatgtgggtgtgcgcataaattatccatgtgcacctatgctggacaaaggtagagtcttgtccttttaatatatagtattgggtccattgactcaaattttatttccattatatttaactcaacattagaaaacccaattttctaatatacacaattctttgatgaattaaacaatattgctttgtatgtttaatatattttggtgaagtttgtctaactgtatatttggttaaagatatgaacttacattttagaaaaatacgaatttagttaatttgctaattatttactcaaattgtatgcttgtttaaagagtaagagataaaaaataaaaagaaaaaatagaagcaatattttaaaaaaaaatgagaaaaagcataagacaaaatgattttaagattttttttctttcaaaattccatgtctttcattttttttcttcttaaattcaaaatttattttttctccctttattttacgagtttgttgcacaaccaattacttatatattttaaagataaattattataaattttatatatctctaatatatttttcaaatcataggatacagattacttaataatagattgtaattatatttaaaaataaaattattagagtatgagataaaattttaattattttgtgtctgataaacataaaaaaatttatactaatgaattattaacaattatataaataaatttaatatcatatcttaatttaaaattttaaaactcacatttataagtattttttttatttatataatgtttaacttttttatatttattcgatttgagacttctacctatatttatatttcaataaaattttataattaaattaaataacatataaataaataaaagaacaaataaaaaattaactatttatttatatttaaataaaaatattgattaaagtggaccattattcagcctgttatttattagagagaggaactacgtcgtttaggaagggacattaatggttggtaaacacaaaaaccctaaaccctaccagcagctcagcgcgaaagccgtaaatcaatataacagttggttctctcacactcttgacttttaagttctgcagacagcaagaagaagcataagcagaagaaccaaaactgaaaccaaaatcaaacgtttaagcttcgttttggtacgaaaccctagcaatggcgtcctccatagcgtcgcaattagaagctatcagatccttcgccaaaaccgactctgaccctctcaagaggccactcactcgcccttccatcttgtatgatcccaaaaaagcggctgacatctccaccgaggctattttcaccgaagctcttcgaggtcaatcttctcatttttaatttcgctcttttcaacatagctagtgcaactaaagcaatccagtaaaccgaattaatttctcagtgattaacatggagcatattcttagaatgtgggtttggacctaactcaaccctaccccaaaagctagctcatagggtgaggattatcccccacttatatactctatcttgacactatctctagacaacgtcggacttgggtttttcttaatacatatgaattacggtgctactttatattctattttcgtttgattttgttctgtttttcttatgtgatgcaatatttcaggcttagagattcttattggcatggatgagcggttcaggaaccataagaacgatttgtttaaccacaggcgtatagagttggatagagagttgatgggaatagaacagaacaatcaacttaatgtctccattgcttcatacttgaaactactttctggatattttcttcatacggccgcccttcaaacgcttgagtacttgatacgtagacacaagtgagctttcaacaatgtattatgaattgttttcttcctaggggtgttgtgttgataatcacattttgcctctgcctagtttaccttttttgtgatttttgatgtggttgttttgagtttcaggattcatgtatacaacaacgaggatttgattttgtgtgctttgccgtaccacgacgagcctgaatttgttcgaatagtacagatacttgatacaaggttaggaagatattattatgtgtttttggtttggttgtgatgtagactactactggttggagaggcttctgatgtttctgttaatttatgtgaaggaatactaaatgggggtttcttgatggtgtgaaagcctctggtgcacggctgcctagaatggtcatagtgcagcagtgcatccgtgataagggcatattagacgctctatgcaactatgtgagtaattgttttgcgtttagttgtgaatgtggaagttctctagtggaatcaaataattatatggctaaggatttggttacaggcatctccgtcaaaaaagtctcgaccttcaatgcctgcaattcgcttttgtactgctgttttcgttgaagttttgggtactgttgtgactgttgatgatgatcttgtaaagaggatacttccctttgtgagtcttcagcctggcattaagggggtttcagatcacaaggttagcttcctaggaaattattttccatgtattaaattttaaaactgattatagttgggtatcatactgtcatatttttgtgattaccttctcattagtaggcaatgtaattgctatcaaatggtagactgcgaaataaatttgctcttttgctctacaatatccaccagtgtaatattattcatcacagataggaatagtagtgcataattttttatgttagtatagtcataaaatatgattatatgactgggtgaccttacttttagtgcttatttgatctgttgaaattatggggttttaggtatagagggagttaaagaagagaatagaagctttgaatgatattctactgattatttgaccttactttttatgttggttgtggtgcaaaaatttggagaaaggctttcacatgcctttccacgtttgggcttgcaaccttagggatattttttgtaagcaggggacagtttaatctctctcacctgtctggggggttttaggtccatcctgtttatggcaccttaattcatgttttctatgtattagtgtgccataggctgggttttgttatcatggactgttttctgctttctttttgtatctatccttttttctcatatatataatatatacttttgctgatcaaaaaaaaaaaaaactgattattacgatgaattgccatgtcttggatggtatattcatgaaatccgaagtactaactcttatttatattaatcatagagcaatcctgagagataatggaagtataggaagactaatcctaaaacataatctaagatactctaacatatgataaaatattttcacatattccaacaatatatgtatacttgtgtatttgagctatgtttcttggctccctctcctgcattttttttgttgtcaaattgtccttatttacaattagcagctggaagctcactttcttgtgctttcttttttggttttctatttgcaggctggttctcttatgatcattggtttgcttggaaacaaaactgcattagctcctaaacttttgaatagtttgatacgtttggttgccgaggttgctcgtcaggaggctacagagttgacagatctccattggtttcggttgtcccttattaccttaattagtcttgttcaggtactagtgtaatcctgtgtgcttgtgtatggtttaaacggaggcattaatccttttttttgttgggggggggggtggtgtaattggtatttcatccaatttcctttcattgtgcaatatctatttctgaatggctatatttttattttaatttgttctgttggaattttcttagtctcaaaatgttgaaatactcccattgaaggccttggagatattaaaggaaataaggtagtcttcctcgaacttctcatcatatgcataatcactgtgctttgactgttgccttttctttatttatatttatgatttattaaatcccttttcatatagggacctggcaggggttttattagaattatctaaggagttcaatatcgaaaagtttctcctcgtgcttttggactccctgattgactgcaggtgtgtttcctatgattgtctttcaggagatatatgctttaagtcatatcttatagaagcttgtgttttatgctgattataacaataacacatttgcagttcttcagatgaatactgtcagcggactttgctatccttaatagaaaaagtccccgtacatggtcttgtttatcatgtggtcaccaagatcctttcaaattgtgtgaaattatcacaaaaagttagcgactcaacttcttccatgtcaggtgtgtattctgattttgaattttagaatgctgatcactatcctgtaccccaaattatatatcctggtgtgcttcataaggttgatctaataattcataccaagagtgaatcaataaatttctgaagaaaataatatttaatgaaaatctcatttggtgattgagaaatctcatctaaacttctgtaaaaaaattgtttgaatacctgtgtgaaaatgttcttctgaattctgaaagcaatgaccatggatgcattttaagttacttggaaatttctttcaccatgaagatcttactttgtgtttgtataagcttattttggaggcgaagaaatttttttggcagcttatctggaaattattccccccgacacagaacttttcaaacatgcaatagatacatgatattaaaagtggtttacttagcagttaatttgttttctatatcaatattatgtaagtaataaaatgtttgtccagactgtataaatagtaagaactggtgtttgaaacaccagaacaaaagcattgcattataccaaatgctgtcatcactctccatttctacagtatgaaaagcatttctcaattaagagccaaactcttggattacgctggttacaatgccttgttttcaaagaatcttactccattctttaacagtttaaccctgtgttgaaactgataaaagaaaattggaatttgatgttgaagtctaatgtgtgccttcaggaagggaagttttatttgttaagaaactacatactcttttttttcaactgtaaataaatagatttataaagaaacccagagaccatgaaagatacttatgaagacaggaaattgcacatactactgtcctatacattaatgctgctaacaatccttgttgataccaactctgttttggccaagtttgagtgtgaaactgctttaaagcagttgaataagtgatttaaaacaaatttggtgtgttgtaaacaaaccctctaatgaactagatatcttcaaattgtgtatctcactatatggcttatgatttgtctatgtgtatcatgcatgcatgttatgtcttcattagtcagtgtactttgttttacttgcttcagcttggaaattcaaatttcttttgaagaagtttcgttgatttctgtgtaaattattattgtcaggttttgctcctgaataattttgttttcttttcttatggtgttttttttttttttaatcatttagctccatatggtttacctttatcttttttactagaaatctacaactagtcagttatcatttgttgcctagcttattattctcataatgttggtttgccaaatgttgattagttgggtgggcaaaaaagattctgtttgttgtcaatacaaaatacccttctgaattacgaggtgctgctcatcatttccttcaggtatgctgatgagttgtctgcttttttgttgttgtcatgcattgtcagatagtatataatggcttgaactttgaacatgttcaacaggataataaagggcattctaagaaagatgattcattgtataaggttttatgtaagatgttggatgggagtatggattcgtcacttggtatttcagactcaaatatttggttgggcctgtatcatccaaaggtatcaatcgttgacctattcttgattattaggtgtatgtaaatataaaagtatgtattctcctgttcaacaatgataatttttttataattgtaagagcttcatgatttatatttgatatggtggtctaggctgatgttcgacgtgctacgctgcttgatttaaataattccgttatcctgaaaaccaaggcagttggttcagaggtatatatgctctgttaatcttctcgtcctcccaaaacctcatgtttccattaatttgtattttttgtttatgacaatgtttgaagaacatctttgatgtgctccttttggttggaaaaaagttgaaacttcttgcttgatgtggtttatttcctttatatatctgtcctcccaaaactgcatgtttgaaatttgtatttttcatttatgacactggttgaagaacagccttgatgtttctctttttgggtggcagaactattaaaattttgcttgatgtgttttctgttttgcacacacacacaatgagggattgttttctgatgttgaccttgagttttattatttgtagtttgggcttggacccatgaatagctactatgcttagggaccctaaacctatatatttccttgtaatctgagtacattgtaacgagtgtgtgaggaaaatatagagaatagttggacgtagcccacattgggtgaaccagcgtaaacactacgtgttattttcttcttccttttcttctctttccgctctctcgattgttgtgtgattgcttggtaccaacacttacatcattcagtaactttttattggataaatttatctcgttacccattgttggattaaaagttcctatcatatctacagaattttagattaattcaattttttttatacatcattcagttcttcaaaattaatgttatatatacttctgacatataaaatcaaacccattcgattttcttcttattgttgttcatattttagaagatttgacatagataattttggtaatatataattataattcaatagttggcaaaaattacatttcataatgatgtaagagtaagtgtgatttacaacggtgtaaattaattcctctttaagtgtgtgtaatttctgatggtggtggcatattacttctctttgattttttatttttatttttaggaaatggttgcattacaaaattttgctgtcaaactagttttatttggaaatattttttgatacatttaagttccattttgaatgatttgaactgagatgcatttgtgatctaatttgtcaaggccactgattttacacattgttggtgagggagggtataattgatttttgttagaaaacttcatttgaaagagtaggtgtacaaggagggaggagtatatatccctcaaaagccacctcaacttcatttgaaccgagccaggtaataaaggcttagcaaaaagtgaagaccacagaactcaatattaaaccctgatatctttacaacactgtcaaaatgcaaaagtgaaacccctctgtaaactgagccttgaaccacgatgaactcaagggcacaaatctgtccaaaagaaagtgtggtggtggaaaatgctataaaaatttattgcatcatgcttcattgtcaaacacaaacaccaattgctagtaagaagtactcagtaccaatggtaccattatttagtacttggtatgctataattaattatatttataagccataaattaattgattatcacgtgggttatgctgtttttatgtgaaattatgggttgatttcatgttgacttagggaaatctttataatatggtcaaagttcttgctaggatgtgttaatactgtttttccatattcaaagtcttcaacctttagctaaccccaaaagtcatcttttttatcagaatcttgtaagcatccaagaggacatcttaagacagcttgatgataaagatctaacagttgttcaagcagctttacgtgttgatggcttgcgaaatgtaatagattcttctaagcttcttgatgcactacagaatgtgctaaaaagatgcactggcaaactgctgtcaggtaatttgtggtatattaaaaataattagatagatatcatctttattgtttctgcatgttgtattgaagcaatacataccatgcatcgatttatccataaactgggaaaaggaatttgttctttgaatgcattcttgatggatgatgattgatgactgttaggggatggtggggttacgtgcagaatacagatgtggtctcataaatgtctaagcttccttaatgtgtttccaatggttcaaaatatgcttatgcttattcttctgtgtattttgggattgatttactctattgaacttatattatttcccttttctttttgaagggtgtctggttgtccatttttatgtttattttatcaaaatatgcttttactttatgttgactagatacatataagcatataaccttcatttcatacacttattccagttgtgcttctgttactggagtatatttgtcctcattaagttatggctagttgtttcctgtctttgacaagtaaacttatttcagttctgttgtaaccatggataaggatgaatttggcttcccagagatgtttgtatttagatattctttaaacaaatggtctttgcttggttccttactaatgattcattcaacgatgatgcatctatcccaagattgggtgggaggattacataactgaataaaaaaaaattatgctcttaattcactgcatgtattatgcacccattctcttcttgtaggttcagctgataactatagtctaaatgttgaagttgctgtcacttgtctaaagaatgccatctcctacttcagtgatcatgctgattacttgaagaatgttgctgctatgatttttccattactccttgttctaccacaggtagtggttaacatcatatttaatatttgtttttcggatagaaaattaatatattttgatcttgtacttatttaatagcttttagattttcccgtctctgggtaattatcaaataacaacttattttgccatgcgcagacacagagcttgaatttaaaggctttgggacttgtcaacaaaataaactggccactttatcagaatattgttgtatcttcttttggagaaggggtaaatatctactttggaattagtttgctataaatttaacgtacacttacaatatgaagaaatttaattctgttgctcaacaaggcaaatttgtcaaactgaagatcctataaagaattttccaaggtgaactgaagatatgaatcaagcattaggtcctgtctcctttggaaaaccaaaactttgaaatttgaaatgcacattttttacagatattatgtagggaataacccaattgcaccatgaatagtctagtacatgaacatgatatgttactacttactagtagtacttgtagtgtgggttttctaaaaagatatttttggtttcatcatatttctaagttgttaatcagtaatcacaacaattcatgaatatgtttatgtcagatgaaattgtcaatcatcttttactttagtgactcttgaagtaaaatcgcagacattgatacctggaagtttatcttcaattaacttgaagactattgataacatggctaagaatttcatggtccatcccaaagagcatatagcttggtttgttgaaagctgcagtgatttggagttgtcaaagacactcttcttttttgttcttttgcagtctcttttgataaaaccaaaaggtttgttttccccttctctttttgaattccattttaatatttttcagaaatagttaataatcttatatcgtataatgactaaaaacaagtaatgtttgaacaaataagctagaaataaatgtttgaagcatatcttatacatcccatagttgtacttttgtcttctctattagatttcttagccaaaaaatttcaagaggggactaaggaatgataaatattgactttttccttttgatcaaagatgaagacatttgtgcactatttgaatgtgtatttcctattctaaaggctgagtgggaaacgtcagtgacagctggtgatgtctcattggatgaggtacaaaggatttactagcatatttgtgcttttatttcattatttgtttactttttttgtaatgagaagctaatgttttacttctgttttgattgttgggaattcgggttgttttgcagttcaagtctgaagtgttagactgggattgcagtgcattctttaatgatcttttgtatgtcaagctgagccatcttaatgtgaagcttatgatttgcatattttggaggctagcacaactaatatcagtactaacttctgacattctgcttgtaagtaattcctttactatttgtaatcctgttatctattgtcttatgaacttgctttccttcttggaatttgttgttgttagactctcaccgtcaacattggttggatattaacctttttcaaaatgcagcatgacgatgataagtgggtcagcaagataagggatctgtttgtattttttgcttcatctaaattgaagcatgcattccatgaacacctccattacttagcagcgcagtgcagaatatcacctccccgcctcttatctaagtttttcacagaagaaggtgctatacacttattccttttgtttgatttttcccatattttacttggccaatgttgtgttccttctactgtgaaattactgcctgtgttatggtgtagaaaatgagaaagaaaattttctgaatgtacttgattgtattttctacccagtagagtgaactgtttatattcaacaatattgcaaagataatcaatgccgaaacaatttaacaagagaacaatttagatgccactacttcctaagatgcattgatcctgactataccaagtatctaggatacttggaaaaataatcattaaaggagctctattctcctaaaatgttcgtatttcaaagggagagaatagaactattttttctgtaattatcatgatctctcatgcataataatgaatacacgcagacacacatatttgctgtttagaaggtacaaaatttatatttgtagttattctctttctccttttcctattctttttactccattttcaattattttgtatatccctgataaatccttccatcccccgttaggggcattttcatcctgaccaatccatgtttaggtgttaaagtggctgttttgtgttaggctttctgtatcctacttgtttgacttgtattcagtcagaagtaagctgccagtttttagttagagacagttatgggttcactctattgtaacagattcagaggtgatacacttttgaatatgttttgatttcagatctagaacaatctttttctctcaaatctctcttgccaactttctctttggttcttaaaatctaacttggtatcaaacgctgtattttggtgttcatcaatggtttccccttcaaattcatttaaaagctaagatattatcctaaatctgaaagcacctccaccaaaaactcctttgatccttgcatctgctcctttgatactttcttggacatgatttctgttcacttggatgagaagaacttattccatcacattttctctccaaagcagatcaagatatcggtcgagtcagtgaggtttatctcacgtcaaaagagcttgtgtatatctatgtatgtctgactccagtctaaagcaataatattttttgcattactacatataagcccaactccagtttgtttcgtccatctatgcaaatgcaattaagttatagtttttttttttttgggggggggggagggggagggagttgattgaaatcatggttgtttgaattgatatttttaacattttatgaatcagaagtcagataaaattcaattggcatatttgatattttttggttgaatctttcattctgcaggtgttcctgctgcagtccaggttgaaagtcttcaatgctatgcatttctttgtagcctgtcacaagataaatggcaaattgaacttttagctgaatttccttctgttcttgttccattggcgagtgataatcaggtatgattctttgttagcgttactctctgaccttgtgtggattttttctcattttctgcaaactgccaatttataattgttgacaaatggttatcctctgttacttttttggcttttttctttctgagaaaatgtgctcaaatgatttctttgcatcgttttgaattttcttccagactataagggttgctgccttgaactgtatcgattcattgcgtacattgtggtgtcatgttgagcgttctggaaagaaaaatggtactccattgtcagaataatttgatgtagccctcaatgcctaattaattttaccttggaactttataagtttctaaattgatatgaacaggtaacaatgcaatgtggatccattttgtgggtgatgttttggcgttgatggatcagcaaaaaacattcatattgtctgacaagaaatttcttccctcattgtttgcgtctgctatgagctcatcctgtccaaacatcttggagcctcgaaatatcttggtacctcaaaatatagaaaaaaggtatttatgatgttactatgacaattatcatttcattgtcaccaatattattaccttagaactatttgttatattcattgccttagctgctactcatcaaatatgaccatgctctcttgttctgttgttggaattagctagatcttcttaaatgtggagagcagcattccccttttctttttaaaatctaaatgatataatgtttgacaactgacagtaaatttccctttgtcacgggaaatgatggttctgttgctgttcattgtctccattgtaacaactcaaagttcataaggattggagggatgcatgacacaaataaagtcatacagggaaggggaaagtaaatttaagggtgggaggagaaagaaatggaaatttaggtagatggcatagagggttctctaggaggttcattcaatgttaaatgtgactatatatatatatatacatatatattataaacagctgagaattaaaatggtactgaaccaatgcataaactgtaggatggaaccttaacttgacagttgaatgatcctatttttattcaaaacctgtttattcaaaatcctaacttagtacaaatgctaatcaattatattgcttataaattttgtaattatgggttttcacttgagagctgtttttatctattgtgttgttctacttctttattatggttgttctagaatgattgcttatcttcttcttgtccttatttatttcctctagatgaattcttcgataaacttgaaacaagaaattatgataaattccaaactaagcaatatgacactagtttggagtattttattaaattgcatccttaggctttagtgtgcatgtgtatgtgtctctattatatgaccaattgacattaagtgtcaaattttatataacatcaaaccctattccttccttctcctttaatctaaaaaaggccaggattgattcactgaaccaatcacttgattaactgttttctcttcctgctacatgggcccggcctttgtatttttattgcttttgattcttttttccttgctgagtgctgacgagattgtgataagagttcttggctagtgtttccttttgggctatgaagatatagccatgaatggagtcattgcaaaaatactaattgtaaatatactctcttcctaagaaagttcaagcaggcaaagttgctttatgtaccatacataaagacaagtctctagtagagactctctacaatcaaagaagccagcgaccattaattaaatgaaaatatgacattataaactagaatctcataagcgtcccgaagcgatccttttgggtcaccatgaaagcattaaaggataatgaaaggtaggatttggtggcaatataaaatttgacacatcatgtacagtcacatatagactttaacattgttttattttctttacatataagctttagtgtttttgtttgtttaatgttacgtgttgtgcggcttacctttttagtggactttaagctgctgttttgtgttattgagattgattgttgggatagaataggtttagaatattctgttgttattggttctgatacttacgctcattgtttgatgcatatatctgtgagtcttatcttgtaactttccccatcttacttttaccttttcattttgcttgttagtttctgtttttatttttttcaagaatgttccttatcttcattcattaaaaatgttcatttgtactaatttctaagattctttattccactttgttcccaaacatatcttttcaggtttgaccagcctacaaaaataaaaattcttggcttcattttgggttccactcttaaattctctaactatgggaaggtttgatgtcttaacgctcttctatgtttctattatatttttagttgtggagatagagatacagatcaaggtttcatatgttcagttccagattaacagtgttaagtgagggttttttgtgctatgccgagactttaaggaagtaacttatttgttgatgttggatgcagctaatgattttatccttattcaaaggaattgggaatgcccttatgcacgttccagaagttgggccgttgttgtcttcttttctggagcagtactataatgagctcaataagtcttgtccaaagttgtcaaacactgaaactcagataatgtgccttttgctggaggtatgtgtattgtatattttagttttagcttatgggatctttattatgaggtttgatgtgaacttgttcttcttcatgcgtagagctgtgttatgtcatctccctctggtggaaatgatcttcaacatcttttactgaaagctttgcgggtaagatattaagatgtgtgttttacttatgtcatgtcttgttattttgaatttactgacttcattcttgggatctttcagttgggcggcatgacatcagatgaccctgcctgtgtaaagccttgtatcactgtcttgaacaaacttaacaatcaattctatatgaagttgaagaatgaagtgaaggtcttattggcagtatatctatttattttcagagtttgttgttgtcattcatgataattgatgagtatagctaatgatctagttaatgagtttatgataatctgtttcattgtgtaaataaaataattatcaccaatgtagcttttactgtgacctaaactaatagttttttcttatgcctgtcaggagcatctattttgtgagctcgtgattttgtggcataatgataatggtgatgtacaacgtgcaactaaagaggcattaatgtgcatagatgtgagttccttgctcttgatcaaatatcatgtgttctgtgtgcgatttctttagtggttacttgcaaagaacttaatcttttggtattattcaatctggacctttggggttttcatccctttaagaagggtgtttattttattttatttctttttccggggggtggggttgtggatcttggatccttttcccctttactgtggttaatgagctccgtagttttagctttgtgctctctgattctggacaaatcatggcctctctctttctatggcagtatttccatctattcccaatcagaccgtgatggtttctggctgttgaacttggcagccttgtgttctatcctccgttatctgtgtcactgttctgttctgttccttgctttttatttgatagcagatttcactgtgaaacaggtgtttcatcattatctgctgggtgtttagcttcaaattcatcaattgacaaaatggatgatatgtcattattcatcaattgattgtagatttttttaaatgataagataaatgttttcttttaaaaatccttaaacagttaatatggtagtgacctgaggataaattttaacaatgtaaattccattgttatctgaccgaagcctttttggatcaactggttgttttgcactatcaatgttatttgttgtttgttttgcactatgctcttcaatgtccaatctcaccttgtggggtaagaatttgttgttgtttcttttcattgtatgggaggttttttccaactttttattccacggaaggaaaaaaaagaaatgaaattaagaataattggtggatatattggaattgcagattagtttctcaactgttggccacatgcttgatcttatacttgcacagaagagttgtataagtagttcagcagaagaaaagatggtgaagaaacaaaaattcataggacatcaagaagcaggatatcctcctaatgacatattcagaagagttaatgcagtctacatccttagttcccttcttgatgttttgctactgaagaaggacataacaaacaggtgacttggttacttctgaatctgaacattacattatgggtactgctgagatgagtagttaaaacatttaactgtgctaaattctcagtttgattgttgcaggcatttacttttagggcccttatttaagcttcttagcaaggtattttcagaagaatgggtgaatggtgccttttccccgaagataaagttaagccaaccttcaagtccttcggaagccaacaattacacaatatatcatattcaacagactctgttgataatcctggaggatataattatttctcttaaaagcatggatccgttaaatgtatgccttgtgaagctggaaaatttattatgttgttagaaatattattttgactaccttttcactattttagctatttccttatattattaagttttgccattgttgacaggaaaaaatgacaaatgaaattaacattaagctattgatagagtgcgcccggaattccacagttgcagtcacccgcaaccatgtattttctgttctctctgctgttaccagagtctttccaggagaagttttggagcatatgcttgatattctagaagttattggacaagcagctgtcacacaggtttgttaatacagggtttccctgtactgaacttagggcattcttttggtagagtagcttattagatccttttcttccctggggaacaatgttatttgtgtagaatagcttattacatccttttcttatgtttccatgcttgttggaaagttccacaactcctacctcgattactagggcgtggtttttatacttgtcggacaacctcacttaatgccaattagttttaagatgaaatctaacatggtatcaaagcctccagccatttctgtcatttccgagtttcctttgtgcatcacttggtcagcaggcatctgtggaaggggagggggtgtggaaactggaaaatcctacatcacctacctcaattgttggatgaccttacttattaactgttgcaacttaacttttagttgcagtatttaatagaaattcttcacaattcaatttattagggactaataatccagtgtaggaactgtggtgtcatcatttctcttttttgtgtgcctgtagattgacagtcattcgaagcatgtttttgaggatcttatatctgcaattgttccgtgttggctggctaagacagatgatgtggagaaattactgaaggtttgtttttcacataaatgatcttctgctgcttgatacaaaagaatctcttagcagttcaacctactaatatgtttttttttcctccagattttcatgaatatattgcctgaaattgttgagcacagaaggctgtcatttgtgttatatctattaaggtattcttgttctacttctacatcatgatcctgctattgatacttcagccatcggttttttgcctgtgtcttataatgatggctgttttgcagaactttgggtgagggtaaaagcttagcctcattgcttatcctacttttccgttcattaatttcaaggaaagctgcctgtttccttaatgttgagatgcaagatgttttaacattttataatgaggagtgggaatataaatttgcagtgcaaatttgtgaacaatatacaagtacgatttggcttccttctttagtcatactgcttgaacagaggggaaatagtgatgttgaccaggcaatgtttctggaattgtttattgtaatgcaattttctttgcaaaagttgcaagatccagaatttgtgtttaagttgaaatcaggtgaagatacctcagtcattcaggtataaatccatatcagatgcatgctagatacttgtatgctttttaatgtctttattcagttctataaggcaaagtctagatgtaacttatattatgatttttatgaatagcttctatttttgcctgacccatgcccaataatgactagcagatacatacagtatgtttttgagatgttgatatctcttaactcataaatttggggatactatgttgacacccactggctgcaatgtggcgtcaccacccttgctgcttgtgtgcaggctaagggacatggtggaaagctttgataccaattgataagaactttgggagagcaacaccacaaaagctagccgttgtacttagttagagagcccgaggccttataaacctcgctagaattgcatacttctaatgtacaacttgattcccatagcctgcaattggatcctatcattaacatatatcttccctgatttattaattgaaggaggtatgtgtggggtaaaaaaaaaatattgaatgtaagtttaaggggtgtcaatgtaatttgcctgacaaaatagtatgatacacatgatgaagttaaatttctatcaatcagaaattgtgattttaaggtgagggacagatcttacgaagatatcgaagcagaagcagatttcatattatgaactgaaatattcattctttgtagaagaatttatatcatatttgttttccttttctttgtaggtttcatgctgagatgctgtctttggttttagtgtgagtgcaatggcattgatgttgcatgcttcttatatttgtgttaatgttgtgatctttgaataagcctataaacacttgtttttttttagatgaacatatttatcagaaattggacttagggccctaattcaacccgaccaaactggcttgcaaggtgaggactgcccaagcttgataagttctatttaaccacatgtctagttgatgtgggactaaattaccacccttgaggttgcaattaaggcaacccccaaagaggccacaactaaggctaggtgtgactggaatttagacaactatccaacaatattcattatcaaaacctgaactgaaatattctttgtagaatatgtcatattttgttttttctttgtaggtttaatgttgagatgctgtttttggtttcttattgtgatagcaatggcataagtgttgcatgcttatattttttttttgttttgcaaatgttctaatctttgaataagcctatattctcttgtttatttagatgaacatattcataataaaaataaatgtgatcgcttcttgaatatttcagagggcattgggtgcgcttatggagcatgttgttttactcatgcaacttgtagatgcaaggaaaaagcaactgaatttccctgtaattctgaggacagagttgaaagaaactatgcatgcacttgcaaggaatctaacaacagttatgatacctgtcatatactttgagagcataattaaattgcttcgccatgcagacaagaatgttggaaaaaaggtatggtttttaatgaagttacaaaatatgagattttattaggatcttgtattattttgatacaagggtaaagtggtaaactacaatttggtggtgtatttatctgcttcatagtattctattaaacatcctgattttcaagatgtgtacttaatttggtgggtatactgtatacacagtggtcatttattcttttttcatatgatgattgggttttattcacatgttatgaatacagttggttctatatacactgtaaattgtttagttggtattgaccacacatcttggtaaattatttatttgccttttaatatgtgagcatgagcgcacaataagaagccaaaaatactaagggggtgattacttgcacttttgtttcctgttttcattttctgttttcactttttaattacaaaaataccaccttgttttcaatctgtttcctgttttcatttatttgtataggaagcgctaaaaacttttttccccctccatttcctgatttgacaatcggaaacaaattgaaaacaaggtgacatttttgtgactaaagaaaacagacaatagaagtgcaagtaaacgccccaagtttttaatagaaaagaaagtattgatatatcgaaaaacataagagtcttccaatgtttgcacaccatgagcacggtatagaaatccacatcttttttgtggtgtgaaagcaagacagtgagaactgtgatttgatatttgtatttcttgtgctgcaggctcttgggctgttacgtgaggctgcaagaaatcataaaaatgtcagtttaaagcttaaagacaataaaggttcaaggtcaactccaagttttcttttgcttcatatgagtgaaacttctcaagaatcacttaataaattgtgtttagaaattattcgagtacttgatgattcatcaaatacctccttgaaagtggcagcagtttcagcattagaagttctagctgaaagatttccttcgaataattccatctttagtctgtgccttggatctgttacaagacatattgcatctcataacttggctgtgacttctagctgcctcagaacaactgctgccctgatcaatgttctaggtccaaaatcactggcagaacttcccaagattatggacaatgtgatgaagtcatctcgtcaagtattggctagtttggatatgaaacccgaaaccaccgatgttttatcagccttaaatgaatcccatttttatgttctcatcactttggaggcagttgtggacaagcttggtggatttttaaatccgtatcttacaaatataatggagcttctggtgctttatcctgaatgtgtttcaggaatggatgtaaaggtggagtctagagctcatggagtacgaaagcttcttgctgaaaaaattcctgtaagacttgttataatgtagcattgtgtaattgtggtatgaaatgaaatacccatttttttctttaccaatcactatttttttacaggttcgacttgccctgccacctttgttaaaattatacccagctgccattgaggctggggataaaagcttaacaattgtatttgatatgttgggaaccataattggtacaatggacagatcatctattgtggcattccatggaaagatatttgaccattgtttggttgctcttgatctgcgccgtcaaagtcctccttcagttcaaaacattgatgtagtggaaaaaggtgtgcttaacacaatgactgttctaaccttaaaacttactgagagcatgttcaagcctcttctgataaagagtattgagtgggcagaatctgaagtggatgaaactgcatccagcggaagcattgatagggccatatcattctatggcatggtaaataagcttactgagagccatcggtaagtcagtatttagttagctagttattgttcgctttagaaaatgttctttgaaataagcatgctttgaatttagtcaaacaacactttatttgggtttctaaatattttgggtatattttgtattctcagaagaagagtttagctttttgtttgtattaaattatgtacatgtgatgtagatacgaaaattgggttttgaaccactgtaaatatgtcaaccacttgtgacagttgagacttgtacaatttggtcgcagtatttaaatcagtagttagttttcaatttgatttccttaattattttttatgtttatgccaataaacataagaatataatcacttgttatgatgttaccttgtttacccaaaataatgatcaaatcacagcagtttaagatggtctatatccttatttgtaggtcattgtttgttccctacttcaaacacttgcttggtagttgtgttcatcatcttagcgatggtgtagatgtggaagtgtctagagtgaatcggaagaaaaaggccaggattctagatgatggcaatataaaagaaataggcagtgtgtctatcaagggctggcatctcagggctctagtcttgtcatccttacataagtgtttcttgtacgacactgggaccttgaagtttcttgactcctcaaatttccaggcaagtgaattgtttacatactaagaactcattttttcatctattcgtatccgataccataacttttgaatacttcactgatacgcgtctgtgaagcatcaagcctttttaaagatatgaaaatctaatatagtttacatattgagacatagaagcatgtataaaaattgaagcattgtccattgatgcaccaaaatggaaactatcctctttatggatgatctcaaaaaagtaatgagattgatactattttgttggtagattaataggacttgatttacgatgatttatactttttaaataatgtgcaggaagtatgcttttaatttgaatttgcagaattttttttacatgtctagatttatatcttatacctatcctatcctatacatttttagaataattgcagtcatgtcagatacttttcatatctgatatatgtatcgcatgggcatcaatatctatttttaccatttgaaatggttatgaaaaaattctttagaagactttttttccacctagagtggaattttttaaaggttatgcattaattgggaatttttcctttccatttaaaaatactttgcatgttttctcattccattgaggaataaaatattcctaagtctttcagcttccttcagtaatatagttgcttgctatattctctcactgactgttatgtcatgcttgctgcagatgttgttgagacccattgtttcacaacttgttgtagatccaccagctctgttggatgacagcataaatatactaagtgtgaaggaagttgatgacctactggttgtgtgcatcggtcaaatggcagtgactgctagatctgaccttttgtggaaacctttgaatcatgaggtgaactttatgatttcttttcatttttactactcgttaatgattgggcaagtaatttgatactgacatactggtaacttactggcttcactatcttgtttttcattgagggaaaatgcatatgatcattgtcctcgggaaacactgttatgaatatgactggttctactattctccctattagtttgggtgcatggatgccccaagacattttaacaatagattaagaatatgtctaacagtagaagtaattaactctctaaaggccataataaaagtgtaaatacagatatggccccccaaaacttttaatttaacgaatccactcctcttacatgtaaacattcagtcagtagctgtggtgcagcagcaagccaacaagctggacggggcaaatgggctcctagaaatgccagcaggttcaaacgtggagtttctaacattagtcattcaaactagaaaaacgagcaaatccttaccaaaacttcctttgctagacctccatttgtggccttgctaacaactacctatcaacatcacctaagcatagtaaaatcatgtactatttgggaaaactctcaacaagaacttctaagagaataaaataagtaggtaaaatggattgagtttcttaagttgaaattaacgtgaattaaaacaagttttttgagaagctaaatcagaacttctataaaagtttattttaacttatgagagaagcttaattcattttacgctctttttttccttattctgtaagtgcttattgaatagtttatctgaacagggtttcagtcatgttagagttgaccttttctgctatgtttatcgggctttataaggtttaattgtaaatagactgtagcttttatgtcattttgatcaaactttagtaataatgtcaattgacgcctgcggttttgacctaccctaccggccaatgatctttaaagatctgaacttgctcctgtactcttgcatcccatttcatagtacgttagctttggtcctttgtagtcatcaatgccttatttatgtgttgaagtttagtccattagtttgttgttaatagttttgggtattcagtaatatgtgttgctcttgaatgctatatgtttgttccccgcaaatactagtattccttagcaactgaatatctttctgccttctttatcccgttttttgcaggttttgatgcagacacggagtgaaaaattgcgagctaaaatattgggcctcagaattgttaaatattttgtggagaacttgaaagaagaatatctagtgttcatagctgaaacaatccccttccttggcgaactgcttgaggatgtggagctttcagttaaatctcttgctcaggaaattctgcaggaaatggagtctctgagtggggaaagccttcggcaatacctatgatgtaagattaggagggcagtatttatggttgtgacatgagcaaagagctagagatatgtaatcaaacaagaaatataatcgataggccagtgtaaattgtggttaattaaggaaaattagtatttatatataccgataaaggttaaagttcaatttttctggttcaacttttataacactcaatcatttatagcataatgcttttaagaggaatatttgtaataataaagagagaagaaaaagtataaaaataggattaaattgatttattttgaaatttgatattttttttaatatcatactacattcccagagaaatttaatccaagactcttgcagtctcttatattttgaaaagtattctatttttttttttgtatctctttcatttataaaataatggttgataattttggtagctttattagggccgtattaagaatagtggaattaggaagtaagacaatggataagcaatgtacctgcttgcttgtggcattgatgactggtttaaaaattaggtacgtgttgttacattaattatttttttagagaactttaattgttcttttacaaaaagaatctgaaactgataaattgatggaggcaactgtcacatcagtttttttataataatttttaattctatcataaaatcaagtattttaaggatgaaggttttcagtagtcttgaaaaatggttcgtgtatgatcaatgaaaggaattgtgggaaatatattacgtagaaagtggccaggtaaaagtttaaaaaattattcacgttttaacttttgattttcagactataaaaaatgtttatgaaatcaaaacatacactattataagttatatataattcttaaaaaggacggataagacataaaaatataaaaaatatcacaactatattgacatccttattttctaagattttataccaatacccaacggaaatttatatacaaaggaagaaagaaaacaaaatatgggaggattagaccaaggtccatagccaaatcaacaaaactcatagcagctcattaaaattacgggcataacggtgagagcaaaaagggggaactgaaacccagcaaaaataattacgactgagaactgcaaaattagccaactgatctgcagagtagtctccttatctatagacacgtgtagctttaaaactaatatgactggatctataaacacaattgttccatttagtggaaaacttccaaggaacaagattcaggttatattatttataattttatataaaatgtaattttatcgaactaattattaaattataattacatgacgtattttttgtttttttaaaggcaatttatacattattagaacacttagtaacaacacaaggtgtgccaaactaaggccaacataacatattgattagttagttgtttcaatttttttttaatcaaattaaagttggacaattatataatttgttaagtaactctgaaatttagttaccttttagtatgacataatagcttatttaattttgtaacattttgcttaatgtcaaacatagcacagacttactcattacgtttgacagcggagtttatggatggagaatcaaataatggcagtgcactttcatgttacactaagtgcacgctacattaggtgacttatcaaacaataatatgatgaaaatgctataaaattatttattaagtttattttctacattatatatgaattttgtttgttttaaatgtgattttcaaaaactaattgtatataacatttatattatatatgtgattatttcatcctcaataaaatttcaaaaacaaatattagtttaaaaaaaaatataaatatatctatggtcataattgaaagtaaacattaatattttttaagatgaagattctgcaaccatcattttatttatttataataaattagctatcatactgactataagaatctacttgctgattatatattagattaatatttgtattgttcccgctacactactcataccataggcatcatcaaatcctttttaaaataccaagtgggtcaaagttgggcttgtcttccttccaggctgaacccatgctaagctatgaatattaatgaagcttcgtttgataccctgttagaaatcgtgtggagtcttttcaaatgatatatcaataattgctttatgagaatgcatgtggagtacatgtgccattatagaaactgcagaatttactttaatttgttacgggtcacggggtgaattgaattctgcacttgatcagcaacacccatcttccacgcatccaacagttttaaatctttttacatcatctttcttaataatacttttaatcactaaattaaaatattaattttgtacaataaaatattaaatacatttaatttttatttaacattattaacaaaacttattataaaaaaataacattaataattaaaatttagaatataaaatacaaagtatagtcaaaacaactaaagaccgtgctccaccctctttacccaccccctctctctcaactacttttaattttataaagaccgtgctccaccctctttacccaccccctctctctctcaactactactaattttataaagaccgtgctccaccctctttacccacctcctctctctctcaattactttataatagaattttttctatggagaaaattccagagtttcatatatgtttatatcgtaatgaatatcaagcttaacgttatgtgttgttgtgtaggatgacgttgctgttaggaactccaggatcgggcaaaactaccttacttttggctcttgcaggaaacttgaaagcaacctcaaggtagtacaaattctatgcaggattaacattctctacggtcctaaagaactaataattaacattaatttaattatgactaataaatattgtatgtacttattatgtacaggatttttacactgttattaagttacaaactgtcatataaagtaagttagttgatatttacgataactactttataattcataattgattgacaatttaaattttggagttcatggaaattaaactctataaccatcatccgtgtgggttatatacgtgtattactttacaatttgtaattactaatattataggtacctttcggttctttgaaacaaatattaagctattacgtagggcatccttatttagtcaacattttttatttttatagaataggaattgagtaaaaaattgtgcctacatgaatgatcgtcttgttagtgtattccagttatagcacaataacaagtgaaacactgaaaccaatgtgctttaaatcattataccaataggaattaagattgattctatttttatagcctttatctaactggaacaagtccatttctgaattgtcagcataccaagaattttgatacgccatagcattcttcaaaattccattgtcatcatagaattacattagaactttgatccttaaatacctgtgcagaaaagtggtagtataacatacaatggccatgagcaaaacgagttctgtattcaaagggcttttgcatacactagccaaactgataatcacatatcagaactgacagtgagacaaacttttgattttgcaaacagatgccaaggttcaagtgatatagatatgtatataatatattagtttccttatgtgccatttttagttatttttattttccatttcagaattcagttacttaatttcctggtctaatgtcatgaacagaaattgtgaaaaatcttgaacgcttggagaaggagaaaaacatactgccaagtccagaaattgatgcattcatgaaggttgtttcatcttgtaaataatatctgaaaaatcatgcatatgtgcaagttaagagaagtcctctaatttgtgtttttttaaactgattttactcctcaacagaacacttgttggtggcaaaaaccacaatgttaagacagattatgttttgaaagtgccttggtcttgatgtatgttcagatacggttgtgggcaatgatatgctaaggggggtctctgttggcaaaaaaatgagagttacaacaggtgatctctctcccctttctaggaatttgttacaattttctttgaaatttggctcttgtagtgatatatgcttaagttaatctaactggattacctcttgtatcatacaaagaaagagggtccaaattcagtccctttatttttttcttgttttgtgaaatatagctttgataagatttaaggagatttcatttagaattttgtttttgactcctaagattggaaattaatatataataatagagaagctaacacagtccatacatttgaatccatatttgttctaggaacaataatttatagatgatacaaaattcaatccatatttgttttgactgtgtctataccagaagattaagacattatgaaggcactaattgaagttaaaaattgtagcaagcaatgacatacttttgcctttcatatttttttctccaagagaaatgattgttggaccacgaaaagctctatttatggatgctactgttctgatagctctaccacatcccaagtagtgtaatgcataggaaattttgttcaccaaatggatgctactgttctaatggctctacttcaacctgcaccataaacatttgagctctttgatgatcttctgcttctgtcagaggggtacgttgaatatcaaggccccataggagacgtgctggagttttttgaatcatttggcttcaaacttccatcctgcaagggagttgcagattttcttcaagaggtatttgtagatttttgctcctctaatggttaaactcaaatgcttgatgaaattattgcttaaaaacatgttattttcccgtgtcaggtaacctctcaaaaagatcaagctcaatactgggctgattcttcaaagccatataaatttatttcagtgccggagattgcataagcctttaaaaattccagatttggaaagtcaatagaatccatgtgtactgctccctttgataaattaaagagtcatccttcagctttgcccagaactagatttgctgtgccaaaatgggagctctttaaggcgtgtttctcgcgcgagagaccttgatcaacaggcataagtttctctatatttttaggacctgccaggtatgtatatatactcaagtaaataaggatgcacttgtttctatatatagttttcaattcttaagttttttacaagtagaattcatgataagttgacaaaaaaattaaaaaatagcagtttaaaaaaaaaattacaagaatatgacagtttcaaaagtattttcaaatctattgcagtgttcaaacacgccccagccaggcgtgattcaggtccattcgcgccctccccagacgtgtttggtcacgtctccaccaggcgggataggtgaggcagtcacgccccacccaggcgtgatcttgctaagcgtgattcttcactggatggcgtggggattccgtatgtcattcggcgagaaaatggtgttcttcttggggaaacccggggtggcgctggacgacaagtttcttctgggaaaagcttttctgggattctttcccactgctacgatggtgttttttcagggcgtttttgcggggatcactttgatcttgatagctggggcgttgctcgggaggatgaactttcgtgggtggatgctgtttgtgccgctttggcttactttttcgtacaccgtcactgcctttagcatttggtgccccgatggctggttagcaaagcttggggttattgatttctctggcggatatgttattcacctctcctccggagttgctggtttcactgcagcttattgggtcattcacttttctctaacttatcacttttacccaaaaattcatttaaataactagtcgtatgtcttagttactcatttataatcaaaattatgaataaacacttaaatcattgttttttaaaagcaaactcttagtataaaaattcataattgtgtttaagttaacaaataaattttgtgatatattttttaaattcttacaccaacatgttaatctaaataaaattagactcaatgtttttatgtaaaatttcattatgatgtataaaagaattaagagtaaagaccctacaataattggttctttgtctagttaattgtatccaattaatgactaatgttaattatttaaattttttacaaagattaatcgttcataaagttaataaatattctattgtatcaataacttaaaaaagaatcttatattacaatttaaagaatctcattaatattgtaattttttaaaattttttaaaaattattactaaaataaaactcaaacaaacagccttgaaaatgcagatcttgttaactatatgcactataattatcataattgaaaggtatataataattattttgggttatacatatacaacacctaattaaaatatatgtaaaaatatatccacgcatcatatcgcataaagaagaaaaaaaaagattttttcatgtttcaactaaaatataaataatgtgggtgatattgtttttaaaaaaaaaatgaatgattatggtacgtaatattaccaaacaacttttgaaataaaatttaatttcactcttaattttatttatatgtacaaatatacaatgaatattcaagagaaaggattacaaacattgttgtgtgaataatttgaagccgttaattttctttataataaaatgctgacatttgcattgtgatggtgtttgatttgaataggtgggtccacgatctgaaaaggacagaaatatttccatcaaacaacatgattatggtgcttgcaggcgcaggcctgctttggatgggttggagtgggttcaacggtggaggtccgttcgtggcgagcacggtggcatctctggccgtccttaacacacacgtgtgtgctgctgctagcatcatcgtcggggtcctactcgacactttctactttgaaaagctttccccataagaaacttgtcttccagcgccaccccgggttttcccaagaagaacaccattttctcgccgaatgacacaagatcacgcttgggtggggcgtgactgcctcacctatcccaactggtggagacgtgaccaaacacgtctgggaagggcgtgaatggacctgaatcacgcctggctggggcgtgtttgaacacgtccagccaggacgtgattgactacaatagatttcaaaatacttttgaaactgtcgtattcttgtaattttttatttaaactgctattttttaatttttttgccatgataagttagcctaatgttggtgatttcttggtaccacttacagaatatttgttggaattgtcacatgcacaatgtttgtgcaaacaaaatttcatggtaaggatgaggaatatggtaatatctatcaatctgcactatttttcagattcatacacatgatgtttaatggccattttgaattgtcactcatgatagcatgtcttttacaaacaaaaaggtaatttatttgatcctgggcgggcatggtctttggccacttggattcttggtgtaccttattcccttgttgaagctgttatatggtcttgtgttgtatactatagcttcaacaagggaataaggtacaccaagaatacaagtggccaaagagcatgcctgtccaggataaaataaattgcctctctgtttgtaaaagacacgctatcatgagtgacaattcagaatgaccattaaacatcatgtgtatgagtccgaaaattagtgcagattgatagagattgccatattcctcatccttaccatgaaattttgtttgcacaaacattgtgcatgtgacaattccaacaaattttactgacaactattctgtaagtggtaccaagaaatcacaaacattaggctaacttatcatgaattctacttgtaaaaaaacttaagaattgaaaactatatatagaaacaagtgcatccttatttacttgagtatatatacatacctggcaggtcctaaaaatatagagaaacttatgcctgttgatcaaggtctctcgcgcgagaaacacgccttaaagagctcccattttggcacaacaaatctagttctgggcaaagctgaaggatgactctttaatttattaaagggagcagtacacatggattctaccgactttccaaatctggaatttttaaaggcttatgcaatctccggcactgaaataaatttatatggctttgaagaatcagcccagtattgagcttgatcttttttagaggtcacctgacacgggaaaataacatgtttttaagcaataatttcataaagcatttgagtttaaccattagaggaacaaaaatctacaaatacctcttgaagaatatattaaaaacgaataccaaagacaaaggacattaatgattgacattgaatattaaagttatcgatgaggaagatttaaaaatttgtaataagagttgaaacttgtaaacactcacatatcctcttgtctcatcgtgacacttgtggatcaatgaattattacaatactctcaaacattttaatttcagcactttatcttattcattttatcgttttcttttacatttgttatacttccctttaaatcttcatcttttttcaatctcaatttcttctccaaactttttactcctttaattttctgtatctttttttttgcgcactttattttcgtcaatactcttttattttaaagttcttctatgatcaatttgcactttactctttattacatacttttagtttgttctcatgttaaaaatttaacattaacctatggtacagtacctattgaggaagatacaagactttcagagaaaatgtttatcctttttctcaaatatctatgggattgtgtcgactaaaacaagcacaaaatttcacggtcaaaatactataaactatttcaaatctttttaaacttgcagcaatcgttttactattaactaactaaaatcataatgcgttaatcattttttaagggtatttgttacactgcacaatcttgaatatcttcccggcgggatacaccccaaaatcaaaagttatcatgcaaggatatgtttggtgtgtcttacgaaattcgattatatacatcacgaataactatgtcggttgattctcaacaaaaacatcattcagcatcttaactgggtaattgtcttcaatctgtttaatgctaaagcttctttaatctaactcatacaattatttgtatatgcatgacatgtgggaaatcaaagtaaatatgacttaaacgagagtgtgtgtcacaatttcaagatgacaggcctctggccatggccctcaggacatatatattcacctttctagaaattgctaatgttctaagtaaaattcagacttccaaatcaattcctcagtgctgattgtaagcattacgactattactatcaatttgtgagctaatgactgctcatagaaccatctgtaatctgttgaattgatcagttctgccttctagttgacacttgagcgagggcttgatcgatttaagccattttaaattttactggccatttccacgattttgtcaataaattcatattcgtacctacaaaaatacaaggccttttagttcattcatacacaattttcattttctttctaaaattatcaaagtaaatccgcacaaaagtaattaccacacaacaacaaaaacagaattgcaaactctaaacaaagccttaactccgtaccccaatgtctctcacaacgttattccttgttaacaaagtcaaatttaaatgaacggatttcaaattaaacggttcatagaatttcaagaacgatgcacatattaagtgattattatcatcaactattactagtataatagacatgaatcatgaaaataagcaaaaagtaaaagaataatatgtgttgtacccggttttcaagtaaaatcctttcaagttggcgacatcaaacaaagctgacctccatttcttcaccctctcagagtccttacccaacatattttcatgctcagtcatggcttcaccatagctatttctttgatgccttaaatccgacggtaacactttgtaaaagatgggacaaatcagttggtttttcgtctccatacactgaaggatggtcaaaagcacatcaagacaggacgaggaacgtgcatagttttcagaaaatacaatgatcgaaagccttgattcttcaataactccattagtagattgtgaaatttggtccccatcattcatgaaggtttggtacctactccggcacaatgcattgttcagaaaacctgtaaaggagcgggtatcgtttccactaaaactcagaaaaatgctatagcggggtacaatggcgatggcttctcgcacaatgttttcgatgaattcatattcatattggtacctacaaaaaagtacatgaccttttaattcattcatgcactggttacgtttttctttatctattattgattactttaagacgggttcaagcaagaaactctctcacacacttgcacatttcttacaattaattaaaaattatgaatgaaaattattaagtaaaaagtgagatctataaattttataattttaataaagagtgcttaaaagaattttttttaatataataaaattgagtttgaataattaatctccccaaagatttcaaaccttaaaactcgtaagtcaaaacaaagtaaaattaacttgataaattagctaaaagcttagattgtttcttaccaataataaattctagtgtgataattcataaaacaaattccttatcaaagagtataattattgttggtttctattttgtttttcttttaagaatgaaaggagaattaactagttacgttagattgtcactttaagaatattggccaaagccttgcaattctagacataaactggctcaagcccatgttaacgagtcatttgacaactcagaagttagaatattcaataaggtataaatcaaggaaaaaagcttcgtgcaaatatcacaagtggttttggtctttgaggattaaaatgcaagtttacatgacttcagcaataataatcggcatgagttacttaacttagtatatgaaattttaatttcaacaatgatacataaacaccatcctaggctaaaaattcattggatcgaaacattttatttttaacttaaatatctttttaattcttataatttaatatttatttttttgtttttataaaattattttttgttttaatccttacaaacaatgtttatttttattttggttcttataggacttttttttttactatctagagtactatttaaagtaattttaaaactaaaagtaaaatatatatatatataatttataaagactaaaaataacaaaaattacaaaaattaaaaaaaaaacactaaactattaaaaacatatttacacctatatttttcattatctctcttattaatgtcacgttgttctgtgtttcttttttctctcaaagtgtaaggcagtattgaatgcctacaaaaaattattattttcattttctttttttaaaattaagaagcggtactagctaaattaagaagaagaaaaaacgccatacctgcagcttccgtctccgaaacaccatccggccaaggtggcaacttcatacaaagctgacttccacttgtgtattttctcggagtcctttcccaagcgactttcatgtctaatcaggtactctccgaaactaccagtctgtttccttacatgggagggatccacgtggtaaaagattggaataactagttgcttctttgttgcccttaactcaaggatcttgacaagttcttcaaggcaccacgaggaagacgcgaagcttttggagagaacaacgattgaaatcctggatgcttccaatgcttgaacaatagcttcaaagatttggtcaccacccttcaacccaacatcgaagaatgtcctcaatctcgccttccgcaaagcagcatagagattacctgtgaaggtgtggcgcgtgtcttcccctctaaaacacagaaatacatcgtagcgccacttcgcaattcccccttcatccgccatcgcaatgaaactattaagcagataacataagatattatatgatgtgctgacactatcatttacgcgcttttgcttaatttccttgctgcttcctggaaataaaatacatggatggagtccttgttttcttctccattttctattcgaaaattatagttgtcccactcaaatttgtgcatttcatcaccacttgaaaaaaaatattatttccttaatctaattataattgtcacaagaaaaaaatatcaaaataattattttattattattttaaggtaatattaattatctttttttatttatatctcttatgagattaataatagacaataaaatttataaataaattaatgatgatataaaattatcattctttttcaactatttatatataacaacctaaaaatacaattataacagaatgcagaaattatattgtatgtataaatatagttgattttactgtgactaaaaattatttactattagatatagttaattgcatgcaaaaatataattaactttacatcacaactattaattaactttgtatcacaagcaattaataatacgatgaaatcattaaaatatataataataagtaaccacatcaaataaaataattagtttcaacctaaattctaattaattacaaacttacacaatattttcgccaaatagagagaaaaaaaatataattgtctaaatgtggatccaattactttgaacatatagaaattattaattgtatattctattcaaaataaaaataaagtgcaagagtcatagctcaaaatgaacctccaataacagaaatccataagcattttttttcatgcactagacaaatttcttcatacacccaccaaagacaacgaaaaataaaaaatattcttccataagattcatacggattgacaatccgtaaggttcatacaaattgaaaaatccgtaagaatcttatggattgcaaattcgtaaaatcttatggattacagatcgcctcatcgacctcgtcgatgctgtcgatggcgagatcgaggtggggattgtggtcgaggatagagagggggatgccgagggagtgggccttctcttccatgcggttagaggtggggaccccgacgatgtcggtgagttggccaaaggctgggagggcactgagcttgacgacaacaaaggatacggattggccaatatgtatgaaccttatggaagggtattttcagtttttcgttttattgttgggtgtatgggaacactagctggtgtaggaagaaaaatccaatccaaaattgggacaaaatgtaggacctaaccaaataatggtttgaacatacttgtgatgatatttgtgataccaaggtgaataatgaagagattaaatattctagaaatacctaaactagaaaaaaaaattatgtatcacattgttcataggctccttgttatacaaaaataaggaaaaagatattgtacacaaccttactcttgcatatgtaaataaactttttacatattcgaactcatgaccaacaaatcactaaagcataactatactaagattaaaaaaattaattaaggattaaaaactaaatttttttaaaggacttaaattaaataaaacaaatttatattgactaaaattgaaagatgataattttttaggaactaaaatttaaatttcaaaaatttctaaagacatagaaaacatgataccatgtgactaaacatgttagtatcacccacatcggtgtcacatgattacatcatgtgtgttgtgacatgtaattttgttggacatataagtatttgatagtttttatttaacgtgggagactaaacttacttcaaaaaatagagactaaaattggataaagaagattgagagaattaaaaatggaattctgaaatagatgaatgatgaaaacttatttaaccttaccatagattttgtatactctgtttttatttttgtgagtagaaggcgatgtgtttaaattttgtttcacggtgccttacctaatgccaatatgacaaaacaaaatagtaccacttgttttttttatctaatcaacacaaaacattgaaacaagatgtagaaaaaacacaacagacctcgagaattgaacaagatttagaaggaatacaataaaccttaggaattgaactggatgtaaaaacaacattgataggcacaactgaattcaagggcagttattgatgttacaatcaattagtcacacagctccacagcatatacttgaccgactttcactcattcttcctcgtagctgtcattggataaaaggaaaggatttgctatatgcttgctaccttcaagtttaatgaccttttgtacaatcctttcgataaattcatgttggtacctacaaaagtgcaaggtcttttaagacattcatccgctgtgttcactttatttctcctaatcagactttatgtcaataaaacaacaatattaagctcgactaattaatcttctcactaacagattgccgtacaaaatacaaaaactgctccaaacaaaacaacacacaataccccatgtctcggacaagaactatgccatgtttagcatttcatagatggtcaatatcacttaagagggaagcatatattaagtaactaattaaaagcattacgtactcattttctttgacatggtctccttccaaattgttgatttcagacaaagcagaactccatttctgcaccttctcagagtcctttccaaatcttttttcatgttcagtcatggcttcaccataactttttgtttgattgcatacatccgacttttgcacattgtaaaatattggccaaaccatttgattgttggtcttcatacactcaatgatcttggcaagttcatcaagacaccacgtggaatatgcatagttttcagaaagcacaacaattgaaatccttgaactttcaattgctcccataagcttctgtgatatttggttcccactctccaattcctcatcgtccatgaagattttgaatccctctcggcgaaaggcattatagagaaaacctgtgaaagtatagcgggtatcctctccggtaaaactcagaaaaacatcatatccgggcaaggcttgcacggctgattccacgatcctttcgatgaattcatattcatactggtacctcctataaaagcacaagtctttttaattcaccaggggtattcgagcatggacaaccatattgtttctattaatcagaattataagttgacttaagcttgactaatctatatgtatgcacagaacagattgctactgctacactgaaactggaaacagaacctttaatttacagcacacatgtatttctctcggttaaacaaaacaaagtgactttctaaaacgataattagaagatcagacatactgttcagcagattacagatacaataagtaataaagaagtggtgccatgctatgctagcagttgtagagattaataatggaacttaatcaactaaaattaagcatacccagtttggtaacaccatccattcaagttggtgacttcaaataaagctgctctccattgcttcaccctctcattggaatctctaaatatttcttctaatttagacatagatgctccatagttaccgccctggtgccttacttgccacggatacactccgtaaaagatgggccacaccagttggtttatcgtcctgttacactcaaggatggccacaagttcatcaagacatcttgaggaggatgcatagttttccgagaaaacaaccatcgaaatccttgattccttgattgcttcaagagtagagtgtggaatttggctgtcatgagtgtgtagtttacgatcatattcatgttctgtgaaaaaggtcttgattctcttgctgcgcaaagcattatagagagtaccagtgaaggtgtaacgggaatcttcgccatgaaaactgagaaaaacatcgtagtttttgagttcattcgacatgatggatgagaagtagcagaaggtggcttgcttgtctcgttgactcctcctaatggccaatgcctccctacttctctttctctctttcataaatttaaaatattaacacgatgccctacgcggttttgcttaatttccttgctgcgccccacttcaatgtcaagctgaaataaaatacatgaacatgggttgactggaccagatggatggatggagtttttgttttcttctccattttcttatcaacaaaccagtcatgtcattactatcatctccatttaaaagaaaatacacaaaatttgtaaaaaatattatcaatgacaagatttgtaattaagtatttaatctaaacccttaatttaatttaatagttgtaataattaagttcttatttataatagttgtaataaacagaaatccaaaagtttttttttttcaaaccaaaaaagctcccgttgatagttcttgtttctcataaataattgaaattatgtccatatccttttattgttgtcttaattccaaaacgcagtctaagcaacgggagaacactcaagtttcttccacgcctatacaatgcaacggaataagtacgactgtacgagaccataaactcggcccatttccacaaaacatttgatctgacatttctatagacttcattggggtctctaactaacagggggcaaagacaccattttggtgctagtttttttcctgtaaacgattcagattttgaagtacaactattatgaatatctccaaataatatttaataccgtgtttggtacacacaaggatgtcctttagtcccattttttttagttaaaataaataaaagcagtaaattgattctatgtatacgtttcttgaaagagatgacagaaaaaaattgggagatcaaaattttttgttaacagaactcctaaaatgtttcaggaattgctctcttttcaccagtttttgctgtcacaaaatgtccagctgaattacgcatatcctatgagtgcatggaatttaacaatttcaaagccagagcttcttgctcctccaacgtaaccgcaccggtagttatacctgcattccctgaaacttcatttctttcaccctcatcactgtcactatcaaagtatattttactctttttatgccgtctatctacagtctcatctacttctgacccagatatatcatcttggtcgtcctcttccgcattcccagccttccatttcaacttctgcttgattcttttttctctaagccgctgacgctctataagcttgtcttccttgtcagccttcttcaaatcatctcgcatccttctatagtattcagctttttgttctgcatcaagacataaagatgatgtggcaaaatgtacaaatagtccatgcttatgaagtaagaacatacatgtaagttagctacttcaatgctctgaagaccaaaatggtatatagtgatctgatgagaatgagatctagccaggttctcaaattcaatgatgattgcagaaaatacaaaagggttttctaattggtaaacaagtgtgtagctataatttaacattttaaaacattttttattattttcacaaaactatgaaaacaaggaacgaaatgacacgtatacacatgtacaagcaacaatttcaccttcagcttcagtttgcagttgaaaagtatggaatacctggatcgagcagcatttctttgccactttgtgtgtcagctatcctggctagtggaggaagtgtgtggccgtcatcatcaaatacaaccctagtcccaagtggcctgtgtacattaatcttgagtttctttttcttcaatacacgagttgctggtctgcataggaaagaactaaattggtaagaataataatggaggaagaaattcaaagctccagatgaatggctccagccaagaaatatgaaagatccaactttatacccaacactaagtttgaattttttttctattagccacatcataaggtgttatattcaaatatcaatttgtctcagcaattttgaaaccagaagactagtgtagccccttgccataatcatatataaaaaaactaatgcagcattatcagaaagcagcctaattttttaatctgtaccactgtaaaaatgtatatgggaacgtacattatttcttcaatttcagatgacttaatttcaccttcatttgcagtatccgctaactgaagaatatcattttcggtttcctcatccttgaaagcaactgtgtctagcttcttcctggaaacctcaaagatagtttccttgtctgaatcctctggctcaactaaagttgatttagttgtcacatctttagatttaattttctggtttagaaaacggattttgggggtcattggtaaacctaatgatgctgaatactcgtcaataggtagtttcataacatcaaatatgtctttatccttttggatatggatggatctcaaatatgtgatgaatgccctctgagcccgatgctgcatgtctgggtatttggccagtaaagatgccaacaaactagaaactggttgcagtagttcttgccttggctgaataatcaacaattgcaaaaacatggaaagcaaatgtcagacaaacataagactgaagtgaagcagatttaaaagtgacaccttgatgttcaaatgaaaattggaattgcatgcatactattaatttgcagggaaaatgtaccttattaaaatgcactggaacctttgctgcttttaacttttccagcatttgaatttctgaaggcaacagaaataaaactgactttccatcagatttatatcgagcagtacgaccaactctatgtatgtaagaagctacattttcaggacaatccacctacaaatgcaagagagaagtgagagactgaacataaaaacaagctttttgcttccaacaccccaccacaaagccctaaaacttgctccaagacaggaaaccaaaagcaggatgagactcacctgaacaacccagtcaactgccttattaaaatcaaggcctcttgcggccacatcagttgagaagagaacagagcgcttctcacaaaactcagaatatattgccattcttctttcctgtttcatcctcccgtgaaggcacttcaatggtatgccagggtgcagtttcttaaatgcttcaaagacaaattttacctattaagcagggatgtgaacattatggaagatagtcaagctcaaaagagggaatttgcaccaaaaaccacatcttaaacattttccctgtttacatgaaagaattatggaaaaattcatcctaaaaatcctttaaaaattttctcattacaataaccataaccagcgcaactgaaaaccataacagaagttctacgcatgtgaacttcatcatgtagctacaaataaaacaaaacaattatttacttggccattgaatatgaaactaatgagacaactttcaagtttcaatcataaaatcaaactacattccctccaattgcacaaaaaatcttgaaaatgatgactagccaatagccatgcattggctaagcatcaaagggtgcaacttttcaagtggcatgacagtaaaattgtaatagaaacctataacatacaattcccttcaacaagaaaaagaatttcttgaaacaggacagaaaaggggagttggagttacctgcttacagcttgaaagaaagacaagtgttttcgactgtagatgtgtctttatgaaactccacaacatatctaacttattttccaggggaacaatcatcacaatttgcttcaacagagtaggagtggaagtcacagattcttcgtgcacactcagatactctggatccttcaaacttagtcttgcaagatcttgaattgactttgtttgagttgcagagaaaagcaaggtttgtctacgctttggtagttgggaaattattgcatttagttccttcttgaacccactgtctagaatccgatcagcctcatctagtaccaaaacctatatccgggaagtccacccaaccatcagctatattgatcaaatctaatgatacatatctgttttctggtttgacccaaataaacacgtactttggaagacaaaataaaaaatttatgctttacaagggcctaaagcatataaaaattaaacggcacctatactctgcttcaaccactgttgctaaatcacctaggcatggaagcaaatttttctgaaggttgttaaggatagaaaatcttgacatacccaagtacaattaaaaacagacacgaggaaacagatagtgatataaaacaaacaacttaattgtaactctaatttcagagtcagattgaggttaatctatcacatataagaaaaaaagttatattaacctgcgtctgtgaacaatcaaaattgggagtttcatccatgtgttgcagcagtctaccgggcgtgcaaatcaatatgttgagctcatttacacgttctttctccatgtcaacgtcctttcgaccaccaatgagaaggccagcactaaaattatggtgtttgccaacaaccttcaacacatcaaataactgaccagccaattctcttgtaggcgatatgatgatgctgccaacaccatcttcaggtccccatctctctctatacaacttttccaacacctatcattcaaaattcaccataaacaaataacaataagcacaaatactacaattcaatataccatctattcacccactacatattaaatcaatgaccttgcccaaacacgtatcagcttctcatggctttgaactttcgatgttgattttccacacttattagtaaaatgttatgattatattattatcataatatttgcattcagaaaccacgataaacaaataataacaagcataaacatcacaattcaatatatcatattctatttactatatattttctcactttgagctaatcttgtgattatattattatcataatatttgtattagttaaataaaaagaaatacaggggaccctaatccgaagagaatggagctgagaaatgaagcacttacagggataatgaaagcgagggttttaccggagccagttttggcggcgccgaggatgtcgcggccacagagcgcgtggggaagagacgctctctggatgtcggtcatggccacgaacttggactctcttagggcgtccttggttttcttcgagagtggaaattgatcaaagcgtgacgcgccggcgtagcgcgagtaggtgttatcttcgaggcggccaacgggggagtttttggggagacgcggcagcgacattgggttcgaaccggagtccggtggctgaaactggatccatgaattcaagaggcttatctcttcctcctctgaaactcgctgttgcttgcgaaactccttcgatttcggccttctcattgctgtagcttgaaaacgaaggtgaaggtgaagatgaaaaggaaagttggggctaggtttatggtttgtgtgttgcgtgttgttgcggcagaaagagtttgcagtgcaggaattgttggcggttaagcttcatttttgtgaacgacgatgagctacgtaatgggccgagtgatgaatgattgggctggtccgattaatccattgccattatttttgtacacatttttattttcctccatactagggaaaaactttatacacccagcaaaagactaatacataagattcttatggattcgtgaatccgtatgaaccttacgtaagtaagttttttttttaagttaaaaaatatttttccaaataatgacacatgtaagtttcgaacctttaaccttcaagttattaacacgacgcttcaaccaaatgagctaatagatcaattatactaaaagctaattaatgttgatacatataacattaaattttttaatatatatttaatacacgtataagtttacataataaattttgtaacaattaattttgatataataattaaagtattttttacatataaaaatcatagatttaaataaaaatcataagtttaataaaaatttgcaagtttaataaactataaatacagatataatttttaatttaacctgtaaatacaaatataatttttattagtcctgcaaatttttattaaaattatgatttttatttaaaactatgatttttatatgtaaaaaatactttaattattaaatcaaaattaattgttacaaaatttattatgtaaacttatacgtgtattaaatatacattaaaaaatttagtgttacatgtataacattaattggtttttagcataattggcctattagctcagttggttggagcgttacgttaataagagacctacatgcgccattgttttaaattatttggaaaaatatattttaacttaaaaaaaaacttacttacggattggacaatccgtatgggccatacggatacaaatggtacttcgaacttggaacgagtatgaataaattaacgatacttctttaccttttgagttgttctgccagatcggtcgctcaagacctttggtctctacccagacctgatgaaaaaaatgggatcacatcttatggactcgttgagaataattctgatctagttcatggcctattagaagtagaaggcgctctggtgggatcctcacgtacagaaaaagattgcagtgagtttgataaggatcgagtgacattgtttcttcggtccgaaccaaggaatcccttaaatatgattcaaaatggatcttattctatcgttgatcagagatttctctatgaaaaatatgaatcggagtttgaagaaggggagggagtcctcgacccacaacagatagaggaggattttttcaatcacattgtttgggctcctagaatatggcgcccttggggctttctatttgattgtattgaaaggcccaatgaattgggatttccctattgggccaggtcattttgggacaagcggatcatttatgatgaagagcatgagcttcaagagaatgattcagagttcttgcagggtggaaccatgcagtactagacacgagatagatcttccaaagaacagggttttttttgaataagccaattcatttgggaccccgcagattccgtatggcccatacggattgtccaatccgtataactcaaaaaaaattatggattcgcaaatccgtaagaatcttacagattcacgaatccgtatgtatgaagtgtaataaaagtgagggtatttttggaaatacactgttctggaatggtgtattagtctttttctgggtgtataaagtttttccctccatactattgtgattatggatatgattcgccttatgtttcatacatgtctagaacttgtgaggttgaacacaacactccaattaaactaataaactaattatattaaaaatagttaatattgatatataacattaaatttttaatattatatataattttacataataaattttataataataaattttaatttaataattaaactataaattaattgtgttactcatataattttgataataattattagtggatgaaataaaagacaacaagaagaatcaacaagtatctaacaaaggtagctgaagcggacacaactctcatacttgacaaagagatgaagaagaaatttcatgtttagccaaaaccaatcagcatattgatgggctttctctataagtaatttgaattgtactgaattagaaaatatttaaaatggatccaatgataaaataacaaaatcataatattagatcacataaactttatctctaaaatggatttaactgggttacaaattacaacaccgacaacagcgtttaccaaatttaggattaatttcggagtttgttttatttctttttcagtacaaagctattcattaaaaaaataaatgaggtaaaaaaacaaaacattgtcgatcagtcttgaataaactagaaagtgatatataaagtagaggttaactaaatttttaattcttaaattttagtttttaactctgaataaaagtgatatatagagtagcaggtagtgtgaaataggaatatatgtattgatcttgtgatactcttcgagtatgttccgttattatctatgtatgttgttttttcgagtttgatgtgggtacaccttgtgctctattccagtctttctattaatggagtatctttgcctagcaaaaaaaatgaataatattggtctcaactctcaactcatgcaaagtgtattcaaatgtgaaaaaacacacattgcataagatgtcttggcataaatggatattaatgagtagattaacatccgatccaagtgaggttataaatgaccaattttgtatgagtagggttaggtaagacattagagagttttttttttatgtaaacactctggttgcatgagtgatacatatataagttgcatgagtgatacatatataagaacgtagttttgattgaaaatgatacataagttattataaatcttttatacatattttttaattttcgtaaataaaaaagataaataaaatacttgcaatataagtttagctagcatactttacgtatgttattctttttttaaaatgtccatagtattattctttgctattattaattaaccaatttaaattagccataacagtacaagatttgaacattattcaaacccttcactaattattttactccaatcaatttttatttttacttactttgttcaataacttttttactagtactgaatttcaattatttaattctaatattgaaacttcattataagtactcatgattgaagtcatgaacttgagtgctaagaataaaaaaaaacattagaattaggtgttttgaactgttctattaaggtctaaaaagtattgtaactaaaaatttaagtaaatagaattttatataatttaaaatatagtatatatttcttcaattaactttattttgatatattgtttataatataagcaaaatatctacttagtatcattattaatattgagtttgtttttaaattaacaacaaaataataactactataatataatcaactttgcatatttatatgacaagtaacaaactctcaattttttaaaccaactatgtttatttaagcaaatagtttattttcacactaatgatataataaatgctagatagtgtgaaaattaaatttttatttgtttttatatgataatttaaaagctttttgttacaaaattacaataaatgactacaaacaactatactaacatgtttgttaaaaaaaaaatatgttagttaaaattttaataaagataacaatgaaattaccttatcataattatacatcttttaaatttttagttcttggtctttatattggtatatatataaaaagtatttctctgagttcaaatataatataaaagttcccccaaatcagaaaaaaaaaaaataaaaaataaaagttacccagtatctacttccacactccaatatacaagcatgtatagtatttatatttatattgaatacttctaggtctgattctttgaattttaaaataatttataacaattaaaattaatgaagtgcattgaatctgcattggaagatttccctttgtttgatttatgctaaatgagtatacttaaaaagaaaattgccttctagaaagggaccaaaacaaaccatcatacaatagggccgaatgaacaaaatacggaatggaaaacaaacatattaaatacctaatgaacccacaatggagaaagagaagaaagaatggcgtccgaaagggagtcgtttgcaagggcttccaatgccgaatggatggaagaagatgaggaggagcttcaaatggctgcattgctgaggttgccgacgcagaagtgtgccaacatggcgccgtctttggatatgagcaacagaggtgactcagggaagaagaaggccaaggttttggagcagattgatgtgaggaagctaagccgcttgaacgcctcgtcaaggatgctttggcaaccaatgaacaagacaattacaagctcctctctgccatcaaggaatgctaagagagttaaatatttttacaaaaaaaaataacaattctcatatcgattacatgcatgagggtttatatatgattttgcatttaaattatttgtgtggttgactgcaaaagggttggattggatgtaccaagtatcgaagtgagatactgaaacttgacaattggagctgatgttcatataggttcaagatctctgccaactttgattaattacatgcgagatgtctttgaagttcatacatattactcactctcatactaacttactaattaatcaaattaatttttagtaaaaatattgattatgggttatgtgtaataacattagttcaataatattgtccgtactctagctcaataattcattacgttttcttatagataattaatatagccctggatctcccgccattgctctttatatgtttttgacatgtttggatcaacttctctagaagtatttctaaaagaaaaaaatgagacgatttttttataaacaaaaataacttcttcattagttaatttttaaaagctcaccaataggtcgaccttaaagacattccttgaccatcttgaataatatcagcggtgttgtcaaactataatattcttctgttattttacattacttattgagtaaactatcaatttgatccttgaaatactactctctccttaatggttgataaaataagaaaaactaagtaatctcttaaatattgaaagacttttcaaattaagccttaaactttattgaaatgcatcaacttaagaactaattaaactgatgaatatcctatacttcaaggattgcttgaacaattttattactttagggacaattaaggagaggataatagtttgggaacaaaattggtgatttattaaattccattcataattgatatttacgatatgaaatgcaaaagtatgtcattgcttgctacaatttttaacttcaattagtgcctttgttcaaagctatatttcatattacaagtggaaataattaacttcatcttaaaaacagaagaaaaaaaaatagagggactgaatttggaccctctttctttgtatgatacactaaagaggtaattcagttagattaacataagcacatatcactacaagagccaaatttcaaagaaaattgtaacaaattcctagaaaggggagagagatcacctgtcgtaactctccaatcttaggagtcaaaaacaaaattctaaatgaaatctccttaaatcctatcaaagctatatttcacattaacttcatcttaaaaaaacagaaggaaaaaaatagagagactgaatttggaccctctttctttgtatgatacactaaagaggtaatccagttagattaacttgagcacatatcactacaagagccaaatttcaaagaaaattgtaacaaattcctagaaaggggagagagatcacctgttgtaactctccttttttggccaccagagaccccccttagcatatcattgcctacaaccatatctgaacatacatcaagaccaagcactttcaaaacataatctgtctcgacattgtggtttttgccaccaacaagtgttgcctgttgagtaaaatcagtttaaaaaaaacacaaattagaggacttccctgaacttgcatatatgcatgatttttcagatattatttataagatgagacaaccttcatgaatgcatcaatttctggacttggcagtatgtttttctccttatccaagcgttcaagatttttcacaatttctgttcatgacattagaccaggaaattaagtaactgaattctgaaatggaaaataaaaatagctaaaaatggcgcataacgaaactaatatattatatacatacctacatcacttgaaccttggcatctgttagcaaaatcaaaagtttgtctcactgtcagttctgacatgtgattatcagtttggctagtgtatgcagaagccctttgaatacagaaatcctattggaatttttaaaggttatgcatcaattggcaatttttccattccatttaaaaatactttgcatgttttctcattccattgaggaataaaatattcctaaatctttcagcttccttcagtaatatagttgcttgctatattccctcactgactgttatatcatgcttgctgcagatgttgttgagacctcttgtttcacaacttgttgtagatccaccagctctgttggatgacagcatgaatatactaagtgtgaaggaagttgatgacctactggttgtgtgcatcggtcaaatggcagtgactggtggatctgaccttttgtggaaacctttgaatcatgaggtgaattttatgatttctattcttttctactactcgttaatgattgggcaagtaaattgatactgacatactggtaacttactggcttcactatcttgtttttcattgaggggaaatgcatatgatcgttgtcctcgggaaacactgttatgaatatgactggttctactattctccctattagtttgggtgcatggatgccccaagacattttaacaatagattaagaatatgtctaacaatagaagtaattaactctctaaaggccataataaaagtgtaaattacagatatggccccccaaaacttttaatttaacgaatccactcctcttacatgtaaacattcagtcagtagctgtgatgcagcagcaagccaacaaggtggacggggcaaatgggctcctagcaatgccagcaggttcaaatgtggactttccaacattagtcattcaaactagaaaaacgagcaaatccttaccaaaacttcctttgctagacctccatttttggcattgctaacaactacttatcaacatcacctaagcatagtaaaatcatgtcctatttgggaaaactcaacaagaacttctaagagaataaaataagtaggtaaaatggattgagtttcttaagttaaaattaacgtgtgcacaagttaaaacaagtttttagagaacctaaatcagaacttctataaaagttgattttaacttatgagagaagcttaattcattttaagctcttttttttttttccttattctgtaagtgcttattgaatagtttatctgaacagggtttcagtcatgttagagttgaccttttctgctatgtttatctggctttataaggtttaattgtaaatagactgtagcttttatgtcattttgatcaaactttagtaataatgtcaattgacgctttgtatccctgcggttttgacctaccctaccggccaatgatctttaaagatctaaacttgcttctgtactcttgcatccccatttcataatacgttagctttggtcctttgtagtcatccatgcctcacttatgtgttgaagtgtttagcccattagtttgttgttatagttttgggtattcagtaatatgtatagctcttgaatgctatatgtttgttccccgcaaatactagtattccttagcaactgaatatatttctgccttctttatccggttttttgcaggttttgatgcagacacggagtgaaaaattgctagctaaaatattgggcctcagaattgttaaatatgttgtggagaactagaaagaagaatatctagtgttcatagctgaaacaatccccttccttggcgaactgcttgaggatgtggagctttcagttaaatctcttgttcaggaaactctaatattgaaacttcattataatattgaaacttcattatactagtactgaatttcaattatttaattctaatattgaaacttcattataagtactcatgattgaagtcatgaacttgagtgttaagaataaaaaatcagagtctgtcctcttaaatgtgttcgtccaacttaattaggattaaacaagtaacaaactctcaattttttaaaccaactatgtttatttaagcaaatagcttattttcacactaatgatatgataaatgctagatagtgtgaaaattaaacttttatttgtttttaaaaagataacaatgaaattaccctctattataagcatacatctttattgaaaataattatacaattatattaaaaaaatatttttttaaaaagtttataaacaattaaaagttttatttaaaatgattgtattaaataaccttgtatcaaaggaataagattatcgaccctcattacatatataaaaggaagaagaacatgccaacaactatttatttatacaagttataataaagtgtatccctcaatcaagtgatacaagttcgaatcatgactttgtatatgaaataaacaattgtaaatagaaataatcaccttatatgcactcacaataacatattaacattaatcattacttccatgaaaattattccatataattttatgatcaacacaaaaaatacacatagaaatgaagtaatagttgtgtcaacccaacaatccaacggtctttagtgagtggtcgttgagttttgaaaagcaataaattttgttgtaattttttttggatggattgattttcaaaagtttgagttctaaaaaacaaattgattcagttataatttattatcataattgaaaaaaattaagaagtgaatgtcaaatcatttgcattgagtatcttaactgtgataatattgagtatcttaattgtgataataaggctgttcatgccagacaaagtcttgatgctttcatgcaacccacaaattataaagacacatgcatgtttaatttctatcatttgaaataaaaatcaattttaatgtggaactaatagataattttataaaaataattatttattaaatatttatttgttaaaagttgaatatttaaatgattaaagtattataaaaatagtctccctctgataattttattacaagttttttaaaaaaaaaagtattttttatcaatattacaacataaagagaaattaagatatcaatcacaagatacaattgaaagttgtttgtaattgaaaaaatgtttgcaacaaagttttatcgtgttatacatttaattgtattttatgataattaatgttagaaatttaaaagaacaaaaataaaggtgggaagtaatagatatgaaaatattgatatgaatgtatgaccaaaaaataaaaacatgaataaatcatgatagtgtacaagagataggtgtaagattaaaaaaagtgtcaacaaattttctaagactagaatcggaaattaatgtttgggagaccaaaacgtggaggaaattttttcattaatctcatgttaaattcttttataagcgaataattttaaattcttatcagatctctttttagagacttgaggtattttcttaattgggattccaatgtttatttttatcaccaatttttacataacacacacaacataaataaactcaaattactaaaaaaaaaaaaatttgaccattgaaaaaaaaaatgtgatgacaacagtaaaagatgaaaaatgtcataaataataagtgaaaaaatgtgatgggaacatgagaagaaagataagagaaatatcattattaatattgaaaccgtgtttaaaaataacaacaataaatataattaattttatatatttaccccagttaaactgattattgtcaaatttgttcgttgacgatagcttgtgttttccattacaaatgttttgtacgagggatagggatggtattatcatggcttgagcgagtgcggtgtggcgattttgtctctctgccattacaacttaattatgcagcctccaactgcttctacatttcaccattcatctttctctcgaagccctcttcaccaaaatcaggtttcttccattttctctcaatattccttttggcttatctcattttactctctctcggagtttcttttttcatttcaaagcatttcctcagtttcagaacttttttacttcattcaaagcatttattgttacattatatcattgttttctattgctttccatgatgcagaaataaagttttcattttgatgtgtatgtttccaactttttcttttttgtagtaatagcgccctgtgaaatgtgaagcttatgtttgtgggccagctttgtgtgaagtttttgacttttgggttgttgttggtgacgtagaaagggtgaattggattgaattagttgtttgtagtttgggggaaggacacagtaaattaaaatgagtggagtggggattgatattggaaatgagaactgtgtgattgctgcagtgaagcaacgtgtgattgatgttttgttgaatgatgaatccaaacgtgaaacccctggtgtggtgtgctttggagagaagcaacggtttatagggtcagctggtgctgtttctgctatgatgcaccctaagtccacaatatctcaagtgaagagactaataggcaggagatttgcggaccctgatgttcagaatgatttaaaattgctccccgttgaaacttcggaaggcccggatggtggcattctgattcgcttgaaatacttgaaggagactcgcacgttttccccggttcaaatagtagcaatgctctttactcacttgaaggctatagctgaaaaggattttgggaccgcagtttctgactgcgttattggggttccatcatactttaccaacttacagagacaaacatatctcgacgcagcagcaattattgggttaaagcctttgaggttgatccatgattgcactgcaactggtcttagttatggagtttgcaaaacagattttcccaatgcagctcctatttatgttgcatttgttgacataggtcattgtgatactcaggtctctattgcagcatttcaggctggtcaaatgaagatactttcacatgcttttgacagtagcttaggagggagagactttgatgaggttctgtttagtcattttgcagcaagatttaaggaacagtacagcattgacgtgtattctaatgccagggcatgtaggaggctgcgtgtagcatgtgagaagttgaagaaggttttgagtgcaaatgcagtggctgatctgagcattgagtgtttgatggatgaaaaagatgttaagggctttatcaagagggaagaatttgagaatttggcatcaggattattggagaaatttaatattccctgctacaaagcattggctgatgccggcatgacagtagaaaagattaattctgttgagttagttggttcaggttcacggattccagctataactaatttattaacttctctatttaagagagaactgagccgcacgctgaatgcaagtgagtgtgtagcacgtggttgtgctctccagtgtgcaatgctcagtcctattttccatgtcaaagaatatgaggtttgaatattgaaaaaaacacattgattcttatcctatctatatgatatgtatatataggagagtagatttttgtgtttgtagattcttaggttagaaatgtaataattactaaatgaacaaagttgttacataggtgctaggtttattttctgcatttaatttgtctatcttaattgaaatatatctaacttcatagatatcattaatcatgtgtttttttttttttatagaattttgcattagcatgtattactctctataaaattaatgtaatttcctgtgtttgttcagatccaggattctattcctttttccattggactttcatgtgatggaagtccaatttgtgaaggattggatggtgtactcttcccaaaaggccaacccattccaagtgttaaaattctaacatttcagtgcagtaatttgctccgtctggaagcattctatgctaatccagatgaattaccacctgggacatctccgaaaatcagttgcttcacagtatgcctgctttagaactttactatgatgtgaaggagtttagatcatcttgtccgtgattctttgttattaattttttattaattattaccctctctattcttgcttctttggggtgcttcatgaaaggcatgtggtatagtctctatgagcttattcatcttcttcatttttactgttttggtatgtttaattctacaaaaaaaaatagtatatactatatagtaatcatcatcataattgcagcttttactcttgaattgtaagtctaggactcaattatgtataaagctattacttgttatacatgtgcttgtattttatcatagtttcaaccgtggattttttattcaatggttataaatgcactttattctttagaatgcattccctcactttagaggagtcaaatccaagacctgcaatgttgtttgaagttcaatgttgagtggtaaaaactcaacaaggaataaagctcaatattgccaactcaagaatgttatgatggataagtagacacacaaggtagaattaggaatgattccttagaaagttaggcaccatttgttgtagaaaatatggtagaatcgtgccttaagtggtttagacacatgtgaagacttgtagaagctctaaataaagagagtgaattagatggaagatagttcaataattagaggtagtaagagacgaagaaaaactataagttaaatcattaagaaagattaagatttaaatggtttgtttagacattatttatgataagacattatggtgtttttgatccatgtagccaaccccaccttcttgtaaaaggctattgttgttgaatcttgggacaatgcaatagacacctccccctttcttgaaggagcgaaagacttcattattaaatggccttgctgaccatcgcttgttctgatctcaaaggaagtcattgctgtaaaagtgttaggtatagcaatatgagaatctgtaggtgtgcacatgcttgaacaaatcataatgttaggagaagcagatatggtggatctaacaccatccatatatctactgtctaagtttctcaaatggagagaaatgactgtatttaatatttagtatcttcaatgacaattggctaacatttgctaatgtctattctatattataagacatctcaatattacaggacaatgaagttataataattggttgtgagatactgccattccttgtgccagtgattaaaaagtgttatgtatgcttatgcctacaccttgtttttgtatgcttatgcatttgtttgtcatttctattcagattgatcctttccttggatcccatggaagtaaggcgagaattaaagttcgagttcaactaaatttgcatggcattatcagtattgaatcagctacagtaagaaacctcaattttatctcttcatatcgcattattagttttctgagagatctttctatgcacatggacatttttgtctttcagttgatcgaggatcatgtgaatgattcagttacaacaggtgattatcattcaaattctgaagcaatgaatgttgaacctgtttctgagacagttgaaaatgtcccagaagattgtatcaataaaaagtgtgaagctccacatcattcagtaagtactcccatgttgttctctctctctcccctgctcacctttttttactggaagatatctcagatattagagatttctagcaaattgtccttttaacacgaacaattatatggctaaattttaattatctgattatttctgatactgaatctgtaccatgtctttcactgtcagtctgtcgcaaccgttttttataatgtctgtgatgttgtatatgtacatttttatcttgtggagattgttttgattgcagatatgattcatgttggtgttttgggaaaataaaagtgttactatcatgccttgttacaggctgatggtacaaaaaaaggtaaagccaacagaaggcttcatgtacctgtgagtgaaaaaatttatggtagaatgaccaaggctgagatattggaagctcaagaaaaagaactccagttcgccgatcaggacagaataattgagctgaccaaagacaagaagaattcgttggagtcttatatttatgaaacgaggagtaaggtacatattcaatatcttaatgagatgtagacatgactggcttctctgattcaattacattgtataagcggtcacacatttcttctgctaaaatagataattgttcattgtatgatcctttttttcttctttttcatatctttactgtgaggtgttccttcttcaaaaactagagccttaaattttgccatgtaaatatgaaagtattgaatatatcaaaatgagaaaaagctgttgtatatagtttaatgacttctgtcatgactcaagtaaatgtaagggtaaaactttgtgaagctggggatggtctgctgttatactttgtaataacatctgcataggatataccgatatagaattaaaatctgaatccttatgccttttcttaccgttgattttattaaagctgtattcatgtgtatgctctacttttcattctgtactggtatttaaatttatttgcatgtatgaatagctattcagcacatatctaagcttttcaagcgaacatgagaggaaggacatatctaggagcctgaaagcgactgaggattggctttatgatgatggtgatgacgaaactgtagatgtttattctgcaaaactagaagatctaaaacaggttacttttgtttctccaatctccatgtttcatccgccatacttcttgcttataatctccatcttctgcagctggtagatccaattgagtttcggtataaagacacagaagcaagaccacaagctacaagagatttgttaagttgcattgtagagtatcgaatgtctgtagattctcttccaccccaagataaagaacaggtacgacaataaactagtgaataagtataattgtgggatgtttcccttagtatcagtttttaagtgacaactttctttttcagatcatcaatgagtgcaataaagcagagcagtggttaagagagacgaggcaacagcaagatctttaccctaagaactttgatccagtattattgtcaagtgatatcaagagcaagacagaagatttaaactcgtatgattttaactttctgttttccttttcagagatgcataattgtagggtactatgatcattcatttgggtcagaattatacccctttctgaagcaaagcattgttcatttgctccaatttaactcgattgtcattatatacattgattttatctcaaaaactaatgaatgttctattttgatggattttcagagtatgccaacagatattgaaatccaagggttctccacttccaaaagaaaagggtgaagacaagcagaatacttctaatcatcaatgaagacgatgaatgaactgaaggcctaaatttttaatagcttctgataaacgtgaacttttttttaacacttttccccgtccggggagttgaaagagataacttcaaatacagtgaaatcattggtaattaccggttcaatctgctttatatatatatatatatatatttcatttttggccccacgttctactaaagccatccaataagttagtacgtagacaaccaatcaagtagtttattttttgtcaagggttgctagattttatgctcgtcaacaagttttcaatttaattccaaattgtattcaatctatcattttggatgaaataaaatcgtgaagattggacgcttctgcgaaactgaccacctttatggctttatctttattcgctattaacaaaagcaattttgttatcctttttattaaaaaattaaaaggttacaaggattttagaaaattaaattccttttctatttttctagtgaaaattcctaatttttgaatctgtacacgtatgctaatctcacgtatgtcctaatttaagtttccgctcacaaatattatgtcctaatttaagtttacatcgtctgtaaacttcagtatttatttggtacatgtgcattaaacatcaacaaatgaagccaataaacagcataagcaacaaaaatagcccaaacaattcaggcgaagcatctctatcctccgctcaagatagacggaataaaaggtcttcttgatgtcttcatttacttaaaatttgctatcatttctatcgttccattactttaatctacaaacaccagaagtaaattatgcataattgacatagcaacaagctatcataataacacagaaccaagtggtgaatcaagatggaatcgaagcattattgggaatcctaataaaaaaagtgaaacattatctaaagttacaatttcatgatggccaaagacattaggtccttgtgcactgtacagaactacttgcataagctcacaatatctacttgccaggattttttagaatcaaatcttcactaagcaacaagaccccaattcagtttcctcgtgcgatgctgcatgctggatggctggcttccttgtccgcatccaacacatgataccggaagtttagggcaatttaacagcattgaacctatagggtattgctagtcataagatccacaagtaaattatgggatgtggaccaggcggataataaatttcttgccatcaagtgttcagtttctcttcttggcatttgtcgtcttggtaccttttttctttcttgatttcttgaatcctgctccactctcctgtaaacatcaaaggcattcagtgctacatcacaaccaaaaggacaacaaaacatcagaatggtatgcaagtatatgtaccttccgatattgtctataagcattgcggcctgtcaactcctccccacttttgttgacataaacctgcaaggggggataaagaatcaggttctgatagatttatacaatatgacaaaatagacttaaaagcttttctcaattatggttctggtcctataatttcaaaaccactaggaattggtccctgccattaaacatcaagtaggaattggtccctatataacaattaatcttaatgtcaaaagaatgtttacaaaaacaatgggagattgagtatcactatctagtgttacatagttatattggaatgatgggatcgtgtgcatcaaatcatagaacaatatttccaaaaaaaagaggcattatgtaatgtgataatttgaatttcattgcacttatttaaatcttaagtaacatactgtatgggttttttgcatttcagttttaaacaacagcaaaacagctcgcataacttcttatgaccagcatctaacatgagaaaagtaaataaatttaaccagttaatacttaataacattaaaaaaaaataaagactttttctcatacttttcttccttctggtgatgtaaaccaatgaccagcagattcaccacttgcttgaacacgccttttgcctgcatcctttggcaaactggtgcagctcctgggttccacccagcccccagaagcacatgattggttcgcagggtttgatttgtttgctttactattactttttgagacactatttttagtgccattcctctttgttgctttctttctagaagattctccatggctgaatggagaaacaattttgggatccacccagcctccagaagcatcaaaagatccctcaacattcaaattacttgatttgtttttcccccttgttgagctattaataaaaccattttgaactccctgcatgtttgaagctcctccattaccaaattgtcccctgaaatcaaaatacaccaaaacaatatgtaatacaaaatgacaatcactttctttttaaatcattaccataagattaaaacaacaaatgaacatgggttacgacttacatgtaatcaatgtgtgagaaattaggttgctgattcactgtgttgatggtacctagtggattaaaattccgcaggcgactgcggactaactgccgaattctcggatcctcatggaaaaaataagtatgagcgggatgaacagggtctgttgattcacatcgttgttgatccctctggcagctagaactaaccccaggattcctctcattaaaacttttagacgaatcaccacccacttccttgcaattggcagaacgaaagtactcttcacatatctcattgaaggcaggcgtcgggacagaaacattcttcaccggcaaaaaatccttccatagatcatcagcaggcgatgttttcttattttgttctaaatggcggttagggttagctttattggcaccagcaatatcaacatcaacatctgaatcatcagaatctgaaagcaactgaaatttacaaacagaaacattcttcaccggcaaaaattccttccacagatcctcatttccattcacatcaaccgaaggtttattatcttgttgcaaacgactgttagtgttaactttattggcaccaccgacatcaacatccgagtcatcagaatctgaaagcaattgaaacctattaacagaaacattcttcaccggcgaaaaattcttccacagatcctcatttttgttctcgtcagcagatgttttcttctcttgttccaaatgactgttagggttaactttattggcatcaccagcaccaacaccaacatcagcatcatcggtgtccgaatcaatcaattgaaaccttcggagaggactagtggttaacttgggaaacatcaagccactcttccctgtctctaacctggcagaagccggaacatcattggaaagtacctttcttttcctatccctgaaagagttgctacacgaatgaggggtcaaaaccccacttccattcaacgaaactttcgagctgctacacacagaatgattccgattccatgccgatggaaccgcatgccctaataatattacaacagataaataataaggaaattattaatattattatttaaaattaaaaagccgagagagaggtgaaatatttgaagtgttagctaacctgaccttgatcgggatcttcttgagaggagaactcctcgatgtcgtcgtcggcgtaggcatcggcatcggggtcgagatacggcggcgggggcccgcgacggaggcgtttgaggagggggcgcggcgggtcgggtcgggattcgggatcggagtcggagtcagagacatgaagatcgggagaaagaggtggatggattggggaatgggggggcgtatcgtcgagacctagggaaaatgagggcacttcgaaattcgccatggaaattgaattgagatgtgtgtatgtaatgtatataagggagggtttaggggatttgaatttgggggggaaatggagggaattgaaatttctgattcgcgggtgcgcgactgaaccgtcttcaactctttttttctgtcttctttttttatatgacagaatcaagatttacataactcactgactttgttgaatcaactgtaagtttcatttttttattctgtaagtttctttttcatttacaataaagttcttttttattctgattttattgcttttgctggaaaaatgttgtgaacgtgataaaaggaatttttttcttcagattttatttaatatttagcttattaatttattcaggataaaaggcattatttttattgttattataattataaaaataaccacaaacataataaaaaattaagtcaataacagtcaaactatctttgtaggtcaccacatttttatgtttttcagatggtataatgtatttaaatattaatttgttatagcaattaatttcaataaacatttaataaaatcaaaatggaaggatatgattataatttgaagaaaatttaagtgattaaattaacacaattaaaatttaaacgaccaaactacacaattatgataccaaaaaaactaattaaatatcttaagttataacatttttacataatcttttaaaatcataattcaatacattctttaagaatgcaattaaatcttcttttttttcctctaaaatatattcttttaaaaaaccaatgattaaacaaatttaattgtaaaaaaaaatgaacgttcaaattcaaattatcctgcataagattcaagtagcattgtcttctatggaagataaacatgagaatacatgtatttaattaccatgataaaatttaataactttataattaattattatataaaaaattcattcgcacctattaaagtgaaaaagaatcattctgatttattcacaaattaacattcacaaaaaacttttatatccaaaaattatttttattattttcctctaaaattgaacacatcataattaaaacttctaaaggtagaaagctttccttctcgtgtaacatcataaaattaaaacattccttacgttaattatcacctcgacttaattataatcagcaaacaaaggaaaaatgctaatttcaatttcattgttttttttttttttatactttgacaacattaactatcaaaatgaacaataaaggagacaaacagaaagaggaaaaggtcccagagtaagtattaagttatatttttttgtcccggtaccacaaatcatccttgccacctcctaaaatacaatctacaacaaatcctaagcgacatacacaatgatagaaaatcaaaatcttgagtagataatgctatcatctatattatatgacgatcttttttcccatcacatttgtcctctgaacatgataaagtacaacacatgctacatgcttctcataattttctcaagaccctacccaatgaagcagggcctgtaatcacagatgacaaagcgagctatttcccaagatatcccaggttttgaggaatttagcacaagggaatgagaagattatctgcttttaaagcttaatatgaatgataatgaagaactgaaataaaaactagaatgaggcagaaaatgtgcatctattcatgacccctcatcactgtgagcagatttttccataaagcagcatatttgtaccctcacaatctaaaatgaactgcttttcatcaatcatttatcaattttacaggttggcaatctgtgcaatgcctatgcccaaaactaaatcttctgtttaagaacatggcgcaactgaaccttctggctttccattctggcctccataagtctggctttcaaactattcttctgtgcagtgcgaggaatgcatcccttcatgccttgatgtgcatgtggacttcctgactcgggactcaactggtatagaaggtcttggggactcagcccacctttacctgatccatgatcgggagacatgatgacaccattagataacattccatttgaaagtctcccattcattccctccaaagagattatcttgtaattgtccccattgtttgagtatgttgacctccaaagcttcgttatggatgataccttttttgcttgcttagttggtatagagcacacttcacttatttcagttattggtgtctcctcacctgcagtttcttcccattcaagtacacttctccctgagacgttactctctcggtgattcctgttcaaagatcggctactcccttctggtgaataacttgagccttgatcctcgacatggctcacagtctcccatccactttcatctccttctatatccccattatcatccataaatacatcagaacgcctctgaatgccacctttacttattgcattggcttcaggactcaccatgtcaatattcgaggcatgactagcaggactgtgagaaacacatggttcaatctccctctcatttacttcaccaaaatttgcatcttcaaaaatggcaaaaatgtcatcagagttagggggttcatatgaaaatcccttaatgtctagaatgttcattgcagcggcagcctgttgaagtgactgtgcctctttcatgtccattgtgttcggctctgtgctttttgacctgatatagctttccaaatctgcaacgagtctattcatctgtgcatacttctcttcaagagcaactttagcatctatcaacttcatttgaactcgttcttcacgccatacttctgccatctgtaacatcttgctctcctcttccacttcttcccttagtttcatagattccctcttcaatgcttcaacttcagccttgtcttctccaatttccttggcaagctcatcacacacttcctcgatcaattctctggccttcctttccttctcataatcctgcatgtagcgctttgcagagagtttgacatctgccaactcattaaccaacctcgaattgacaatttcaatcctctggcgatttttcctttctcgattcaactctgctttaatgtcatcaatgtatgcgcggattttctcatgctctttgcttctccattgggccctttcctcactgactttcttcagaaaatgctcaagcttctttttggaggagcggtgttcagtctcaagttcctgaattcgtgtttgtgcctgctctagttcagctccgagagcagatacaacagatacagcacttgccttttggtcaagatgtttcatgtggctgtagatatgctgcgcttcctctgatgtttttgaacataaaggattccattttgttgcaccctccatttcattgttgggaagctggaaacgttcaggctgaatagcataaagtaggtttaaaattagcactttaattgtctgctctttcacttttagtgtagaagcagaacactttttaaaactcttttgctcatatagacattggaaaagctaatttcaccatgtaggtttacatgaaaaatgttttatctaagccatctctatactgttatacatagcatgggtcaatacaacaatgagcataatttgtttcaaagtgcaaattgggtggtatcaacccataatatgcatgtgtttgcatgggcaggcctttgaaatattactaaaaatttccacaatatgaactcataaacaacacgttgctatgattatagtttgtcactatctataacttaataattagatgattgatgtcattttcacaaagatgattaaaacaggtaattgcatgaccgagcaatgggatattgggatcattgtgcagtacaggttgcagttttaacttgagttattatgtgtatatgacattcagtcaataatgttcaattacaataccaaagagctgtaaaactcctaatggttatattatattgatattgaagtagtaagaaaaatcatacctcacagaagtgtccattctttgtcccaaatatggaacggggactttgagatggattcttcttcagatcagaaccatgggtcatgccattaggatgaccgagaaactggagccctgcgtgaccaattccattctgcagataagtgtcatcagtgatcagtaatgagaaatggaaacctatgaaattaatattgtaaaccagctacattgatctacaaacgaagacaataataaagtgcatggaagataatcattctctaattcaactggaatgtacagataacaaataacagaatctcatataaaaggaagactcaactaaagtcccaacttactctcaaaaagcacaaaactgacaaaagaatataagttcatacaagccaatattattacacagcatgtttgtttgacattctgccaaacaagacgcaatattcaatgcactctggatggatatgatttaatgcagcacgaacggaagcaactgattcttcctttctccgaacacaagtttgcgtttagggaagaaatcttcaacataacgataattatttacaaacacaaacccaactcaactcatttctccaatcattacaaagactataactagtcctccactagaactacatcactcgcgagaaaactaaaaaaacaaaagcatttgtatcttcaaaagacagctatttttaatttcatagaaagcctaatcggctaacccctaactctaacaccaaaacaggaaagtgaacaataatgacaaggaaccaaggatagaatctgaagacccacgattcaaaatcaagcaacaacaaaatcatcatatgaaaataaataaaccccaacaataaactattaattcttttttctccatgaggggtggcctacaatacagtagatgaagtaacatagtagcatgtagctgcaaaatcacatttaaatcaaaaacaacaaacacatgcaagatgcaacaacactcacacgggaacgaagaaaaactagggatctcaaacaacagaaagaaagaaaaaaacaaaagggtaaacgtttgagatcccacattgaccagtgtcataggcaaaacagtgtatataagcagagcaaaaccctcgcagcaaaaactaggttttgcgactgagttaggtccagacccagagtgtaagaagagtagcccaagttatgttccaacctaccttatgttccaaccccttccggccatcacccgtggccgtctccggcagatgcaaccgccacagtccggcggctagtctcctcgccgacacggcgacttcggcttgcttcttggcgctccggcacgttctccggcgggacccagcgacggaagacttctggtcgtcttcgagtggatcgtaatggatcttccacttcaaaagaggggtttcgggtctgctccgtttgccaccgtgtctcctcaaccgtgtccccggagttctcgggttccgtcgcagaaatggcttcgccggttcaagatctgagtccggcgaagggttgttcacgctcctcgaagcaatgcccgccggaaaactccccttgccggaaaacttcatcgtcgccggcgagtctcagccatttaatcaaacaaacaagagttacttgcgagaatgaatggcccaaagagataaaatggaaacagagagtgtgtgtgtgtgtgagagagagagaggagatagaatctgtgtgtcgttggagtgatggagttcgtgaagtgtgtgtgtgagagagaggacacgaggaaagtacagaagagagagggagagtttcactgtttcagagattttgctgagaaaaggacgaacacagtgacaatacaaatacacatacgcaaagaggtgtacgtctttccgtatgtttatacggtcaacgtatctgctatcagttatcatgattccacgcgcgggaaaatgttatacgatgtcgtttggccctacttggtttataagctacgatgtttgttaggctgctggtggaagagacgttctgatttgaatgatcgaaggatggtggggggtttcttttacttttacattttatttattaggatttatttcaaggataatgactttaaaatattaattaatttatatgtgaaaaaagatatttaagatgagttcaagaaagatttattttatttaaataatgaaatataattattttaaaaaattggaccaatttacatttcaaatcaattttattcatttttatcttttattgtttattactttcaaacataattataagattttagagttcacacccttttaattgttccttattaatttttttgtgtgaattaggatattttttaattgttttttatcaactaaattaatatttgttaacagataatttcatttaagatattgttaatataatatagagaaaataatatttgtttacataatatagaaaatcagatatataatatctaaatgagtaaatgtcaagggagtaattgtaaattctcctgacattttctattgatacggatgacaaaaatacagtatctaaattaatcactcaataaaaacttgattttaccatttatgtggttaatttgacttttttttaatatttttagttataatttgaattttaatattttttgtaaaagaaattattattaatttaaaataatattttatcactataaactatttatcataaatttaaaatataatttttatattaagaatatttattttaaaataatttttataaatttgaagtatttattcactataaatttttgttatataaaataaatatttattttatacaatgcaggtactaattcaaatattagttataaaataaaatatagacttagattggtaaaatttgaatacgaaatgatacttaaattttcattagaaatatttcatttaaattttaaattaacctaattgaataaaatgatgatgaaaagtgattcaacgttgtgaatcaaagaaaaaagttaaaaaaaaactaaacccaattttacttattgctcatttagtcaaattggaatgtatattatttactttgaaataatccaaacattgcaaaaaaatgataaggtttaaaattacaacctctaaaaaaagtttaaaattacaagttcgtattacttaaaaaagaggtggatttgttcatttatttatatttatttcatatcatagagattcgatttactgttattctcgtagacaatgagtatataattaatgaagcaatcaaacatttatgtcatcgtcagttttggccattggccaaatcagaaaataaaaacatctaacaggaatgaatgaaattagaaacaaaaactattagaaatccaaatttgaaagaaaaaatcctgttgatttttttcatttttccctgcaagtctgaaaattgaaatataacactatggtatcgtcgcctataaaataaaagaaactaaaagtacaatttttttgtaaaatatatatttatatttaaaattatttatgattgattaataatgtatatgtgtggcaaaagctgtctttgtactctggtggtttatagctttggcacatcttgtgcttagcttggtttaataaattttctgctgttaaaaaaaatacacaactccataattttatctatttctataagttattaagaatttttgtcaaaggataattcattcacgaatgaaaaatgataaactggtgaggcgtgaacattgtcactttagttagagaaatctattgagttccaaagctttttcaacccttaaaagtatatatagtagccacataatataagtcggatagggtaaaagtgcgacaaatatgagagcacaaaacttggatcatattaactaagatatgaaggttattccgtgtgttgaaaggcacttaaggtgtcaatttgatactccattgaagacaatataatggactaatatctgacttactataaatgatgaaatataaacttcacagactattttttaattctgtcaaaattttaaaataataccacaataggtgtcaaattcacaaactgagtttatgacaacaaatgttaaatgttaagataaaattgatttcgtcaaaaaacaaagaagataatatacttaaagggtttaccactttttacatctaactctaactagactctttaaaacagttcatacaaatgtgtcgtgtttcacgtaaacacttaaagtgtaacatatgctgttttgttaaagctaacagagaagactttatagaaaaactaacataaatactatttcttgtttttcacgtaagaaacaaatacacactgcattaaaaacaatctaattggttcatattaattattagtgacataaatttaaattttatttaaaaatattcacaaaattaatggtttaattaagatgtgactatatttaatgatattattaataatttaaaaatattttttcactggtgaatgtgttaattttaaaatgaaaaagattattacaaatcaaaatttctaatcaaatttatatttaaatcaaatcacattcaccagtatcttgtaaaagaaaataattaagttatgcattgaaattgtaaagtatttttatattattattaaattataaattattatatataataagtttattgaattttattataattttttaaaattatattaatgataatttttaattgattgataatataaaataattttataatatgagttaaactcatatttgtgaacaaactttattataaaataaaaggctttaaaaattaacatttaatatattagaaaagatatttacatttctcataattgatataaaaagtatacaatgtttatttacttatttcttatataaactaggggagatatacatagtaatgaattaaaaaaaatattatgtttattttattcgtttcagatagtattgataaagtcttagtgcaagtcaaattcagaaagtagagataagagatcagtgataataattgttcaagcatccagaaaagaaaagggtacaattttccatgcccggcgtctacagtgggaaagtaaggtagatttcccactgtgcgtaagtaaccgtggtcattggatttaagtgattttgagatatatgatagacatgcatatattagaatttttattttcttttactattttttttttttacataatgactcttcttcttcattagcatcatcgtcgacctctattagtcgtcgttggagatgatttctcacagcatcattttttttcctactttcagtttttcatttcctttcttttcttacgctctccttctccaaccactgagcgcagatccgaagtgaaatctaaatatgaaccaaacctcaaacactaatccaaagcaaaaaaacaatcgtacaaaaaacacaaacgctttcattcatgaaaacccccaaatttgaagcgaaatttgagactctttcatggataggccaaccccagatccgcgacaactagcatgcgtcatcgacgccaggtcgaagatcagtgcacgcaatcaaaaggcgtaaacttagaaggattaatctcccatttagatctcattgttggaattaactggaaccaaaggtgtagtagagcgcggatgacgacacctttttgtaccttccttcacaaaagttccaagcgatttgttggagtacgatgtcgtcgacaacactggtggcgttgttgacgatgaaaatcttgtcgacgtggtccttgaagatggttgagattggaggaaaattgttctaatgtgtgtaaacctatgataatctcaaacatatctaaaaagcatatagatctaatggacagtaattctttcccacggtttaggtctccaacgttagacatcgccctcgaaccaaatgcatataactaaaaaaatttagatgttcaaaagattcttctttatgcaaagataaggaagataaattttgtaagcagttttacttttgttaaaagagattgtttttgaatttttctttatgcaaagagaggaattttataagtaattttattttttatatgtaaaaagttattttcaaattcaaaatcaaaacaattttattgttgtgtgtagtgttattgaaatctgatcggatcgactggtccgatcggttgaatcgagaaatggttcggtactgtcattaaattgatcatacagttgatttggtcaaactcaatcggtcagatcaagttcgttcgatttttttatgtgatttttttatatgtgtttttttggatttttttaaaaattttggattattatcaatagttattttagattttagagtatgaatgaactttttttactcaaataatattagttatatatttatatataataaatacatatataattttaaatttttaatatataccaatttaaatcgattcaattaataattcatcggttggatcactaaatcacttatccactacctcaacttacctcgactgattcaataatcgaaccgattttcatgacacttggatatgtgagactcagcttcaataaaatgcataatgtttatttgaaaattgatcacgcgcgaggagtcggtcgtgtagggcacttcatagtaaagcaagtgtcgtcagtgtctgatctatttgttgcttgcacacttcactatctactctgtttcgccctacacaaaaaggcatccgagggagactccacgtggcaaccaaagagactgtcacgtcgataaatacaaaacgtgcgctccaatgctccatattaaaaaaatacgctctcacatgggcttcgaaattgattaatactatttattttaatgagccaaccctctataaagtggcataataagtgataactttatttttttctttgtttggtacgacttcaatgcagaattagatctggatagcttattaaaattaaaaatcttaaattaaacaactggaaaaatggttaatggctgcgcatcctaacttgattttcattttcattgccattgttaggtttctttttttctctttaattcaagtaatgctaagtaaattaagaaaatacgtacaactaattggatataaattcttataaattttttcgaaggtagaacgagatatgtgttccaattttcacattgtcaatgcatgcaaagccgaagtgccaaccaaatacatgggcagaaactgaaagaaaaaggatacattcacagaatgtgtgaggttctacttggctcgtcgctcttgtggggcattaccatcatgggtccaaatttaatttatacctgattctttaccattttattttttacttttctatttggagcatgtgtaatttaaatttttgttctaaattatgagcaaggttggacttcctcagaaagaaaatgtttgttgaatagattttaaaatgcatatatttattacttactatgaatgctattattttctaaatgtttattttgttgtttgatttagtttgattcgtttcaataaatatatgaaattaacagtaatattcctttaatgaattttttcccctttgatagaagattatttttcttcgctaaagatgtgatcttaagaagatattttaaatatttataaaaatggagtatttatttttatttccgttattatttttcatttatttgtataaatatgtgaatgaaataagacaggttaagatctttttgtttcccctcgtcatgggtaatattctttgatgtttatcacacactcataaacttattaattaagtattctctttatcttactctcaaaaaaagtattctctttatctttaattaacattaatagtttttttttttacgtaacctgagtagttgttttgaacaataaaattaattgatgtaaacataaaatcgttcaagtgctttgctatataaacttttaggttattgttgctttaattttatcgaacaatatagacatttttttcgattattatattatagtatcatgaaaatatataatgtgaaaaataccagttgatgcaggatcacgatgtacatatattgtctacatgcatggaaaattggaaataacaagagcccacgttcagtggggacttcatgtccataatcagcattgataaaataatagactatgtacgtgtcaggactcacgtgcaatgatgaaatattcttttcgttagaaagatagattatatttatataattaagaaaatactacatagttatactatttttttcagcatatggtaaaaatgaatgagaaagaaaaaaaatattatagaaattattttaaaagttgtttatatgaataatataattctaaaagaaatgataattaccgatagttataattttgttcagcaaaaaaaatgaatatgaatatttatttatcttcaataaaatattttaatatattcagtcaaaattacacaaatgaatatgaatattgtatatgatcaaattccgaccagaaaaggccacgttgcaattaacaaattatcttttacacagctttttcgttttttttcaccacgttttactcttgaaaataatctgataaaacttatgcatataatacagtactagtaaatataattagtaatgtctaagatgtggtggaacattcagatttccaaacatactcttaatcttaatctttagtaatggttaatgttttgtttcccaccttatccagcaaagaaaaacttatgattcaccaaagttagtctgctctaaaccaccattaagcattaacaattagctagctgcgaatgtattttttactaaaattactaacttcttttcctttttgctattatcgaaggttaaattactgaccaaattaagaacacattgtattttcctcgaattacaatgagcttagccttagtccactatattacgtacctagggtttttcatgatcgtcgataaacaaaatatcaacaagattatagtagagggataagtagcctaccgtaagtcgttggtaatttaattttgatttacagtgggttttaggtaatagccggaattcttgtagtgtttattccttttgttttgtttcccaccttttaattctttataccactaacaattacccgtttccaacttttaaaacaatttaagtaattaactactacttttgtacctaatataatattctttaattaattcacaataattagataagttagttaatttaattagtcatgttaaatttgttaatagtttgtattatttttttaaaattactcttaaaattaccaaaatgcataatcttttattcttttcacttaattcctatttaattattaacatctttagtcatattttccaattctcgcaagagaaaaaaatatttttttcttattactttgtaccatttattgttaattaagtacaaaaattgtaaaataattaaaattaatttgataaaaaaataatgcaaagacaatttaaaagagatcttaaaaagagataaacaaaattttcaagagtatatacagatatgaaaataataattaactaacaaacatcttacacatcatgtaaatatttataattatagatttttttatattaaaattgtattttttaaaaattataatatttttttttaccttttacaatatactttactttatgttaaggtttatgtgtgtatatatatatatatattatacctaataatatattttatatatagtatttttatatattatatattattttttatactagatacacgtattatgatgtcatgttattttctaactcagtttctttcaaaagataaaaattacgctaaattaacaggatagattaaacaaaaagataacataaccatatccggccaatacatcaaacaattaattacaattaaatatgatagttattttattctatcctactttaaccaccaaattccctaacctcccaccacaatgaagtttgcctttttcataagatcacgttctaatgtttcaaagaaagaaaaaaaaaacgaggcaataaaaaactaaaactacttcgttgaaagaaacaaattatacattagtaatttctataacttgaagaaattaatctctaactaaaaggatacgttcagttgttaaccccccaaccccacttcaaaaacaaaaaaatgtcgtgttactaatcaagaaataaatttatataagggaacgtaatgaaatagacaatgctatcagtttctttcaaaagaaaagattttgaaagaaactgacagaagagagattatgacagaaaagaaatacacctgatatatagttcataagaatgaggagaaaattatttaaaatggtcaaataaaattaagttaaaagataatttagtctacctaatgtaaaagttgtccagtccttcaaatctctccaattttgagtgaacaatttcaactaccttctccaaaattttggatcaaacaaataaaaaattataataatacttatcttccattcccccttctatttctcaccaacggaacactaactaaaggtcgtggagataatatttcaaagcaaagccatattatatataaaagacgatatacaactctatggctatatccatcttcaacctcaaatacagtgtgcacaagctttgttgatatatttacaaatacttactaacaaaactatggactttcaatatctgaagaaccggttgcattgatctttgaaggcaattcacttatggcaattaaccatagcaccgaattggatcattgcagcctttagaagcagattgcttgaaaccaaatcggccacctttctcaaggtactgctgatggtactcctctgccctgtagaacttcttggcaggaaggatctcagtaacaatcttcctgttcaactgcttctcctgttgctccaatgactccttggccgccttctcttgttccggcgtgtagtagtatattccagatctgtactgtgttcccacatcattcccctgccacacaacaagatcaaatggtaactaagcgcttaagcggtagaatgtacaatccatgtatgtgctgctgcatatcataactagtcaccatattttcaaaagttcgtgtgtgcatggatttggatggaagagtgaattcaagaaacaaaattattaagaatgcatattgaaaggggagaacaaaagaaacaagggacaagacaaaaatgtagcaaaggaaatactgaaatagattactccatatggaaacttatttttggatgctcacaagtcattctagagagccatgtataattgaagtccaacataagaagttggaactagtacattgccacactgaaattaaagcaaaatcatcattgcattaactcctaaatgcaactgataaatggagttacagaatgtacaaagaaaggagacaatccatcggatgttaagatattggatcaatgataatcataggagctggggttcattgcaggttcttttgaaaacagtgctcataagaagagatgttttaataagagagtttttgctgacaagaggaaaaaataaataaatggatggattggatatcttacccatgaaacattattaatggatgggttgggatttttctttatcatataaagtcatggatggtttggatttttttttaataaaattctaccacatcataaatgaactaatggtttatttttgaaccatctattttaatccaacttaatttatcctaaccatctattacgttacacccctataaacatcccaccaagtgcaaacagaagggtaaaaacaacctaaacaactattaccaagagacccctgcaatttgatgcgacccaaaattcaacacaatatcatattaaaacagaatttacaaaacagacatgactagatatcaaaccataaatgtatctgttaaataatggctacatagagaaaaccaaaattactaatttactataaataaatcaatcaaggaatcaaaaaagtgttggcaaaatgtttaactctagaagtaatgcatcattaaataattgtacagaaaccccaaaagtaacaaaaatcatttatgctgacaatacacaaagtccagacctattattcatatcagcaaaatctagaaatatcaattagaaaccagacttcctcattttttacatgataccgtgaaaaataaaaaaaataaaaaacttcatatatacctgtctattcagtgtggtgggatcatgtctagcccagaacaagtcaagcagagtctcatagctacaactttttggatcatattgaatccttacaacctcggagtggtttgtggtccctgtacacacatcctcataggttggattatgcacaagcccctgggtgtaaccaacctctgtcttggtcacaccaggcaccctctggaaagccaactcaacaccccaaaaacagccagcaccaaactcagcaaactgctggcctggtgctggtatgtcatcatctggaccctgaggaatggatgaatccatgttctctggtgctcttgcgctgccaaacccgagtctgttcaacaggttcatggagggcttgttcacggcaatgtgaggacgagtttgggaaaggaagcacggacgcttgacagaaaatctagaaagtgagggcaggaacttggttttggcaggactggagagggaagaggaagcaaacactaaaagcaaattggacgtggtggtgtagctgctgctgattgctgctaagcatttgagtaacatgagagtccttttctaaatgaaataatcaacttcaaaatgctcttgtatatatgaaaaaaacaaaagagccaccaaatcaggatgccaagacaactgaagttacaaatttgaacagataatcggaagtttaaaaattaattttgaatcactcatccatatggtgctacatttattactataccacatggcacttgtatattggtaaatggtaatgataaaagttttacatgaatcaaggatcatctgaactaataaaataattattctctgttttcattttgaattctcacatataattacaaaaatatcatcttatgcttactttgttccctattgtcaaggatttgtgctaggaccaaccaaaataatttgtagaacatggaaaatagtaaacaaagtaaatgtaagataagatttttatatttatttatgaaaataaaaattgaatacatatattttctgaaaccaaacacgtcctaaattttataaagataattaggtttaaaaataacttaaactcccatcccatcacatcactttatgttctagtcctaatcacatatattcctccctctaacttttggatattttttcttatagtatatgtgttttctcccccaaacatggactacaactttacaagctgcagactcacatacaactgtgcctactattgaacactaatttaacacttaaacacgccactattttttattcaaataaaacaattagccgatactctttctttcatgcatgtatgcaatcagacagaaatagagaaaaacaaatccttgttatgaaatatagaagtgatttatggtttaactattagcactcacttgggggaagaaaaagaagacaagtagtatagtataagattccaatttcatagaatttccaataaatggaaatccgtattgggtcaaagattgtgccaataaataaaattatattttctcatgcaaacagctggcccagtgtgcatccattgctattcataaattgggaattggaacagaatcacataaaaataaaaccaaactcacaagacccagaattgggtgcataaacatgaaggaaataagtccaccaaataaattaaaggaaatccaatatcaacccatacctgctccacaaattctcatcttcaacccttcaacaaattacaggaatcaatctccacacaataataaaggtaatttttttaacactaagaagaaaaattgaactgaaataaggagaacccacaattcccttttcctcacaggttaaaaggaagagggaaatgggagaaattgaattgagaaatgagagaaaacgtgcaattggagaatgaagaacacaacaatacgtaccccaagtgactgagtgagagagtgatagcagaagagagagaggttgctggttgaggattgagagaagatgaggatttgatcactgcaaaaaaagcgacccttggagctgaacaatcatgctttatcagtttatctctctacgctggcatcaatcccgaaaagacttaaaagcccctccccaacttaccaccaccttttaaagtgtaaagggtagggacgtcatttcccaatcaaaatcacattaaacccatcacctttcgtgttggagtttgcctggaatgtaacgcctagaatattacaaaaaaatagtgcatctaagggtgacacgtcatgaaatatggttcatgtattattttttcacgattttagagagatgatgtataaagtaaaaaagtgcaaatttcaaattatttactttttattaaattaaaatatctcacaatttatcaaaaaaggcatgaatcaactggccttgataatataaaatttagtgttatattttttttttaatatatatgtactaaagattattttttaaaataaaataaatcaagttaatttataaaagttgtttcatttattttttataaatactttttaattaatatataagttaattttaacttataaaaattgattcaatttatatttatatttttataaatatttattaaaaagtttattcaaacaaaagctttacctcttaatagggaataaatcccattagaaatgcatattccgattgatatcttccaattaacacaaactaaaaagccccttttatctagtttgtgttccttttttttcttgctgctgttttatttttcgtatatgtacataaaaaaaaaaacacggaacttctttttagtacctttagaaagaaaagtttgggtcactactttatggaaacaataccatttttagtgtcattatttctatttttatagctataggtttgcacttttatcttataccagaagccataatgattatacaacaggggtccgtataaactaattgttttacacttcttacttgatgtagcttgtagcttgttacatgagaacttaatttccgtttgggtatgtgtccttggatttaaaaagattttttttttccacctgagtatattaaaagtcggagttaaaagtaatgatgtaattaaaacaacttaatataatatatttattacgttgttatcagctttttacgagattttttgtgtgtggtgtgattagctccttggttttgttaatgttcttatcattttcttacgtatagttgcaacttttttacctattcaaactaacaaacaaatcaattcacagggcgtttgtttcactaattatttatttaattctgaaaatattttttcttgagaatatgacagagaaatattattcacaagtattttaaaaaaatatattatatatctgataataattattttattacctcataataagtatgagaataatatttttcaatcttatattttcaaaaataaaaaataatccgtgaaataaatgcgttgcagtacataaagattatgatgcattcttcgggcaaaaggaaaaatgagattaggattcttgtttagtcttttctttagtttggattataattggaattggtcctttacattttggttttcctaacgagggaagttcacaaaggaaagtatacatttcttcaaggaaattgttcgtttttttttttctttacatcgagctattgtttgtttagcatttaacaacgaactaaggattaagttttgaaaattttgaaaaaaatggttaaatacagtaaaataggatttcgtaatttttcaagtttttacttatataattgaaatgtgataaatttaagtttttttctaagtatattttattaaggttttttttaacctctcgccttaaattttgataaacaaaaagaactaaaattggattggcttatttatttataacttttttgtgaagagatagagacgggttatgtatctaataaaaaaaaagagacaggggttgtaacattggtcttggactgtgccaaaggcccatagtacgtaaactcaatcgtgtcgtgggctttttgtcttccacaacaggcgaccgtaaaatactctgggcttataagttcggctcagaattaagcccattagggtaagaaataagtgtaacctcaacctcaatggtctggtctgaactgaattataaaaaaaaactcactgaacttattcaactcaaccgaataaaaaaaggaattgagtctacactctacatattaagtaatatctctcaaagattaaaggataaaaaaaggaggtctttaattagtaggtgtcggcaaacaattttttaaaacattttgtggtcttatatttttaagaaaaagataggggtccacttaatgatatagagtcaaacgatgatcacttgataactgcaacatagccattacactatatagtagatagccactcaactctgtctttgtatgtatatatctttgaagaatattacaacattcattttatattgaatttttgtcctatataacgggcattgccagtaaatttttttattttatttttatatcaagcaatttcccaatgcaatttgtatgcatgtgttttaattcaaattttatttttctttttatttaaaattgactttaaacttaatgtttaaaatgaaaactttgaaactaaaataaaaattattttacatcctttatttcttttaatttaaaagaaatgataaaacaaaaaggagaagatagagtaagagaaaatgtaaaaagtgactcaaaattgttctttttttgtattgaaaatctacttttttccgaacatgattcttcagcacacattgattagtacattcagtttaatatgaatatatagaatggagatttttttttgggttctttaacccggccagttattcttgaaacaatcttcttgtgttgaattaattgggactcccaagtcctgtttatacaagagtaactaacattaatatgcaatgatgtaagttttggagtctcttaactatttttggtctgactaaaagtttagatatggactagagtagtttttttactctatataatttatattactgcttagaaaagaaaaagaaaaaacaggtaatcaacattaatatgaatgtaatagattgactgtagtgtaaatttactgatctataaacaaaagtatctgactacaaattaatcctaaaaaactatatttacaaattaataatattaactaattacaatttctataaggcaatttctatatatttattattgtctcatttaaaaaaacaaaaatgtaaagctcatcaacaacaaacataaaaaatcaacgggcgttagtatatatgtaatatttcccaataatattttgtctatcacttaatattaaaaacctttgacaatatttaaaaaatatagttaaattataaataaatattactaatatatttttgcgacattttatccaatgttattaggtataacccatgttgttaaagtctaaaaatgttaaaaaagaatttaacaattttgatataatgtgaaaaatattttaataatatttgtttatgatttgacgataatttttaatgttactaaagatttgtagtaatgtttttattaatgtttgataaaaaaaatgtcaatggaggctacatatgcagtagttgacatgttgtgcagtccaacatgtattacactcactcagatgtgacttatttaacttttataattcatattttcttatatgccatgcttaaaacataacgccgtttattactgattattcaactttgatacacctaaacgtggaaagtagaaaatttcaactataacctattgtgcttttacaagtcctaattaattaaggccgttattgaaatagagtagtacatttgacgcagtagttgtaaaacgagcaatcaacatcagttacacgcggtgatttttaattaatatttaaggaaaattaggtagctactagaaaccaattattttcctttgattagttaattactaacacaggtacacaactacacaagtcttgggcaaaatactatgatattcatttaaaatttaaccctgcaatgttgtcaaatgaaagccaagtaaaaacattaatattttagctagagtctgcagctaactgctgcttaattaagacttagaagtcaaacaaagggaagatagtagtcaacattcgacaagttaaaagtcatatttgaattgaccatataatatataacaacaatgaaatggccctagaaaagaaaataagccattgggagattaagatagccatggcgcccaacatttgcatgcacacataaagtcatgagtggctgcacgtatttcatgggtgcagcacgtgatccagcattcgcgtttgtgcaagaatgattcaaggttttgatttttagaaatttacttatattttggataaagtttcttagaaatttataatttttttaaaatatatagttttttttcaatcattatttagtgattaaacatatcaaactctaaaatatcaacatatataaatgcatgttacattatcaataaatagagatagagatatacttattacaattcgaaatcgtgctatgcaaatttgctttaactttaactatctaaaagccaaaaggttgactataagctaacattcgcttttattcatattcaataagaggatagcacgtttgaaatggcaacgaaaagaatcttgtgacaaaacaacctagtttcatatttgttcttccccagctcaaggcaaagactatttaaggtggattttggaaatctcatatgattttcttcgtactagtccagtttccatggagcacttgcaatgattttgacgattaagttagtatttgcaatagtagataaagggtgtaaatttatagagataattgtttacttgggactggaacatgttcttaggtttacttctaaaattattattgagttaggatggtgtctcttgcatgataacgcatgttaagtgtctttaaggttaatcccttgatttgcagtaaggtattaataaattgtgttcatcatctcgtgcttttgtatttgcatgaattttatatgcgtaagaatatgatcgttgaatgagaggggcattgggctatgataaggccgatgagtattagtaaaattaatttcaaatcatattaattttaattaaaaatattaagttttttttaattataaatgcaagttagtagtgaaacttagtacatgtaaaagttatctactcaaaatcaattcatcaaaagtaaaattaaataaatataaaaatttacatgaaatcacgttaactgctattgaacataattttaaaacatcccaagtgaaactaaacaaatactatatcattcaaaatctttaaacacattaaaaactcaatacatagatatacatatttttttcaaccatcgcactggcctattaaaaaattgagtttaatatattcttagtttttgcaaatataataagttttaatttaattctttaaaaatataactataactcctataatttttaattttttttaaaataatccctatctctttttttttttttttaaaggaagaagtaattacggtgttatgtaacgcatcgttgtagtccttctggcttctgatatatataacgcatcaagaatgtccttgagaataggtctgagaggaacagaggaggtaaaaccgatcgattttgacagtgtgtatggaatccaaataaaaaataactctatataactaataattatggaattgactatgtcgttgtttaaatgaaaagcgttctttaacgatcgttgtttattattgatcatttttccacaagagtcgtgtagggagtatatataagctacatatataattagggttatgataatgaaaaaagtgtgtttgggtcagccaaatagaaattgcacgtgaaaggaaggtagccaaacagcaccttcactcaaagattccgttccctaatttgtgttcacacctgacgtggctacttctatttgaaacttgtcctcagattccaggtttatacccttttcacacctaaaacctaccaactaattccagcttttattatcactttatgatccctccatatatatattttgatgaagctgtgtgtttttaagaacacatttgatcaaaatctgacatggaatataaaattaaagtttaaccgcatacttaaatagctataatttatttgtataaaaaagacaactaggtttgtctcataacataaaaaggcattttccaataaatttatagtagcatctaatttcatataaagttataacacgagcttcttgatcatttgtcacaatttgaagggaaatgaaaatgagatttgtatcctgagtttaattatataataactatttttctacatactatacaaggagaaaaaaattctttggcaacaatttatcgttgttggaaatgcccagtttcgtttttgtctatttggaaatgcctttttaagtaattaaaaataatgaaaagaatatagataattcatttaaaaaagtttacgctagattcctaccatgcccatgttcacacctgaaacaatattgaattgaacatttcattgctgtctgcatgacaaaaataataataataatttaattggtgaactttgaggggcttgacttgtgcttcgcggctgttcatggcttgcatgccactagattgcttaaagatacacaatttataaacttaaatacaattctgtaattatttttaataatattattttatttcggcaatttaaataataaatatgttcattaaaaattaatataaattactgaaataaacctttaattttaattaaaaatatttatgaaattgtatctaaatttcgtcttatcagtatttatgcttcaatattgttctacaatttttgactcattatttttttcagaaaatatctggtaattttactgtatatgcaccaaaaaaattcgccctacttggtacttgcttttcaggtataaaataataaaataaataatatattgaatagaaccttgagaagaaatatattttttgtctaaatcacaaatatcttttattagagacttagaaaaaatccttaattatagtaaagtgaaataaataacgtaattaatttaataatagtgggcttgctttttttttattagaatgcaactattttatacaaaatataatttcactcgagttaaatttaaattgatgagaaaattatttctctagagatttaactcaattatatatttaaatttagactcgaaatgatttattaaattaaaatcatcctggctaataaaaatagtgttacaaaagtcctatgaaagttaacttacgtccgtgagttactgtggatcacctggtatttgagtacgattcttttagataaataaaaaataaaaaataaaaaattattggctcattctcattatttataagacattttattgggatggcaaaagcaagtagagccgcgccagtcgaagtctaagcgtcggctagaatgtgatcccgtaagataccttgaacttgaagtccgttagagtcaaaggggcccacacttgccacctaggaaatcctacgtggcactacttaggtttgacctttcccattttctcatttaattttttcattacctatctctctatatatattggtaatatcatatcacccacttagctattactttccatcattgcaattcataaagccacacaaaacaaaatgggcaactgcttgaggcgcgaatcgcggattggatactccaccgacgaggacgaggacgaggacgaggactgggaggattttccggcggcggagagcggcggtgttaagaaaaggaggagagaggtgaagataaagataacgaagaagcagttggaggagttggttggcaaagtggaggtgaaggagttgagaatggaacaggttttggcgcacttgatgatcaatcactctcttcaacgtccatggaggcctgctcttcaaagcattccagaagatcattaacgtaattaattagatattggagcagtgtattgggcctattaattggctcaatccttccatcataaactagggttttgtttttgttctgtgcttctaggggaatgttaatattgtaaccagggtgggtggatgggtgcttacacttttttctttcttttgtaaatacaaaactttagtacccttttgatgctataccctacatatatcactattagaggttgatttatcttgatctactatcttctttttacttttctcgtccttctcaatttctatttatattattaattgatacaaaattatttcatcttaattattattttttgagaaatagacttttgctatctgaatattggtggttttacttaattagatcatgctttgtctttaatgaaagatatatgtgaattataaaaataatttcaattaaattgtttgtttgtctttctgatatgtgttactttcaagagataataatccacaataaaacaatatatttttctaataagaattcgaattttgatttacttattgtgaagaatgattcttttgctcgaccgaactccattggtatgttctgttcatgactgtatatagggatataaatttttgtgtggggttgagaaatgtgatgagattctgtaacatgtttttctatctgctccaccatacatattgtgtccagggtggccaccactttcattcttcaacttgagtggcgagtggcgtgaatgaatggttgtgagattcgctttcacaatttgttattagttttttagtctctataatagcagcattgaagttgacgagaaaaggagagttgtttttttaaggcttggtaagatcttcgaaaaggatgaaaaaattacaaatattttttttatatttctgattgatggctaatcgacttggactatgtttaccatttttttctcctaaaagctgactcattattttttacatattgtatgaagtaacgttaaacggtggattaattagggcccgcgagtaatttttattcaaacaaaaatggatatttttttcaacaaacaatgggaagctatcactttcaagatacgttgcctaatattacccacatatggttcatctttgaattagtaaaacattatgacaatggatggcagtgctgtgaatagtagtacatatatgggaattaaaacatggtagattaattgaatggggtgaagagaagcagtgcattggcaattttgaaatgagttgcactattaatttatcatacatgtcccacatgatggaaaaaaagattgatttggaaattggatctgaaagttggaccaagtacaagtcatggacccaacaccatgagattaaactgtgcaaatgctctagcctacaactaaggtttgtatcatttaatgctaagcttggagtagtaggtatgatgcctattcagcattacacactttctatatatttttctaaaatatggtgtaaaaccttccaaaattcctagggcaactaaatctctttgtcgtcactatcgaaatttggtggttgatcaatcatgaattaatgagagctttgtggatagaattacatctcaagttttgagttcacactgctcctatttcctaagtcctaccacaaatgtttgtattctagtctgccggcagtacttccaagtccaaacccaaaatatgactattataacaacaaattactattcctcaactttaaaataagtatcattttaagattatgtacaaaaatttaaaagtaattaaacactctttaattttaaaaataatttactcggattatattaccttttcattttataatattctcttattttgcttaattaatagtatataaaaactactatacatatgatttaaagtatttttttaaatgaattatttgctctcttttttaaaaaaatgacgaatgatttaaaataatttaaaattttgtgttggttatttgatataaaaagctccaaatgtcatatctgaaaaaaatttaacaaaaaaaatctacactgcaaagatacgtttatccaattcagtcaagttaggacagacattttttacataagaaaaaactacttacaggtaatctactagcattatttttttaaaatttaaagccaatttatgtatgcattttcacaggcaaaaattgagtgaatgagtcttgttataatagctttgtttaaatttatgtcacatgttcaataaagatgatttttttaaggtgactatggcattggtgtaacgataaaaatgtgattgaattgattttagtaattttattttacaataaaatatcaaaaagatttatcctccctctcccgagtatcgctaaataagttctgcagaagtacttatatggctatatttgaataatgcttttatataacttcactatagtaattttctattacaactattgacaattaataaattttgtattgaaacttattggatgtttatttattcaatgataaataatataccgatcaaaagaaattccataaggtattaaatatttttttgtagtgcaatatattttttcattggttcgtatgacgttcatatgccatatagattgcctcatcatctttaaaagaacaccctgtatacgcacacgcacacaatacgtcacccactcgatctcaatgcttacaagatgacaatctttctattggtaagtggtaaaactaacaactacaatgatattagtatagtaaacgagtaatgttcacttgacatgatataccatatcaatatcaccatcttgtaattgcttttcaaaataaaattgacttccccatcatcgtcacccatgaatatgatattgatatatatgttgcatttatcttcttgtattataaacgactgataggagtattcactaaaaaaataggagtatatattcactgcaatttgcgaatggattaaatcattattttattacaagaaaaatatcgacagatttgtgtatataattaaaaaaattcaaaattgaaacgtggttaaaaatttaaagtaataacactgacacaatgtgataatgaccttgttacagagcttttgtattgtttgtattgggtacatgcattattgaacttcataaaaattataatatttcagtacttgattttatttttttagcttatgatttcgcaataataagtactgttttaggaagagggaggaacatctcaaattgttttattttttacaaggaaattatgtatatattaaaaaaaaaaaaaaaaactttgcatgaactacaaagtgatacttagggagagtttgactactcaacagagtcttagtcatgaatgtgtgggaaaagagtaaagagaaaaaatcatgatgggatttcaacgattaagtggtgctattgaaaggagaaaaccaaagttttcatcagagttatggaggaagaatgttaggaaacacaaggaaatgcaaatgatatgtgagcgaagatgggataaagggttggaaaaatagctaaaagacacttgaagaatcaagagattggggacctgaggataaaacatcttggtgatgatggaatctagtgtataagataaagttaagattgaaatgaattgttttaaagcatgattcttgtgttagaatgctgaaaactagaaaatgtgtgatagttaagaaaagtaccaaaaaggaactgaaccaagaactaaaagcttttattcgattatgccaagccttaggtatcaaaagtggagctagagctgctacactctataggcttgctaaaattagagagaaaaagtcaagagatttggataaaaaagaagtgcattaaggatgaagacaataaaatctttgtttttgttatggaacaaaagtacaagacactatagaaagacagaaaaataacttttagaagttatttaattaagtacgtaaatttctatcaggttaaacacaagggacgaggaccaaaattatgccttttattgtaagatttgggagaaaggtatcagttggcacatttctataaaaaaaataaaaattgtttaacaaggttatgagtatgaggcccaagaaaataccagaagagtgaagcagtgatactcttagaccaaattgtaagaatattgatataaaaaagattatgcaaattattggcgatcaagatgaagttatgagaaaaaggtgattgagggaagattaagaaaaaagactcatattactaaaacgatttagatttatgcctaggaggtaaactatgcaagcaatataattgctatagcatttaatgaggagaaatcgttggaataaaaaagattttcatatgttctttattgagttagaaaagacatatgatcaaatactaagaaagatattgtggagggccataaagaagaaagaaatttgtgttggacatcttcaaacaatcaatgatatatatgaggaagttcaagactagggtgagaacacaattacacagtggaatcacaacaaaatttcttataaccataggattgggccaagggttaattttgagctcttatctctaccttagtcttaaatgtccttaaaagtgtatccaaaagtcaatacaataatatatgctttttacatatgtagttctgttggaaaatccatagatgacataaatgaaaaattgaatatcttagatattcttttcttatataaatacaatgaactcacaacttaatttttcactgtttttattaataacaatacctattttctcccaacataaatcaacatatgaaattcatgattaacaataagcttgacggctagaacaagtatttgtaaatttgtttcgagagtcgttatatactatcgttaaaagggatttatatatagtatcaaaagcattcaacactggccaaggttaaaatagtggcgtgagtttatgtagttattgcactaaaaattataaaaggaaaataagtgaaatacattaggtaaaaatctttaccaggaagagaatataaaaaaaaaaaaaaaaattgactactaattagtttctttatctagtctgccactagaggtgagtttcttataatcagtcattgtggaacgagaccaaggaactaatattacaacccaagttgccacaacaattctcatgcagaaattattcagttttattgtctgcaacaaagcaactacctttcatcaatgatgttcattcaaatccacggagattacacatgaacttggtatctcattcaaatcaacagagtgcatcatctatactcttggaagttaacatgaccagttgcttgtgcatgctccactgcctcctgaaatgttcgcaaaaaaaaaaaaaagcactcagaatcattagaacaaaggagaataggctaaggtgggtaaatagaataaagcaaagcatcaggtactgagggatcaccttctgaccaattactccaatttggcatactccacagcgcagagtgaagttagaagtgtccgtgtaactccgtttcctgagaaagtgtagccatgatatattagcatcatgggcatagcataaattgcaatgatactaagtagcagaaataattgggagaggccattcgagatgatatcgaaattaaattgagaagattaaaaaaaattacatcatgcaagataaaacaaactgacttccctttgtattattgcagagttaaaatatacgttcctactggcagacaagatacatagcccaactatctctttcacttaaaaaatgtgcataatttcacctgtattgtttgacaatagaaattggcaaagttgaagttttcaacttatcagtctatgtatatacattaacagctttgcggcacattcactatgttcttgttctaaattgataaaaggtgcactggatttgcaaaaatgtcttcttctgtttgcactaacaattacaaaaatgtcattagtttcactttattttttgtttttaaatatttgcacataaaaacatgaattgaggtgaattttgtaattattactaaaaatagaaaatatttccacaatcctccaaattcaaatgcatcccaactcctctgaaagtgaaaccttaaaatacatgcccaaaaagaagaccttttaggtaccgatattcacaacaaatctgatatataaagaatccaaatatgaagatttatgcaattcaattatctaaatatgataatatttatctctttcttttaagaaggttcaataagaatagcgaactacctctgctggtccttcacaaaatttagaacaagcccttcaacaggtccaatgcttctgtttttctgtacagcaaatatggtctgatcaaactcctcaggagcttcctcaaagggagacatctgacccatacaaggggtgtgagtaatcatcaggcaacatgaaaacaaaaatacatatgaaccttaactttttaatttgttttattgtttcatgtgtagtagataaatataaataccatatacttgtaatctcacaattcacctccaaaaccacaaaaaaaaaatgcacaaaagagaaggaatggatcaacatcaacatcaacatcaataatacaatacctttaacccaaactaattggggtcggtgaagagaaggaatggatgataaaaaaaaaatctggtatatgaaattactcaccactaatgcatcatagtggagaccatcataaatcagcatcactctttcagaataattcctttcctgtcaaaagtattcacaaaaagtgaaaatagaaaagttcagtcataagaggttgcaaaacttgagagcatatagattgcataagagtgactaacctgaccgtacaaatcacatcgagttgtctggatatcatatgctgcaatttcacgtccataataatctgctaatattgaaagttcaattgcaccttcacaaaaatatagagcttaattagcgcatcaaactaacaaaaagttaacagtgctttattgttaaatttgctagtaggagtttgaaataccctttgaaacccatgtcaaattcatcaactacaaaatctatacccaccaaatttatatcaaaagcctaattttagaaacaaaactgaaatttaaacaattgtcgcagaagattctctgggtatccagatgtttaaattaaatttcccaaattttaattaaatctttatgcctctctgcgtttcaggaaaataatatattttactcatatatactccataatatatttatcttagcaaagtttattaaaagctcagatgttaaatcaacctatctttgagtgagtttcatcaccttcaaagttccaaataaaaatgaattttccacacttgaggttacacattcatacactcaccacagtaacaccaaaagtagcagttccaatttgttgagtgaaaattggtaactatttccatctaactttttatttaaaatagccttgattacgaaaaacataggccaactaacctccccacttctccgagtcaagaatccagttacaatactctgtgtttggcttcccaagaaatgcttcacaatatttctgtggatcacttgctactgttgctgctataacctttagcatgtcaaatgacaaatagcacacaaatattaagtcaaaatatgtaagaaataatgaaataacatactcaaaatgcaaagatattaggcaatacaatggtataaaagttccacttgactggtaattcttaaatgatagactatataatttcatatctgaaaataaaaatattttgccatgacaagattttagttgcatgtaatttcatggaaagcattgagtagcacagcatggggcttgacggaccataatacaagtgcatatgatgaattgatgacaaaatatggagatctaccagagaagttacttaagtctcatgtcaggaattaaaaacaacaagagctagcgaaaaataggtatgttgagccatatataatatttcaaagtcagatttttgtaaaataaaaatgctcaaagcgcatttattagtcatagctgcatctgaaaaattcttcatgcagtatgaagataaaaaataactaaatattcaatacgacaaagatccgtaaggaagcagaggtctccggtcatgtgttgggaagcaccgctgtcaataagccaagaggaggacaatggcttattggacaaaggttcagacatgggcttgcattggtcagcaagagtcaggatacgttggatcatctcgggtcgggtgtgagatcaggaagtggcgctggtgtggaagatgatgaagccacaggaggagctggtgaagtggtatgagcaacaactgtggaatgcaggcgttcattgattttgaaggtacgtgaagaagacatggcagcggaaaaaaattggcctggaattgttaggctctgataccatgtaggaaatgttgtagattgcagcttactttattgataataggatgaatgtttatatagagccaattacaacagaaaatatgtatatcttattaggtactagatatatcttatctaatatattaatatctaagtatttcactgatccttagcatttgttgcaaccattttaatgattgaaaagccaactatcagtttgccaaaagctctttttactgaattttaataaaaatatgtctatgactacaaggaacatttcagaataaaaatatgtttttgatttctcaaaatatctagaaatttggtcttagtccctataaaaattcaacatgttttagttcttatatttattaaaagtgaagtggttttagtctcttgtcaagaactaaaaacacatgtttttgagagaaaaagtagggaataaaaatgtattaattttatagtatgcttcaacacattccaacctcatgtattcaacagtgtcatatcacacttcgagaatgacacggttggaggacctctaactagttgggtgaaaagtccttcttccaatcctgtagagaggtctcctgatttgaaaatgaattctacaatacaatgttgttaaaggaggcgtcatggcgtggcagattttttgccaaccaccataggcaattcgtgaagagaagcccaccgtggcgtgtttacatggaggaattttacccttccgccatgttctaccaccccccattgataacactactacgatatgtttcactggtccaaatcttgagtttattgtgtttgatacctcaagtttgaaaaatgatatttttctagtagaaaagatcatatatttaactttgaaatttttgttaaaatgtaggggctaaaaacatattaatctctatattttgtgggattaaaactgaatctcgatatattttgagggaccaaaaacatgttttactccaaaaataaaaacatatcttgaggcaaaagttgaccagccagaaatgaagcacccctcggcactagaagcaaattcacaaataaactgaatacaagaaaaaaattacctgtctcaactcagcagctttctttttgtcatgatccataacatatctgaaacaattaaacaaaaccaaaaggaaggagaaagaacatcacaagtggaataatttgtacaagtagcagtaattccaaaaaaaaaaagggcctgtgttccattgcttagcttacccaacagcattgaaaaggcaactgttatccgaaggaatgacccttctcagaataacaccttccatgatgcagattgtagatgacttaccaacctaaaaatcaatcacagaagaaccatattcaaaatctaaaacacaataactaaagcaacaccgcatgtgtattctgaaaagaaagggaagaaagagaaaagggtttgaattggaaaatggagatctatgctatgagaattgaaaaagggattggtctgagaagaaggagagaatgaatacgaaccaagcttgttaggtgtgttggatttggtataggtatttgaataagaaacgttttcctttcctttttatgcgtcaaaagaattaacattaacttaacgggattgctaccgttttcgttcagatgccaccgtcattttcttcgccatgccccactactctcttccatgcccaacacctagcattcgcaacatcttccctattttattctctgttatccaaaagtattattttctaaacaattttattggtatattcaccattttttctcatgattattttctcccgtctgggaaaattgtcatgtttagtggtcccaaatataattaatttcacattacttaatatttttatttaattgattcttgatatttaattttaataaaaagtattttacaaaggaaaaaaaaaaagtaaaatcggtgcaattgtttgtaactaatttttaattatcgagaatcaattattttttaatatatttaagatagcgagaataatctttatttaaaaaacagacttgcttagtgatagtaatataccccgtaaaaaaatatatagtaatatctcttcttccgatcaaatatgatattttcattcacaacatttattatatttgtaacttaaatgaatgtaccaattttgcaaagtattttaaataaaagtaatttttcatgtaaataattgaaagaaagataaaaaaaaaatatttttaaaatcattaagcatgtgaatcatctgatattagagattttgaattcaaatattgagcattggatggatagttttgtggctcaatgtaatcttatcgaatatgattatttctaatagagaatagttgtgattaaaaaaaagaattaaaagaaagttatgtcaaataatttatttttgcataaataataaataatgactcaaagatgaagaaaatttaattccaaagtttaccatcaaatcctaagaatttatattaataataaaataattaattgaatatttagagtagtctatctatagtaaaaacctttttatatgccatatatttagagaactaaaaaacaatgttttttcagcaaaagttataaccaaatgtgtactaaacatttaaagcaataaaagatgtaacttgtaagtatacaccgagtatccaatacagtgcatggatacttttttagttatataaagcatggatacttttaaatacatgtgccatcaaacaaatatttataaataaaaatagaaactattgaattaaaaatataattattaatattttaacatttttgaataattagaattagtaaaatagccttttagtttctccatatgtattttatgaaaaaaaaaaaaacattaaaagaaccgttatgtgataccgttatgtgattaccaatgcttctaaagttttattttatattttttcatgtaaacagagaagaagaaaataaaaaaacaagaataggatgcacatatcaaattttaagcatttacttgagaagagaaataaaaaaatataagtttcatgcataatcccccctagagtactgtgaaatcagggagaagtgtgttgcacttgatattttttactttttaaaaaaatattattttataacataaaaatataaataattttatatacaaattattttttactgaaatttaatttttttaattagtataatatttttgtataaataatgtctaaaaaataaagtttgataatggaaaaaataagcattaagaaaacttaattcctaagtttaggataaaatatcaagaacttatattaacaataaatagttaattgaatatttaaattagtttatctataaaaaaatctttttctataccttatttaaaaaaaattaaacataatatttatccagcaaaactacaaaagttattaccttttaaagcaatataaaacactaagtataaatcaagtgttcattacaatgcatggatatatttttttgacactgtaaatggtacaatggtaagacactccaataggtatcgggggatttcccagaagaggatcgcacacaatgacacaaagtggaaaaattgaaaaagtgacgttagaaaaattggaactcactcataaagaaggtaaaaattataaatctttaatcacttggataaattcgcattttcaaacaaatactcataaattaaaataattattgaattaaaaatacaattatttattttaatattttaatattttatattttttgcgggaagaaattttttaaataatcaataaatagtaacaaatatcatttaatttcttcgtatgtatcttatgagatgtcatcaaaaaatgttgtcatactaatagatggagaaatcctccaaatacactctttaatacatttttatgggttgtttgtaaaaaaaaaaaaaaaaatactttcttatatgattatttatgatttattgatataatttttttatatttattctctcaattacacaacaactaaatatatattctctaacacactctaatgttatgcaaatgcagaacaatcaatgggtaaattatcccccaccctcactcacataaaaaaaaaaaaaaactaaaaaaaccctcactcacatgaagaagaaaaaaagaatcaatacgtactaaaaaaaagtgggtaaattatcccccaccccaccctcactcacatgaagaagaaaaaaagaatcaatacgtacaaaaaaaagtgcatgatttctttgaataaaagcatatgcacgcatgaagatgaaatcctttcaagcgtagagataatcaaaatcccctccccaaccataaaagaatcagtgcgtagaaaaaaaggagcatgttcatcggataaaagcgtaggatataatagaatcctttcaagatgacatggaaattgcaaagtatattgaatggatcttttaatactcattttgtattaagatgacaaggcctccatagagcttacaaattaatttattcagcaagtaaaactatttattttatacggctaaaaaacactaattattgttttgtaatatagtttactcatgtacttaatggtaattttcttccaaatatcggaaaggctctttcctatgaaccctaatcaaacctgaatattatgaaaattttctgggtagctgaccctctcatttcgttcgtccaaaatccatcaaaattcattcataacatactttatctttaattgaaatagtattttctcctcttaacaggtaattttatatttgttttgttaccgatgatgggaattaatcctcgcaactcgcaagaaagggtgatagtctagccgtggaaccacatttttttatgcaatgtattcttgagaaagtatcagcaaataaatcttcttgtttgaataattttttaatatgtatttataatttataagagaataaaatgagctcttatatatatatatatatatatatatatattagaataattgattatgattgataagacatttaaggaacttataaatttttttaaataacgtataagttcctttaactaaaataagtttattggtacattaatttattttaatagcttatttttcataaactactttaaatagcttattttgataagttatttgaaatagtttatcaaaaataagataacttataagctattaattttttcttcttaattttatcattcctattttattttaccttttaattcaatttaaaaaaacccttaccttgctaaacaatatatgatttgtataatatttcatagtctttcaagtgagaaacatacacatctaagttcttcttatcaaatgaatatataagaaaaattataaaaaaacacttttcattttttgttttaaaataatattattaataaagtatttaaatgttaaaaaatgattttaaacaagagaattctaataaagtttattttatttaatgttactttaaaaaaaatcatttttttataatacaaaattttaaaaattactatcttactttttaagatgataaattattaaaaataaaatttaaatattaaaaatactaaatatatctttttacatttgatatttatcaattaatcttatcaaacattaagtcaattagcttattctaattttaccaaacatagtatttacactgtttaacttttataaaaagctcttttatttagttccttcataattaaagttgaaaactataaatcgattttgcttacagaatataaatatgatttattttatttttatttccttctgttataagtatggatagaaaattctatctaaatactgtacaaattgacacgatagagttatataattatgagaaaggcaactttatgagtaactttaatgttcgtcacttaccttaatatttttttaaaaaataacatctatgtataattacggttacttaaaaaagtaatgttgcttaattaaaaaagcaagcctcgttatatttttttatttccttttttttttcagactttgatagagggagaaaagttatagtttcactgttaaagatgttttacgttttatctttattcttgaaaactggcaaaaatcgacaaatgtttgtcgatagtttgaataattgagtgcatgtttaattttccgttcaaattattgtcttaccaattttgagacaaatccaacattccaatataaaagaaagaatcatgataagttgacaaatttacgttcttcttcaccaacatttagtcaaatatgctctaaatcgttcaactcagattgaattctttccctctttgtcaatgaaaacaagttacacattttcaatatctaaggattgccttcataaacttggttagggaagccagaattgttaacacaagaaattaaggaaaagattatagaaaaaaaacataacagcttaaatattaaggttggatttgatttaagatttcacaaattattttcagaaaagtgaatttgggaatgtcacaatctcaagtttacttcatttttttatataaaagaaaaatatatccacgtatggttgattcttaggaatataaaacattttcatgaaaataaaagttcttttctaaaataactccatattcctacttctttcttgagtttcttccacattgtttcctctactttttcttcttcaaaattttaattaaatatttttctaaaattattaaatgccaaccaaatcaaacatgtttatgaaaattacatccgtaagcatagtattcttggggataagatttttggaaatgtaatattataccttgggaaaaaaaaacctaaattaataaaatgcaaactaatttataatatcggtagagaaatttaaagtataactaatcaaatgataatgtaaacaaaattacaaaagattgaattggaaaaacaagttactaacggatactaatcaaggatcaggatcttctaaagtaaaccttctcattttagggagagaagtgaaacgggtttatctctgtcgtttaattaataaacaatctttactaattgtatattggttactttttctgttacttatatttatgaattggtcaatccatttcagtgacttatatagtacctcaaaaggaattcatatctaaccatcagccaaatgatatctttagttaaagaacaaaatatgaagaaaaagaagataatcagtacgtactataaggttttcaatgtaacgtccacaaatcaatctaaagaaaatagatgtgagttcgagtaaaagatatttattaaaaatgatcttattcatggtctgtcttatgtaatacgatgtcacaaaagctgcaaacaagaaacatccaatgactaagtttctttcacgttaaatagatgcataatctttgagagagaatccgaagattagagacctcgcttggatggtaaatgtaatcacaagagcaccattatccaaagaacaaaactaagtaaaacttcaatactaagatatgtcccttcctgcattattaacctgagtttgctgatggagccagatgtactagtacaattgatgcttatagagttgctatgcactcaatttcaatcttggcatccaatggcaatgcggctacttgataagttgaacgagcagggaaaggtgaagggaagtctgaaatcattggaaaagtaggtaaattaaaattatttaagtaactgtaggcattagtgaaaattaaataataccaacccaaagggaaaaccttaatattttcagcatgctactagtggactctctagtatcaatctagtaatcacccttagtatatattaaatatgacaagttgacaacataacctattacctattatgacaagctaacaggtgaatcttcaagactaaaccataaaaaagcatgaaggttttgaatctaaaagctggtcagtggtcagccatggtacatgtatgttacctacaggctaacacattctcagcccacaaatgcagcaggatcaatttttacagcacagtacaaattattatcagaagtgaaattcattagtaattagcacagttaagcagtttgtcaatacaggactttcatgatctgcaatatgaaatggattcacatctaaacaagttagtgcaagcttcgccttctacaagaatgtaactgtcaaggaaacattaaaaattaaaatcactaccacagaactcacatttagcatagatctcattaactttcttgaagtccttcaagtcagccaacctgcaggaaataaaaactcaaaaactagtaatcttgctgaaacgcaataaaccccaaccacaaatgagtgaggaattcatacataattgtcgtcttaacgaccgacgagtaactagcaccaccggctttaagaatttcccccatgtttttaagaagctacaaagggtaattatatcaaatgtcagcaacaaaatcaacaagtgcattgcaacatcaataaaatgttaccatcatacaatacaacaattgacattcaaagaatgtaatatcacaagacaaaatgttgtctcattctgtacctgttcagtttggtcttcaacatcatcagatacgaacttcccggtctgcattgaagagcaaaacacacatcaacaatctgaagaaacgaacatcataaactaaaggaagtgataacaattaagtgaattaaaaaaacctcgggaacaaggccaagaacaccagacacaaaaagaaggttgttggatttgattgcttgagaatatggtcccagagccgcaggtgccccttcggtttgaacactttccttaatacctacaaacaataaggatcaccattataacaaaaaagtaaaagcttaaaaatttgaaggtttcttcataatgggtacttacgagtttcggaagaaatgctcaagcatgtgaatggcaaagagtgcctcggtgacgaagaggagcgccagaaggaggtgccgaccaccgacaaacaccctactccggcggccaatgaagcacggttgcgcagtgcgctgccttccatcgccggaatctggaagctccgagcaccgcaccacgacgccatttctatatctctgactgactctaccttacactctcactctgtcaaagtcttcaaccttggagtttgtttttggggtctttgctgcaacagtcacttctttttaccaaaactacccttatctcaggcactcatttaccattttggtcccttaaaatggatgggctccaagggttcatgggctgggcccatccttcaccctaataacagttttgattaggcccatgttatttacatacatcttttctctaagttcgcacttttttttagttttcaaaaagactataggcaattgttaaacatatctcccataaatattagatataccttttttttttgttattaaatttacttaaatatccagatctcttatctctcaatcctttctccttcaagcctttctattttatagtacataattgagaaaggttaaaaaaaaaaggaatgagaagtaaaggtgaagatatttaataaatttaataacaaaaaataaaacaatgttgtacataatgttgagtcatgcaataatttatatatatggtttggattaataaaacaattgtgtgtgaaacagaatcagaacatacaaagaaaaggatgagtagcataatcattgttgtggaccaaaaaaggaaggagaaggaaagatatattgaatcagtcaaccatgacatgaaaaataaagaaaaaagagatgaaacctttgatatagctaaattggtcttcatattaaaatttgactctgaatctgatgatgataaggatgatgagccatattcaccaaatcaagaccagaaagagacccaattacaaaacaattaagaaaatgaaatcatcaacttatgaaacctatccaagttaatggcattagcttcttgagtgttctgtagttgggtttgttcttagtcttggtttgacaacatgactcatcatacttgtcattatcttattcagagtcatattctaatctgaagaccaattcagctaaatcaatggtttcatatctttttcctttgttttttatgccatggttggctgattcaatatggctttccttctccttcctttttggtccaaagcaatgattttgccactcatcctcctctttgtatgctcttattcattttcatacacaattattttattaatccaaaccatatatataaactaagacataacttaacattatatatggcattatcatacaatgtatatctagcattagatttaaaagacatgcttctttagctttatttacatatgtaatttaaatatcaatatttattattttatcctcataaagatattttcactaaatacgctcttagattacacacacagttacactactacatctcccttattatgtcgattatttggggttttctatattgctatacgaatcagctaatgtaaaatgttagaatttttcaaattaattatgttagaatggatgtaattttttttacatcatttctaaatagaatcgatgtaatacgtgccaatttccaaagcaaaattctctcacaccagaaatctaaaccaaagcacaaaacaaacaacaactcttcaaacaaagtcccaaattgaatcaacagaaaaaaaaaaacctattaaaaccaaaacacaacaaaaatcaatcaatcagtcaaaaataatatattacctaaatgaaaaagacaagacatggaaaaaagacaattgagtatcaaaatagtgttacctctacagagaattgcacgatgaaattgccaaatctatgtgtgatggaagggaaccctagtgggtgcatggaagatggagtgagggagaggcagtccagatccactctaccactaaggtatcaaccatcgttcggaataattgttccatcttgtgttgcaacaatcactcaatcaatagaaaaacaaacaatgctccaaaaaaatactaattgaatcaacacaaaaggatttgttgaagccaaaaacacaacaaaagtcaaacaattaccgagacgcaatagaattccaaaatgaaaaagacaaggcgtggaacaaaaaatggaaattttgtacacaattaagttatcgaaacgatgttacctccattgagaattgtgtgacaaagttgcaagatgtgatggaaggaaaccctagcaagtgtgaaggagaggcatactgagatccacacctccatcgaggcaccaactactgcctataactggcattccattttgtgtcacaacatgcataagatcaatgcaaaaacaaacaatgctccaaaaatcccaatcaactcaacacaaaaaagtatccgctgaagtcaaaacaccaaaaaaatataaataaaacaatcgctcaaaagcaatagattacctaaatgaaaaatacaatacatggaataaaagatgggaaatttaaagtatatagttgagttatcaaaatagtgttacctcaatatagaattgcttgatgaagtgttgaagtcaagaagtgagatccagatccaaattgcactgaagcaacaactgtcacccacaatcactgctctatctggtgcagtagccaatgctattagaatcacaatccagattgtaggaacgtgcgattcaacgatttttgaagacatctctgtgttgcatcgtcgttaggatcgttggagtgcgagatcagattaaatttgcactctttcatgtgggatatacaatcctatctaaacaatttaggtgagcaaataaaggtattttgcgagctttgtggggactctttcgtgtcgttgttgttgtgttgttgccaaacaacctctgttcttacagtcgctaacctcctagtactcttctatctacgctctctgtctaccataaggaattagggttgcacttgttcttggacttttacagcagtggctgatgacacttagcatttataggagaaacatgtaggtcgtagggtttcaagggaattgggccaaattttttctttattttatttttcatatttgatttcttgggccttaattaaagtccaatttagtttttttaaaatgtaaaatattacatataatataataaataaagaagaagaataagaagaaatataatagtattataagtgtaattaacaaaaaataaaacataacaaagaatataataatatgataaactaaaaaacataatatatgatataagaaattaaagaaaaataaaagttatatattatttataagtattttaggaaaggaaatgtaggatcttatgatccaaatcacatttttccccactcaatcctagataagatcttgatttcaacagccatggtaacaacaaacaccaaattgaaggataaagtgtaaaagggtttaatcgagtaacactataaacactaaatctaaaatatctctccatgtaaaaccaaggttatggtgaagatgcatcaaaatccaactttgctctgcacaagagcaaggttgtaacaaggatgagttgaggtgaggcaaagatgcattagggttaggtgatatccaaccaatggctttgggtaccgtcttcatgtggcagagaaagtgttaaggcaagagggagaaaagagtatcatcctcaaaaaggagatccaatcatctcaaaattgctctatcaattttgaaacctcaaagaataaacattattatataaagcaaacaactcttacaatactgtgggcaaagtgggtttagaacgtagtaatcaatggattattatatagagcggacaactcctataatattatggtcaaagtgattttagaatgtaaaaatcaatgagtaattatcatatgataagttggacgttggttacaatcatgagtgatatatatgatcaatttatacaataaaatcataagataaatggtttttgtttcgggagggttcatataacatattaattgagaagtcattcaatttaatcttataacttcgtcaaatagatattctctaatattttcaaagaaactgatatattgttcaataaagtatttaatttattgacgttgaataaataaaaaacaatttaaaaaattgctataaaagcatagaaatataaagtaaataataggaccctagtgataattttggataaaaaaagaaagttgaaattttcatttaaggatattctcttattagagtttttattttcaagaaaaaatatatctttcccattatttcttattctcttttagaaaataaattgctttatttataaataaaaatttaacatctctttccttttcctcttgatgtcttcaccaaaagatacctcaaatacttgtttttagattgttaacaatattttatttattcacattaactagttaataaattatttaaaagtttgctatgaatgaataggaacaaaatgcagattataagatcctagtaataattttggataagaaaggaaggaaggcataatttttatttacagaaaatattctattacttgagatttttttataaaaattatcatatcacttttccatttttcttgcttgtttgtggaaaataatttattttttatctataaataaaaatttaacagctctttccttttcctcctaattttttcataaatagatgcaacaacgctttgtttttagattgttagaaaaccattcgtttaatgttattaatagttaaacttttttaagtttgctatatgtaaaagcattggaacaaaatcaagtaatttctacgatcctagaaataaatttagataaaaaggaaaggcgaaattttaattcaaagtaaatattatattaattaatatatatttttacaatattagataactttcctgttattccttattctctcttaaaatataatttttttgttgttaaataaaattttaatttgtctttccttttcctcctagattcttcatgaaaagataggtaattttttttttttagattgttataattttttttattcattcacattaattagttaaaaaaattaaaaggttaatatgaaagcataggaataaaaagtaaataataaaatcctagtgataattataaataaaatataaaggaagataaaataattaaattttaaataaatattttattatgatttatttcaaaataaaatattatatagctttccctttatttattattttctttaataaaataaattatttttttatttgtaaatataaatttaacatctattttctcttcttcctaatttattcatgaaaagataccttaaattttttttttaagatttttataatttttttcacatttattagttaaaaaataatttgatttttttttatcgaattataagaataaaaagtaaataataagatcctaatatgataatttcagataaaaataaaggaaggtaaaattttcatttaaagtaaatattctactatttcagttttctagttttttttttttttttaaagtttcgtcttattatttattctcatttaaaagtatatttttttaattggaaaagtttaacacctctctcctcttcgtcctacttttttttattaatatatatatatatatatatatctgtgtgtgtgcacaataaaaaaattaatatgtacaaactgaatttggttccattcttctcaagtgtagagacagtttattctatattaacaactattctgttaattacattagaagagaaacgaattatgttactcattattttgctaaagtgtatgttgttaagatttcatgccagttaatatatatttttattttattttagtgcaacttgtattgagactcttatttagaatcaaatgatataagcttcttccagtaataagaagataggataaagtctctctccctctatatgtatattataatttatatattttatatataattataattttaaaaatcttatttttttataattttaagaaaagtagctatataaataaaataataattttgtataacaataatttattttatttgttatctagtgtgtattaaatattaaataggattagagttaattgtattattttgttattctatgccatggtcctcatcatcatgcattgccattccgaacttgttcaggtggacgattctggaaattgttcacgttgttgaccctcactggaaaaatgggatacaaaagggtattttgaataacaaaataaaaaagaaaaagaaaaagagaggtaaatagagtaattggcagaggtaaattttattaatagcctttaccattgggtcgacctctttttttttttttttttttttttttttcttataaagtttttaggtaagggattgggctgacctctataactgtcttttttattatataaattattttaaaaagtttaaaatgataagttgagtaattaattactttataaaaaaaagcatagttaacacgctctaatttggcaataactttaatagattactatttacaattgaatacatcacagaaattttaattcattttagtaaaaaaaacattccatatctgatttaaagcctagaaaacacactatttatcttttgtcttttcactatacaaactccatatgtactacatggtaggatggtcatcaactccccaattcaataaattttaactaattttagtataaaaaaactcaaattgatttaaatcattattttggttcaaattgaaaaaaatgaaaatttgatcaatttaatttaagtctcgaattttgatttaaagaactgaacatatctaatctatccgattaaattaaatgatacataatatctttatatatattaatgcagagaaaacactccacatctgaatttgaaagttatctatataaagataaggggcaaaaactctattttagtggattttttttatacatattttaagtttactttgaataaaaagtattttttaggtaattataattataatttataaagatgacgtcaatcacaatattggatgtggagaggaaggaaaaataataataaaaccctatcttatgatatgtagaaaaagataataaagtaaatttaataaatattttggaataaaaatgataaaatataagaaggtaaaaatcaaaatgttatattttattaaaataagtttgtttaccaaagactattaatgcgatcaagcaaactttttttaactaataaaaaaattaaaaattaacttaaaatacttgttaaacatattaaagaaaggaactcataaaaaataatgaaaaaattacttatttattgtttgtagttacataaattttatcctttaatctctatacttaaaaatcatatcgttttatctttgcacaaatactttcaaatctctcttagtccctgccattatacaaactttattttttagtcattgctatttataacgacaactacaatatgaaaatacttgtataaagactaaaaatattggttttatagatagaaaataaaaggtaaagtttggattaaatgattaattttttcaaaaataaatatataattaatgagtcttgcactgaattaaaatgaattttgatttgataaaaaaacgagcctttctctttttatcaatatttatgtcctattaattaatcgcatgttgtatggatttaatcaatcaatcaaatgaggccttcattcaaaaaagtaagagcaatgaaaacatatgttagcacagagatcttccacctatggatggtgaagctatgcgtttattcattttcacgtatcaactgccaaaacagaaagaaggagagggttactgactttaatcttaattagccaatcattgatttggaataggaatattgacaattgttataaattgaaaatgagagtaaggaatagaaagacctacgactacgagggagaatgggagtgggagatgaaaacttcagagtttagctttattttccgctcattaatttagttttaaaactggttatttatttcttacatattttatttacttatttattattgatgtgacatcatatattcactgttggtctatttctgtgttaaaaaatcagtttaattgtatattgttgtggcaaccatatatttatcacactattccaggacaagattttcgtatttctggggagttgagaagtggcaacttcattcctcacttccacgatattatcagaaattaaatgtgttactactattgcgttttgatcatcaaaattattgtcccaactgaaatttgttatcagtcttttcataccttacataaaatgtgtttaggttgtttaaaagatggttttgggccttttttgggttcacaacttaaattttaagttctactggcccaaccaaaaagttcaatatacctgcctgtttagtggaagaagcatttttgttattggttatgtttcgttgtgtttttcttcttcttttatttcagtaaacctttaattcagtctttcaagtattattctctcttcttaatagtccttgaactaatgaaattatataaataatccttagaatattgaattagcataaatttattccatatattaacatgttttactaacgtccaagaattaatttgaaatattttttataattgggaattatgtaatacaatttttaatacctgagggattagttttataatttctttactttaggaactatttagcagaaacaataatactgtaggaataaaattgttgttttattctttttaatttcttcaattaatcttagtatgccgtttaatttatcttctcttgcacacgtagcccgattatatatatattcgcaccacatcataactagtacgttaattttattcttattttttatttttttgtatttaatgtaatgaactaatataaataatgttatattataattttgataattttatcttttaaagaaatgatatttaatgagaataagagaaagtgtcaacattttgtcaatattagaagagttatcataatataataaagataaaaatgaaaaaaaagttagacctaactttttttttttgtttcaaagaattagaaacctatgaacttaaacgttcataaaataacatttcaacaaatattacaaactaataaaataaccacttttacaaactcctgacaatttctcaagatcaggtgaagtgccacatgttttttgggtaaatgtgttacacgtttgtattaggttattagccattagctattagcacttagctgaaaagatattttaaagtgaaatgaaagattccaaaaatcaaaagtgtgattctcattgttgataacaatattactaattttacactttttttaatttctttttttctttatttctctaccgtacctctctttttcttatataacattacattactccttataatttttacttctctttacgtatttttttatatctttcactagatttttcttttatacatgtatctttcactagatgtatacacccaataaatttattatgataatttttatcatgatttggttaatttattgtttttttaataaagtaattacctctggcagtacaaaataattatggattcaaatttctctcaacaataaaaattaacaaactaacaattaatatttgttaaaaaataaacactaacttcaatcaataatggcaattttcttggaagttatcaaaatagaatagcatgtgaaatgctaaatagtcaacttatggcattttagttagcaaaaagatttgtataagacgagggaggaaatagcactgtcccttaattggtatcacttttaacagactcacttcagccacaaatttgctcccattacatagggtagattcatgggacatagctctacaaagacattgcagccttggtcttttgcttgcctttataaacataataattaacataagtatgtttttgttaagattttttttttttataattttgacgatttaaaaaagaatactaagattttgttttttccccctaattaaagaaaccccaaacatgtacataaggacactcaactgactcaagtattcatccaaccaaaactataacacaacaaaataaaatcggcatctccacaaaataaaggttgctttagcaactcaactagccaagcgggctaggaaagttaattgtgacttgaaagctaagttcttttgtagcttcaaaaacttaaacatagctttattattgtcacagaagaattaagaaaagcaaaaccactttgtaaataattaacccaaaaatgaggaggccgggagggggaagaaagggcataaccttttcctttacccaaaaagatatgtgaaagtaaattcatctttagtatccaaaaaaacgtgctccattttttaaggctttatgtgattaggtccacggttgtgtatcaccatctttagcatcggacaattatagttctttgtgtgtatttctcttttacctcaataattattcatctaacaaataacttaatttacaattatcaatacaaaaattaatcctacaaaaaggagataaaaaattaataaagaataacttttgttttacaaaattatcttacattttcataaatataaaggtgagaatgtttattcccatatttaataagaaattatcagaaaatattcatgaatatcttttattcccaaaaactgtaaaactgggcacaaaataaaataatagtgtttgagattctctattgaattacaagctaaagaataaactacaaaggtagcttcttttttttctcaagaaagttacattcctatgtctacaacttttcttcccattctaatgggatgagaaagctccaaattgacttttatttatcatttattaatctgaaaaaaaccaatcacgctccaataaaaaatctcgatatcatattcgtttagaagaaaaacaaaaattgccttcaatattattagaaatgttaaaagttaaccaaacatatttttatatatgcttaggaataacattcctcactacaaatttatgggaacgtaatttctaaaaatacaagataattccataaaaaaataccctaagtattatttacaaagaaaaacttgaaaactaaacattttcataatgttgtatactgacaaataattttttttttcctgttaaagtaataattacttcaaaattaagaaatatcaagttaacacggtcaatgtagtagttagatttaaagtcccaataaattgttattcagagctatgatttaattaatttagtacataaaaactaaaacttgataaaatcatttattaagaaagtctagttcaattatttgagtaagatttatgagttatgataaatcttttaatatcaccttctattactgtggatgaaaaaaacattttatagtttaaaaattataaagtaggattttatttgaagtgttccttaaagcaacgcgtattgtgtatattttccttccatttcttatcattttagcatgaaaatattttttagtgtggcgcgcctacaattttttaatttctctccttattaattaaacttaatcaaataattcaactttttttaattttccatctaatttcatctctcttgacattttttttttttacctatttcacttctattaaataaagtgcaaggaaagttaggaaacgcttagattgtgttctctcacgttaatttctttactcagtgtttctaataaagcaaaagtgcgagaattattttaattgaaacatagaatctgttgggggtctgagaatttgaccagaaagtgtatgatttgaatgaaataaaaaccgtgaatgagttgcttgctcgtgtacacgttttcttgcttcagagttaactactacgcaaatgataataattatatattgtctcgtgtccacgtttcatgatttacatttcacatgtgtcctatttcatttgatgatcatatttttccaattaatttccatcatatcaccgtcatcaagcacattatttttctcttttagttacgagtagatttcttttatttgtgattagcatattcggcgaaggagaaaaaacaagagaaaaaaatgaataaaaaagaaaagaaaaggaattcattaattttatttgatttttttaaaaaataaatatattttttcttcataaatattataaaaataaaatgcattgcaaggattattttttgaatttttttccctattcttccatcacacttcctcttatgggagggaaaaaaattgaagcaagattcacacttgttttttttctttgttttcttcttatttcaaacagaaaaaattacctcttattgatactgtatcttagaatataagatacccatcaaaatatgtacattaaatatgctctaattagaagggggagttgtgtggattttaatatgtttttcaaagataatttaaattattcaatataattttaaaatgtaattatatattaaaaagtatttatttattataatttagttataatacacttaataaattataaatatttttttattataaattataattttataagaataaatatttatctaatacaaatttagcttgtataatatttcatctaaaatgctagtttttgttttattttttgaggtaaaatagagactaactataactagatattgacatttcaattatgttgacaccttaataatctaactaaaccagctagccttaaaatgtattaaaagatgacaaaaggtccgtacaaacatgggagacaaacacggaagataaacctaaacgtatgaaaactaacgagataaactctatttaaacctaaagttaggagaagtgtttctatcctttatggtttttgttttgttttcttattacttgttaattatgttgttttaattgattgacaatttaaatgaaaataaaagagttaaatatataatttaggctctccaaaaattcattgaatttggttttatttcttgaatttttttaaaataggtgaattcagtctctcatcctaactttattaatattttgttggcatgactaataacgatcatatggatatcatatgtttgccatgtgacattaaaaaccttttttttaaaaaaaaaaaaaactaaatctaattttgatcaaatatttaaagatgaaaatcacaattttaaaatgcatttaaggttaattttgactaaaatttcaggaaccaaaaacacattttataacaataataataatttctcggcacacttgtcatttttttaatattgagaaaatgctctacaaccaaaacaattttttagtatgacttcatgagaattatttttattggaaaataaaataaaacacttacaaataaatgtaacgtctaaattattagaataatgtctcacactttatcgaaggaagcataattttttcattgaagaccccagagtggcatgctgatcctgagttcttacgcaggattcaatttgaggaattgttgatttctacttaaagatgtatgttaatttaattttagaagattttcaacttcaaaagaattaagtgtattgcacacatttccttttttgttaaattaaggatcatttaagtcaacctttatataatagaggcacatgaaaatataatattgtattaaattaataattaatgatttccaataatgtaattgccaaaataaagagatatgagcaatattatttatgattatatatttttatgatctataaggaatctataatgctatttatgaaaattataaaatttgattttgaatccatagaattgtgcacatactaagatacacacatagtatctccatagcgttttttttatttattctgacctccacagctatttaatgatttggttaatttacaaatatatttttcaacattcttttatcaatggttcttttctcttgacacaatgatcttaagtgcgaagcttatactatctcagataaattttttcattacgcttattggaaatgcaaaagtctatccaaatacgaacatgagagcagcatcaccttagtccttgaagaacataaaaaatacaaaaataaaaaccttagacaaaataatttttttttggttactcattaacaaaaattaggtggcagcatgtggtgaacgaatcaggagaaaaatgcggtgttggatacgcatctctgattcggtccttgaatcataagaaagaatgaatcaaggaagtttttcttctattatatggactccctccaaggctctaaccttgttttggtcgtaaaatagtttcaacccttttttagttaactcgttaaaatccgaatcccacagttgactcggttctatctttatcctttttgttgagattctttctttctactttcctctcctcctttaaaaaaccacatattctgatccattctgcatcaacctttgtcttctcctcccccctccccccttttctctctcttcacacttcaatggatattctttcttgaattctcttctgggttcattccctttttcattctttgactgaatcttcacactttcaagtagttggttgtgtggtggtacctgataaaacttaaaaaatctcttcccttttggtgtcagaaccatgggttgttgtctgagtaaaaaagggtcagagccagaagaacacattggttacagacatgttgccggtgctgggggtgctggtgtgtacaacaatcacaagagccatgaaccctttgccacccaaaccaaacccccttctcaccaaccataccaattacatgagaaacatgctcctcctcaggcaccctggaggcctccaccaagcccaaaacatgttcacaagcatgacacaatcactgggaagccatttgaggatgtaaagcagcacttcacacttgggaaggaattggggagaggccaatttggggttacttatctctgcactgagaattcaactggcctgcagtatgcctgcaagtccatttcaaggaggaagcttgtgagcagagctgacaaggaggacatgaagagggagattcaaatcatgcagcatttgagtggacagtccaacattgtggagttcaaaggtgcttttgaggataaacaatcagttcatgtggttatggagctgtgtgcaggaggtgaactttttgacaggattattgccaagggccactacagtgaaagggctgctgcttcaatatgtagacagattgttaaggttgttaacacctgccattttatgggtgtcattcatagggatctcaagccagagaatttcttgctatccagtaaggatgacaagggacatctcaaggccacagattttggcttgtcagtcttcattgaagaaggtatattttgttatccattcattggtcttttcttatgaatttttaatagttgtggggattcctgaaaggtaagtatgtgaactgtagcatagttgtgaataatcttctaaagtttttgaggaaaattttgtataatttccatccattttttttttttgtttttttttgtgtgtgtttgtgtaaggggagagggggggggggggggggggggaattggatgcaaaaggcatgtaagattgaaaatgatttttctattaagttctaatagtgcattgccaatgcttgacatcaatggcctgattgtcaagacttgcaaagtttgagtagcttttaatttgtttcatgggattttttttttctccctcaagatgtttatttgaataaacttctgccaactaatttttctaaagctttatctcctttttcttttttctccatatctatgcatgcactttatcacatttcagtagatggacatctttgccactcaatttgtgccatgatttatgaattaatttttttgcaagtatggagatggaaattgtaaagtgatggcttgttagaaagggtttatctactgttaatttaaagtaaattaagtttacgaaattgacggttgataaacctcgcttacttattttatacatcatctcacttgtataaaacatactaagttttttctattaattctttattcttcacaggaaaggtgtatcgagatatagttggcagtgcttactatgttgctccagaagttctacgtcgtagctatgggaaggaagcagatatatggagtgccggagttatattgtatatcttacttagcggcgtaccaccattttgggcaggtaaactctgagtttgatatgttgataataggataatttccttgtattagaggctagcctccccctgttttacagttgactattttttaataaaatatgtgatgtagagacggaaaagggaatatttgatgccatattgcaaggtcatattgattttgaaagtaatccatggccaagcatatcaaacagtgctaaagaccttgttcgcaaaatgcttataaaggatccaaagaaacgcattactgctgctcaggttctaggtaggagacttttattgtgttttctcctcattgatagtttgaatttctttcctacttgatccttttatgtgtgtacttgggtgaggttgagaagatagatcactaaaggggcttagatatattccagttctgttagcaacccaaagattgattttatttattgaatgaaaacgaaccgaaacatggattctcctctaaggattccccctttcttacaagcttgttaattctctgaatgaatcctttcacagtttcacccttcaccatatttatctaattgatcccctccaactaattactctagttcccaactaattttcccttcacttctatctaacacataacaaggctagtggatatagttattactaatagtaatgttgcatataaaaactgaatttagggcttaaaaacttatacgtgccaagatctttccatctgtatagattattctatacccatataggtgtgacaacgacaaccaatgatgcatttgaacatgttagttgctgagactagggacttttcagagacaatattttcacaaatatactgtttcttctattatctatcctttaaacatgtcagttgtttagttataggacattctgtatgtgatagaaaatgaaacattattgaacacgagggaagctagtaacagtgtgtgtctttgtcttgatgcagtgactcaaaactgtttcccgttaatattactgctgactgatagcttgattgcagcatccttaagaattttttggttcatgaattatattttctttactaattgattccttgtattgtttaaatatttagagcacccatggcttaaagaaggtggaaatgcttctgacaagccaatagacagtgcagtgctttccagaatgaagcaattcagagcaatgaataaactaaaaaaactagccctcaaggttagtcaagccacaagctgcatgaagtgaccacaatgctcttttatgcttattgtatttgatggcataattaaacattgagagacataattttttttccagtgttctcataatgactttaaattgctcgactgtgtgtaactatagggtgtaggggtacatatctctaccaattcgaaaataaactgagtggacttaaataatcgttttaggtcattgctgaaaatctttctgaagaagagatccaaggtttaaaggcaatgttcacaaatattgatactgacaatagtggtacaatcacctatgaggaactgagggcaggattgcaaagactaggctcaaagcttactgaagctgaagtgcgacagcttatggatgccgtaagctattgttgaattcacaagatttgccctcctttactttttctatattctttcaagcttacactcctttgcttaaatttaggctgatgtagatggaaatggcacaattgactacatagaattcatcactgctacaatgcatagacacaggttagaaagagatgagcatctttacaaggccttccaatattttgacaaagacgacagcgggtaaatccatctactgtgaattaacatttcttcctcaatctgtcacattatggaagtaattcttttttcctactatgcattctcaacctcaattttgaagtccatgccttccatattaatcttttgactattggattatgttttcagtttttttaataagtatttaacaagatcatataccataaatcctatttcttcctacacccaaaagcacatacattacagaatcattaaataatgaatagctctatttagaatttaaagagtaatgacacatgcaccctgatttttgtttgattccatcacaggtatatcacaagagatgaactggaaacagccatgaaggagtatggtatgggtgacgaggccacaatcagggaaattatatccgaagttgacgcagataatgtaagcctgtttttctttttgcttactacaattttgtactctagttctatccatagttgacactcaattttgtggtttctcaggatggtagaatcaactatgaagaattttgtaccatgatgaggagtggaacccaacaacaaggcaagctattctgatgtctctagattgtgtgtcctgcagccaagatgggtgcttgcttcagataaaggcttccaagagttaatattcatcttagacatgtaaagcttgtagtttagatttgttttgagttacatgctccgcgtgacttgtggtcaactcttatttctctttttggtttccttttcactttgaagtttattattgagtccacatgtaatttattaggcacactaataataaatggacttgcctagggaaggtggttttccaagttagattctacagtttgttaaattgaaatcctcatcccgtcatccggtgtcctttcttaagaattgcactttcactgatgaaatatttattgggtgccaaaaggcgaaatatttttgttgctggttatgatttctagcccttcgttttcttcttgaagcgatattggttggcctacggtttgtggttagtgccatgtctgatgacaaccacgtggagtcatgccgggttatctaagggtgattgcagattagatgaattgaaattagttttgaagagaaaaattctgatctaatcttatcagtagttatttactttaacatttaatgtgttgaatttaagtttaaatctaatctaattttaaagtagtttggattgacaaacccaagttagtaacatgcttgtcatcaaattcccaccattgcccagtgttttttcatccttgatatggggaatgtagtgaccactattaacagcagttcctttgtgaatagtacaagtgacaagttgtgtgccaattctaacagaaacagctcagagttcagacaatctatatgtgaatatatcatcctagaagacaccagaaatacaaaatgcagaaatagaaacaagaaagcaaagtgctctaataaccctgcatgtgaaaaactgatcaaatgtgccaatgtgagacttgattcctttgaaacttccaaaatacactcaaaacatccaacacaaatttgggtagcttgctgaaaatataactatcagtcattaaagtgatagagaagcataaatttgtaacgttaaatggggtagcacgtgctggtttggatcaccaaaccagtgagtcccactttcaagaaaatgtcggaagtttagtccattagaagtttcaacacaaaaaagccaaggttccttaatccaatgaataattatttttgctaaaccaagtcatacccaaatgagtctagattttatgctgtctttggttgaaaggatgaaaacagagaagatggaaaaaaaaaatagatatttgaattaaagtagaatgtacgagattcgcatgtgagtcacaatttttctctttctattatgcttcccctcttctcaaccaaacaacaaattttggaatgtccaagtacccacatcttagtgcatgtttagatgagcgttgacaaaattaattttaagtgaaattgttttgacaaaattgatttttggttaaaaataattctaaaactatgatttatgtttgaaagtttttattataaattaggaataaaactttatataaaatttgttgatcccatgcaaaagatatcaaaagttgtttcaactccattaattttggattcacagtcaattctaaactcctatttaatatgaaaaaatatctgaaatttatctaaaatcaatttaaaactcaatcaattctactgtgtatcaaataaaaagaggttaataatagataccatataccaacatgatcaactagcctatttaaaggtattgtttgacaaatataatccttaatctatattagcatttagaattgttgattgaatccggttggcaaacaggaacatatatcatgggtttcgatatggagttggtctggtccataactccagtaactgatattgataacatttggatggtcaaccagtctcttaaagcaataactcttcacttggtagaactgttgaagattgaagcagcattgttgcagtcccagtttgtcacaaaagtgaaggctacagactatccctcacaattgaaaataaagtcctacaaacaataaaaatatttacttatcaacttaatctaatgaatcatatcaatagaaatattttataaagtatattagcaataataattttttataagaaaaagtctattcacgtatacaaacaatattataaaaaaatacataatttaaattataaaagcgaaggcataatttaaataaataaattatttcttaaacacgttatgccttgaacaatatgtaatttcaaatttgagaaattttttcttaattttaaaattttatttataattatagtgtgattttaattttaaacttttgataaattgtatcaaactgaatatgtctatctttttaaatactctgaatattaatattacagtaatatttatcaatcttaattaaaattgtattcttaaaattaaaattataaatccaataacaacaaaatcttatgattgattaaaattaacgtgttttatttgttttaaatgaagttattatttaaaataaaatactctataactttacatcaccaaaacaaattattttgaaatttaaattatattttctaaattcaaattacaatcttgtatatatttcaatttcaatgcaattaaaaaaaattaggtagaagattataaaaaaagaaagaatataaatataattttacttgataatttcgcatcatttaataaaagaaagaatatacaatattaaatttgagtaaaatttagttatcttatcaatatctataggagggtatctacacaatattatattagatcagattttactatcataattatcttatcattcatctttattacgttttctatacacaatctttatgttacacaacagttatatctgtattcttgtggcgggaagtttgaaatataccaaaaatattttataaaatatattagtaataatattttttttctaagaaaaagtctaatcacgtacaaaaacaatattataaaaaaatacataatttaaattataaaaacgaacacataatttaaataaatcaattatttcttaaacaagttatgccttgaacaatatgtaatttcacattgagaaattttttgttaattttaaatttttatttataatttttatttttaaaattattaatcgttattataattttaattttaaacttttgataaattttatcaaactgaatatgtctatctttttaaatactctgaatattaatattacagtaatatttatcaatcttaattaaaattgtattcttaaaattaaaattataaatccaataacaacaaaatcttatgattgattaaaattaacgtgttttatttgttttaaataaagttattatttaaaataaaatactctataactttacatcaccaaaacatattattttgaaatttaaattatattttctaaattcgaattacaatcttgtatatatttcaatttcaatgcaattaaaaaaaatagatagaagattataaaaaaacaaagaatataaatataattttacttgacaatattacattataataaaatttagttatcttgtgaccttatctacacaatattatattagatcagattttactatcataattatatattatcttatgatttatctttattaagtttttttacacaatctttcggttacagagtagttatatctacattagagtggcaaacggtgctgattatctttttacatccgtgtatatattagagaggtgaaggaggataataggagatcattagaaaaagaaagaaatcttataatctgcaaaagtgcaacttgggaatgggtactgcaggtggaaagaaagaattcgggcatggagaagattcatcagcttctattccaatgaagacggtggttcgtgactttgttgcagcaaaagaaaagcacctgcggcatcctgaaatgggtgcaaagatcagtctcgaaagaaaagtcgaaaaagaattagaaaataattataacccatcaaagagagccaaaagcgaatgcgaaggggctagttcttcacaacatggcaaatcaaagtttgaatatttactagatgtagtggcggccttatttactgcatatgaagaagaacaagatcgcttccaagaaagggaagatgctagaaacgaaagaaatgtgggttatgagcaagggccacctgatgaacttgatggattgccaagggaatttcaagaaaagatccaagagttgaatggatgtgacgtgcagtttgtgacgcagaaggaacttttcaaaacagacttgaacccacagcaagctcgcttgtcgatcccaccttcaaagattgccaacagatttctgacaccacctgaggagtcttccttaaacgagcgtcgaggtataaataggaggctttctggcatgccagtgatggtgttggatccgtctttgagagagtacaacatgtgcttcaagaagtgggaaatggagagaagctacgtctacaacttgaccaagggatggaacgagattgtgtgtcacaatgatctaaaacttggtgatacgctgcatctttggtccttcagactctcctctaagctctgttttgcactagttaagaatcaagttgtgaatacatccgtggcaggatcatgatttcaaaatataatcttcaaattagatttagttactttgggaggttatattttgtttaccgtttctgttattcagttttagttattaaactagttttattctaatttttgaaattattcatgttctttatacttattctagtcaataaattattgaaaaggttaaaaatataatgttagaagctgaattcagagttgtaaagtgtgctgcatttagaggtatgacagatttgttttatctgtgatttgctaactttcgattattagcctttcataatataaagaccaagtttgctaactgtgcaggtttcatggtcatatacatatgcagataataaaatttggacataggaagagaaatacgtaaggaaatattagcaagctataatttcttaattcattgcagatgtatgtattttaaggatatcatgaaattatgtgttaacggaagtttgatcaacattaacttgagaacaattagaccaacgacatacaagacaaattcaatcaaaacttgattagtttcaagacctttcaaaccattccttctgttagctagctcccagatcatgaagatcgatatctccttaacttcaggtcaaaatgagtaacaacacaataacctataagtagggctaggcaaaaaaaagaaccccgaattgatgataaactgaaccgaattgaactagtaaaaaataaacttttcttgataaaaccgaccaaaattcagttttggcggcaattggatttaggcaagcgcttccaaggtcggtaaagcatttaccacggtaaaggcctaatctattgacggtaaaaccaaatatcaacgtataaattttatattatctattactgggtgagaatatcaagcaaaacatgttgcccttctcattcaatttttttttattacatatccaaatttattttttcacgctgaattcatataaggaaaataaaattaaaattgatggcatcaacaagcacgtacaaaaattatcatagaatacttatacatagtttctatattggttcctttgaggagcacaacccaacaagtccacgttattacatgattccatttattcagaaaacaaattccaccaagaaaacaaaatcaactaggactgtttcccagacaattaaactgattaaggtactaaactacatggtgtatttcatatcaggatatagagttgaagcttccactccaaatgaagactcaatttcaaagttagtatgatcccgcctttaattaatttatgttggtgtaaataaaacatgaatttttttttttttcaacagaaaaagtgttttagtagtaacatgtatcatcttctaatatttttagtggatctatataagcaaaccccattaactttaaactaatttaagttaaaaataaaaggacctattttaagggttaaaaataccatatgtaaaaatttaatttgataaaattaattgttaacaagtaataaattgtatatctttaagatcgtattaatattagtcatttttacagcacttaccttgatttccaaccaggccaagtctctctcctacgggctcatgttgctgcgcacctagaatgcccctccccttgtttgacaactggaatgctttatgacatataggcatacttattttcactaatatttttttttactgcaattcagcaaaaaaattaggtagaagattataaaaaaaagaaaaaatataaatataaatttatttgacaatttcgcatcaaaatatatatatactgcggatgatttggtaatattccagtttttccgctttgattttttaaattagtatatttgtttagttgtaaaatttgttaggtttgtgtatactcatatataggtacagagagagtagagaaatgaaactctaatatgcaacgtagatacataagaatggcaaatgaggaaaagaattcgggaggagctgtaaagaaagaaggtgattcggttgatatatttttgaggaagggtatccgtgccttgcttacacaggaacaacaaaagaatcctcacttattttcattcctccaggatgacgacactgagattttgaatagcatcctcagaagacaagaccaaagaaagagagaagaagaaagaaagagagaagaagaaggcacgtccacgaaaggtgcttgcaatagcagtgctaataataatgttggagattccaagaattacaaggccatgtgaagaaattaaagattcaagaaatgaagggatgtgaggtgaagtttgttggaactagctctccctagatctctgaatatctacaagcacttcagtttatctttgatccaaaaaataaactctatgcatttgtctttaagttcaaacaataactctgttgcataacaatgttatatatatcctttagttgtttatgtaacaaattaaactgactcgtacttcacttatacatcaataaattcagatctttcttttgttctatatggtatcacaacctaattgcctgtgtatagggtaccactgtctgccctcctaaatccatcaccatcaatggctccgtaactgagaatccaaattattttttaatgttctattcaagtaaattaaattttttttatctgaatatgttattaatttcataaaatatatcttataaacaaacaacaccgtcaccaggccactgcgttcgccacaatgcccctccccttgttcagcaattggaatgctttgtggatgctattgccgaagacaattaccctgtgccctgtggtgcatgccagattagtgaaggcatcaaaggtccttgcatacgtttatcaatccatcacgatgataatgaatcatatttatctcaaatacttgttagatttcgttgctatcaactaatcatgatgataattaattataagttttattaatgattaataataaaggttttaaattgcaattgcaatcaattcattagattagaaactaatctcactcatggtgcgtgatggttactaattcaattttgttttgcatcgaatacaatttttccactaaatacatcattttttcatatataaacgcatcacgagtgagattagtttctaacctaatgaattgattgcaattgcaatttaaaaccgttattattaatcattaataaaacttataattaattatcatcatgattaattgcaatagtggaaaatttttaaattctttgtataattcaatatgatgaaagttgctttgtcatttgtgactatggtaggtaattgggcatgttttccagccgatggtgacaccagatgatttggagcaacaacctcaaccagtgacaacgttgtttgagatatatatgcatgctgaataaaatattcaattttttttttgcatcgaatataattttttcactaaatacatcatttttccatatatgaacgcaatgaagcattacatctctatatcaaccttatggattaaaacaaaatctttcttttacatcatgcaagtacatataattcgtagggaaagtaggaaaaaaaagaaaataaaatgtttttcttgtgtaatagagacatcaaacttggaactcaaactttcacaaacacaattttttagaccaagtaggaattaaacatgagctaggaagatctaatgttgaaggagagacgaatctgtgagaaaggaggacttgtaaacaaagcaagagcgaattgagaagaataggtagtggtggggtatatatagtagcggggtgtgcaaaacagaataagcaatttatagcagtgaaattttttaggacaaattatttacagcatgcaattaaacatttgatagtataaagtaattttataaatgtacgtatatatatatatatattatatattgatataattttacagatgttaaatattgatttacatgttaatataacatctgaaaattggaaaataaatataagtaaattaaatttcataaaaatattagtatagtatttattgttgttaaagtaattttatataattatttagataaatagacttttcttttatagcgtgaagaatttttgttaattacttaaaaaatttaaaacattaatttagaaaatatatttaaacgttttaattaattactttgatgtcacagccattttcaaaacctcaattgctttaggagtcttttttttctttctgtgtttgttggaaaacatagaataatgctgaaagagttcagtgattcgtacgtagtacttattattgaataatatcgttgtttatttgttgctattttataccttaaacacaatcgcaatgttaagcataagcattcaagaacatgtcttctttacccaaaaataacaagtattcatgtgtgtaactctttaaataatcaaaatactaatataaaatgctcatagatttcaattttgaaatatttattcaaaatgctcacatatgctctagctttgccaagatatttaaatactaaatttgtaaaacataaatataaattaaattatataactaaataaaatagacttactcaatgatttcttttgatttagagaaactattcataaacttcaattgattttttttagaaattattcaaattcttttaaaatggagaaaaatataacatcttgaattagttaaaaagtttgaaaaaataaaatacgaagcgtgacttttatgttttaataatcataaaaaattatttacccaaacacccatcccaaaatatgtaccaaaatactctttcttattattattcagagtagctaggtaattggctattttttccgttcccaaattgacttttgattcaccgaaatctcaacattctaaattgggttaaataagattttgtcattatagaatttcaaatttcgagttttaattcctataatttttccttatttttagttatggagttaaatttttgccgttttgatgtctatttttagttcctctgagcaactaattattgtatttttagaagcacttagcaactaattatgatgaattattttcaaattatttatgcatttaatatgtccttatgttttaattttttctataaaacatattttagtgtaccaacattaaaattcatattaacataatcataaagttatttcaaattttacttgttaacaattaattttatcaaattaatttttacatactgtattttttatgtatataatatattaagttgaagtttatttattacaaatacttaaattaacaattaatagcaaagatattataaattttatataattgtttatatgctacactatatgaaataacaaagagatatatttggataaaaaaattaattcacttgaatggaaaattaaaaaatataataagtacaaaataaaaatataatgttattcaaaaattatttttccattcgagatgaaaataaaataaaataataaagtaattatttgacacgaatttgttatttggtgtatattttacaaaaacattagaagtatttgattacttagcttctatatatgtgttatatattacttgtttcctttaattttcatgtgatatagactaagtgtcttgattcatggtcctttctcttttgttaaaaactttccttttgcattgcaatattgaaaaagtagccgttaataactctactactatacaaatactcttggcaactaaaacatcaaatcttatgtaagatatccaccctctcacacgagcaaaatatagaagagaagaaatctttcttggatgccaaatattttcctttgatttcctttctttttgtttatatatttgatatcacgatgtctggtaggtgtgcagcttgcaagaatcaaagaagaaaatgcccttcagattgcattttctttccatattttcctgccaatgatcctgaaagatttgcttgtgttcacagaatctatggtggcagcaatgttggaaaaatgcttcaggtgttttaaatatagataataatatttgatatcaatgtgtttatgttagtctataatatggaaaaaattatcaatatatcaaagttagaatatgtcatccaaagtcaataagattatgttactaaataacctttgtatattttgatgttgcagcatattccatcatacttacgtgaacaagctgcaaattctttgtattttgaagcacaatgtaggactcaagaccctgtttatggatgtgctgggattatctctaaattatataaacaaatcaacagtacagaaattgcacttgcccatgtccaaactcaaattacttgtcaaaagcttcaagtcccacaggcaaaagctgaatcaaacttcaatgtcttgtcaacaattgaagctgaaccaaactttgatgtcttgccagcacaaagcagcagcacagcagaatttcaatgggaaagtcaagttccttggtttagttaaaactaccatttccaattgatacaaagcatttgatttatattcattatgatgtcacaaccattttcaaaacctcaattgctttaggagtctttttttctctctgtttttgttggaaaacatagaataatgctgaaagagttcagtgattcgtagtacttattattgaatgatatcgttgtttatttgttgctattttatacctatacacaatggcaatgttaagcataagcattcaagaacatgtcttctttacccaaaaataacaagtattcatgtgtgtaactctaaataatcaaaatactaatataaaatgctcatagatttaaattttgaaatatttattcaaaatgctcacatatgctctagctttgccaagatatatttaaatactaaatttgtaaaacataaatataaattaaattatataactaaataaaatagacttacccaatgatttcttttgatttagaggaactattcataaacttcaattgaaaatatttttagaaattattcaaattctttaaaatggagaaaagatataacatcttgaattagttaaaaaaaattaaaaaaatacgaagcgtgacttttatgttttaataatcataaaaaattatttacccaaacacccatcccaaaatatgtaccaaaatactttttttttattaatattcagagtaggtaattggcaattttttggtacccaaattgacttttgattcaccgaaatctcaacattctaaatcgggttaaataagattttggtgttatagtatttcaaatttcgagttttaattcatataattttttcttatttttagttatttgtttatcatgattagtctttatggagttaattttttgtcattttgatgtctatttttagttcctctgagcaacaaattattgtatttttagaatcacttagcaactaattattgtatttttagatcacttagcaacttatttaattcttcttaattttatatgctttatcaatagagttcggcttttcaaatgaacatgcttttattttatttcattttaaacattaatttaatttagttgtattaaaataatttgtttaaataattaaatatattataattaatttttttatttcaattattttaggggtttaaaatgtgttagaattaagatttaagattttgtattaaaagcatgcattttaattataaaaaatgatcaaattgtatttcagaaagccttaaaaactaatatcttgattaaaattatatatttataaataatataaaaattaatattgattggtcccacaacagaattaaaaataaatactatatcaaaatcaatatcctaaatggtgacaggcctcacattgtggaggaagcttgttatatacgagttgaggatgttgtctacattgccattgttgttcttgatcattgatggctgcctcatcttgttgcaccatatatggtgttgaagaagtagtactagtagtagtaacagagttgggaaatattgaaattttaaatgagtacattttttccaaaaatgcggaaatatccaaaagatgtggactccgttgaaatgaaaagtcatattaagaaaaaaatgtccttatcatattgacaactatataatattttacctatgactttaaaaaaatattgtacactaaaaaaatacaatttgatcttttattttatactaataataatgcatcattttaaactaaattcacaattctaacacattttaaaacataaactaatcaattgtttaaaaaaattaattataatacatttagttattaaaataaacctaattaaattaggtatttattttttaaagaaaaaaatacacgttggaaattcggcatttgaaaagccaaactccatttgtactccacatacattaagactaatttgcttatacattatttttcttttaattttttttgaacaatctgttttttttttttttaaaaccggcaacctgatccaagctgatttggttcgagttataataaaaattaagcaaaactaaatgaaaacaaaatcgactggtttagatgaaaaaatcatctaaaaccacactgtggctacccctgggcctaatagtgagatattagaataaatgtagaaagatctactgcatgcatgtttggttgggtgttaacaccagtaaacatgcgtaaccttatactaaaaatactagattctccaacaatttaaagattttgacgtggatttgtaggaaaatgtggattttaagagcagatccaaacacactattggattttttttttctgtcgctattgcacacacacaaaattcataaaaagttcattagatccttgcttggccagaaaactaaataacacattggttttttttttttttttttttttttttatcagtagaataacacataggttacccgcacaatgaacgtgctgaataataatctcccaatcccttttaactagtgcctgaatgttattgattctacccaacatgaaattttaatagaatttttcatttgaattaagttccaacctaatctagacctaacaatatatagaataagattgaaattgtctgatttgttaacatgacaatgacatcaatttttatattatatataattaaatcacaaacttgataaaaaatatataattacaattaaaatatatttataatatattttaaaaataaataagtaaaaaaatataatttaggtaaaacattgtgtattaaattatgtcagaaagttcaatcattaataactacgggtaaagttagtgagacagataagtcatgaacattactaattatagttggcttatttttaatttggtgtactatttggttatttgatgtcacataaaatattttaaaatgtaatatcaaacattgcattttgatacttaaaaaaaaaaaatcatcttaaattttgtgtgtatatttgtcataatcacatcacatatcacaaagagttaaattgataaaatttaccactcgctttaaagttatgtacttatgtgggtgcgttgatcctccaaaataaatatcctaatagtaaactatgaaactttaggtacttttaaattgaaaaacttgcaagttttgaattcataacttgatctctcggagggttatgcacctgtagctggcttctttccatcaatgaacaagcccatggttttgaaccaccgcatcagatttcgatgttccttcacatatagccacgcttgaagaaatttaaagaggctctcgttcactcctcgctcctcaatgtaactgtgaaacgcatctctcatcttttcatctagttctctgtcatttacagaaaagtcagtcagcaaaaaacataagaatttccaagcgaagtttaacaggtatatgataaaacacaaaacgggcattctaggacaacacgcgtattcgtatcttccaaaagtaagaaattttttcttctcccaaaatgcaaaacacaattccgcagtttcttctctaagtccagcctatcttttctcagggaaagagcatcaaaatgaatcaatcacatcacattgacattgactttaattaaacactcacaattgagttccaaaatgaaatgaagtaactcgcacggtagagatattttcaataatagttattactataataaataaaaagagccaatacaccactactccttacagcaattgaagagttctgagtggagggcattctacttcatctccattcttttaatcctaaattcctaatatctacaaaaaaattaaatgcttcttcccaaaatctgcattttatacctaaatatagaactcggttttctaagaatttgggttttgaacttaattcaatctcaaaatctaacttagagagaagtgattccccacctatatatatactattttggtcatatatcactagttaacgtgaaatctccaagagacatgcttaccccggaaattacacacaacttatagcttgcaagattgaatatttgtaggtgatccaataacaacacctgataacgagtagtctaataaatccaacaacaaccactaggattccaatgccatcttagaacttcaaaagctaactcatgcggtaagtgttgttccccacttaaatcatatcaccagtaaacgtggaatctccgtccatgtttgatatatctttttccaccttatactttcatatactctagagattgcaatgacattaatttaagaatttaacagtgatgcacggacagtatatagttttgtaaaaatcaacaaacctactatccgtgatgtgtgattggatgattttacactatgagtgcatactttttttcttcttcttaatttaattaccaatctccagacctacactacacaagcataaaccctaaacaaagaaaaattgagagcaaagagcacagaactgacgcgaaaacagggccggtgtattgggaggggatgaggaggtagccggagtcctggaccttgggcctcatggaaacagagtgaatccccagagcatcctcgtacaaaccgcagaggaaaatcaaggattcgttctgctgaggtttggagacgtcgacgtggatgaagagctggtcgatggcggaatcctcgtcttcgggggtcaacaaccgcatgacatagatgctgacctcttcgtcgccgtagctgcgcttcagaaccggaccgtgcgagtccagagctcccttcacgatcgtgaacggcgacggaggactcactttctgctaggcacgtgccactctcacgtgagttagtcaatgtctaaacctaaagtaaaaccctagcacataacagagtgagagagagcttacagggggcatgttcattttggcgacttcttgatagtgatcctttagagagcggaggagcattgagttcacggcggaggagatgccgccacctcccgacgaatatggccgccggagagcacccacggcaccgaccaaggttctcttccacatttctctatcttttccttctattcctgcgctgtatgagattgtgttgtggcagcagctcaacccaactcagactactccactcaaacatttcaacaaaattatattgagtttaatttattaattaatcacaaataattttaattacaatttttagcatttattataaaagataattatcttgctatgtatatataatttattttcaaagaacaaaaacctttttttagatgttttttcaacaaattgttatgattgtgaaaatataaaattgacaattttattataaattaaagtttaatactactagtagtatttactattagaagttattaaattttagtttttcatttttttctatatatagttaattttctaatacaaattatttaatataaataatttatatttttaaggcataaacatttttttagtccttcaatttttgtttgttttcattagtccctcaaattttcaaaaaattaagtttagtccctccttgtttatcatttcatgggtttcatttgttacaatttttaatcatcaaaatttatttttttaattttataaaaagtaatttatgacaattttaaatgccaaaatatttgactagtaatatgatttgctgacattttttacatattttgatgattttaaagaagaaaaaaaaatatgaatgtgaaattgtgacaatttttaaaatatcttaactatttaaaatatcacaaatcttttttaaagaaattaaattaaaaaattgatgataaaaaatcgttacataataccattaatgcaaagaataaaaaaggactcaaaacagcttttcaaacaaattgacatgttcttttgcattacaaaagtgtccaaacacaagctaaaatcaattataagaaatcaaaaagtttattgaaaatgaatttaagaagctccaactcacacagataaaaacaaaataaatgcaaaaacaaggatcctgatgcgttggcaaaatgacttttgcctcaaacatgcacaataattgtagcttaaagcctgtttgcatctgactcaaatcaaaattttagttgcagctaaaatttttgctttagaaaatttgtgtcttctccgtttgagatatttcaaaacagggtataaattgccagacactgtcctttttctcatcaaccattctcataacagtcgattataagcagttttgacatgcatcacaccattccacaaaacaaggcccctctcagcagaagcaccgttaggtagcagtaccacatcaataacttccggccaaatatcatgcagaaggaatcctttatccttttgaatcaagagcttcttccaaagcaatgatgttggaaaattaattttacatttccacaataaatggaacaaagcaacaggcaatcatatttcttccataacatgggcaactgaacaatttttcatttcgtgagaaacctcaaacaaggcacaaattgaaagccctgatctttctgacttgtcaaaggagatatctaaagattcaaaatctgtatgaccaacaacttcttactaaatacagaagaagttaatactactagtacattttggagcaactgaaaaatgcatgtcatgtgagaattctatgagcttcggccatgaagggacttgcttgcttgtgaggctaagaccattgccttggctcttgtgctcatcagcatcaattccctcactgcacgacgctgatgttgccgggcatttttagctcgcttcggagctaatcggttgtccctttccacaaatgcaagtctgaatttttcagctactgataattcagtggaacttgaagatggagagatgggcttcaatgcaaacccatgcattgtccatgttctgggatcaatgtccttgacaacttcatcatccaatatgatattttgtaatgcttcccgaggaacctcagttcccttaaacccaaagggtgatgacttaggatttactacaacacgtgggcactcagtggaaaagtcctctaaagaatttttatcaatgtttggctgcaaataaaataaaataatcacttcttgaagaaatgtcggccatgaaaaaatattaaactactagcaacttctattttctatatgcaatgagaatcaaagaaaaatcgttatccatcatgcctattttttcctaattctcactccatcccccattggctggacgaagtgcagcctatgtgtctctacaccaaccaatgctatcataaaaacaaagacatcaaactaagaaggaaatacatgaatttttgcatttcagtaaggacaaaaattgcattcaattacaaattagacagaagttttcaagttcatacccacacaagccacctgagtgattgtgccccactagcaatttcttttgtatcaagctcctcccaagaatcctcctccacataatcatcaaaccttggtttaaatatacccaagcatcttcgtgcagtgttgtcactccttggacatcctctgcaatattaattatggttcattgcctgttatgagttttgtaatgatgtaatcctagtcaaaacacagtcttgtatccaatgtgatttattagacaaaaatcattgtgtaataaagtaggaaattactaccatgaaaacaaaaaaaaaaaaaaaaagcaccctaaacaattttaaaattacataattttctacctttttgatttaatttgatttttaaaacaaaagagagaataaatatagaataaatttcccaatacctacaacttcccaagtttcggataacatttccttcgtgagaatatacatcaattttttatatcaaagccagtttttggcattataaataaatgagtaagtaaatatgttttgatcatctttacaagagaactcaatttacagatcctaacgacaaaagtatgacagatacaatagtaacaagaacatggtacctaaagggcccattgaagcaaaattacaagttttcagattatgtcttaaatgatagacaaaatacagtctaaaacaacacaatgaacaaattgcattaacaaagaaataaaacttaaagtggatagcacaggatatgtacccgcatctcaatgtctccaataagtggcagtgcttcacaagctcggatataccattagcagtaattttggtgcaccggctgcaaatagtctcaatatatcaagtgattctgaaagagagagaagtataatataaaaacacacactacaaaactaaaaaaatgattgttagcatcacatcaatcctacaatatgctaacctcaaggcaagttgttgacggaccaaaaactaggtgaagaaaattaataataaccacatccagtagaagtaaaaccatgaaatacaattaaaattacaatggaagaggatgatctaagcataaaactcaatctgcattcatcactcacttctaataaactcatgatatagttcaaacagcaaaatattttctcaaaatgtgcctaccagctggtccattgaatgggacatatgacatgctcttgtagcatcaagtaagctacagagttaagactacaagctagagcatattgcatgaaatgtcttctgaaatttgaatatacatgaaaagactaaatattatgataattcttgttttttcagcttatttattcccatttctcagacatcaaagatcaattgcattacaattaaagcatagtaattgtttcatttttttaataaaaaaagttatagttctataccttatatctagagctttaatgaatctacatacttcagctgcttttatcaagccaaaatcagagacatctgagccagagacatcaaggatttcccaggaagtatcagctaatgcgatcaggatatcatcattcagcaattttcttcttctagcaatagctgccactgctatctgtcattaagcataactaacttttttatttgtattgtatgtatgtataaaatacatgctgcaggatgaaggattctttttgttcttttttgggggaagatacattataatcaaagatttttaacaagggataaacaaagaagtgtttagaacagtgagcggaacacaagtttcaaccacttaagaatattaaccgggtgcctcaacaaaggatatttctttagcaaagaaagcgggaaatcctggagaaatctttttttcccacacatttacattgagaacactataaatttagaatttcacttgttgacaaatatgagcattaggataaatgacttattaaaggatttgaagaatcagaatcattctctagcaacctacctttatatcagctggcaagttgatagcaatttcactcaaatctgcaacaatatcctccaaatgtcttccaagaactccaacgcaaagactgactaaactcggaggcttcgccttcttaggcagtaatcctgcacaaaaatttctcaaataatttgttaatgcctatcatgtggcacatgcttatgaaaaaataattggtgcatcgtgccaccaaggtttaaaccctaagatctcatttaaactaccaaaacctctcacaactaacacccacctagtgtctccttcaaagaaaacaaattttagtcattctattcaggggcaaaactcaaactgagcttcaattgtcagcataatctagtcatacaaacacagagtctaagggcaaaaccaaattaaacaatgagcacttgccacaaaaccaggcaatatgatcaaaactgaaaccaattgcagtaaaaggcccaaatgagggttgaagtgttttttgtttgtttttgaagttttctacctaaaattatcacagaaacaaagaaccactgcatttcagagttagtattgttttgtcaacggtctttcaatttcaattgatccccaaaacagagcaagtgcaattgatcatgggtcaatgaaaggtgaaagctttaccaaaaaccaaacataaacataacaccccatctctaaaatacaaaagcagattgaaagagagaaaaaggggtttaaaaaataccgggaaattgagggtgggtgagtgaaatggaagacttggatttgacgttggatggaggattcaaatcgaggttttgcaaagaggtcgctaatgccttggcacctttacctttatccatccaaaatcaaaatgaaaaacgatgtaacagaacgtgcccttacacaatacctcaattctgaggaaccaaatttgacggtgtaccaacttattctaatctctctctctttcttgtcttctgaaataaacgaagccgactttacttgcgaccaaaaaaaaaattaggaggctctcgcacatggaagggggaggaaaattgtaagtcactttatccattcatatacaaacaactattttcagatttaaatttatgatgaataagtcatcaagatataattttactgactttacttgttacctcctttggaaaaatttattattttctgtattaattttaatttattattttgttaaaaaaataagtagtatggttactatggtatacagtacatttttatttttatataataaaaaattataacaaactaatacttttcaatatataaatatattatattaaaatttataatttttaaatatatataatttatgtttaaatttataataaaaaattaaattataatataaagttatttttttaactattgttatgtttttttagaaaaaaactgttaaaatataatttaaaaataaggattacaaaaatggtatattgaaatagactagcagttaaaatgattaagtatatatataattatataaagatttttaaaagggtgatttgaaattattaaaatataaatattttgattcattgcaaaaatattatgtaaatgtattagtattttttatatataaattataggtatttgtcaactcatcattggagacaacttatttaaacagagtatttggaataatatgaaatagggtgttcatgacctaactcatcttactaacttaatctgttcttaaaggatttttttaacgagttcaagttaaagaaattagataaatttgctttaaggatggatttagacttatattttaggtcatttcaacctactacaatgtcattttttaaagtataatatttaaaaaataattatatattgataatacaactccttgacaaataaataatattttgtttgatataatattatatttataatatttattttaaaaataatattataaatatattttaattataattatatacttctttaattctacaaaataattatatgtaacgttaataatattaatatatcatgtaaacaaattaagtttatccaagtctattccatatatatttgtctagttttaattgaattgggttagaaacttagaattcacaaaaattgtttgtgttaaaaaatttgatcaaggtgagatgaggattatagtctgtttagatataaagttagaaatattttttaaagtttttttattagaaaaaattctatattttgaataattttctttaaaaaaatatttataatttgtatctaaacagatcttatttctaatttgttatcttctaatatgtattaataagttcaattgattgtgtctcttaaaagaaattctcattgtttgttatgaacaaaattatacagtagtattagtgatgatatataatacagattaaactcataaagtattaaatatttcaaaagtaagtttggtttgttacaatcggcaaaaccaaacatagaattgtcgtaactcgtaattaaattagttaggcttttgtcaactgggcatttgcaactgtccagtgtccagtctacttaggtgtaataaagcgtcattttatagagtttaatttttatgtaatgttagtataaaatatttctattattaattaataccctaattagtattctttttctattatacataaatataaatattttttggatatttttaaaaatatacattactgattctttgtgtattttgatgtttctaatcattttttcattttttattaatcctttatttatgttaatatatgtatgctaattcatataaatgatattaaaaattcaaaaagggtacaaaattatggttgatatgtttttaattttttttacaacgatatgttttctaaaagttaataagattatcatataataatacatataatcgacattgtaaataaatgataatataaattttttagatcatccgtgaagagattagttacttttttatgtaacacttaaaatattctcattttaagtaaaaagattatgcttttcatatgaattcccattccagttagtaaaaatgaaactctccgttttaaaaagaatcaggttcattctgattcgaacgtaatataaacatatttatgtatttttgtttaacaatataaaactttgaaataattcctttattttcttataaaagattgcagtgaagacgacattacttcaattcacagtaaacaaaaaattctaggcccaaggagcattcatagaaaaaattacatttactttactttaagataacaagtgagagtttgaatttatgactcgaaagataaactcagtttcatttcactggacttgctttagttttgttttttcttccaataattcatgacacagtataaaaacttttatgattaagtaatttaaagtttattttctgttgccatgattttatccttttacgaaaagttaaattttaatgtaagaaaaataaatttatagattacacttcaaactcgcgaaacacgttgaaaataaaataattatttgtgtctaatacttaaacggaactttttagtctttaggtaacactttaacggagacatcgaccgtccggacaaaaaaaaatattatttatctaaatgtcacacgatcagaaagttttatcaactgtcacgtggtataattcacttgtcagtctagtgaaatacgtgatgaacactagcagtcagggagtaattcgagcccagcgaattaggtagacacgtggcagacaggaagtaattcattggggagcccagcgaattacctggcaatggaaaaatctcaaaaacttcgaacggtcataacttttgatagaaatttccgatggaggcgtatgatatgtcaaaagctcaaaatttagaggcgaagggaaggggattttggtccactatttttttcaaaaaatgcgtctaagtgcaatatgtccttcaaatgatttaacttttgatagaaatattcgatggaggtatacaatacgtcaaaatgctcgcctctgaatttcgagcattttgacatattatacgcctccatcgaatatttctatcaaaatttatgaccgttcgaaatttttgagatttttttctattactacgtaattcgttgatctccccagcgaattactctctgtttgccaagtgtccacctaattcgctgggctccccaatgaattactctctgactgtcacgtgtctatcacgtatttcgttggactgacaagcgaattatatcgcatggtaaaactttttggtcgcatgccatttaggtaaataatttttttttttttgtggcaggtctatgtctccactttaacgtttgataattggtaagcattgactagggacaaaactcacataactactccattttatataggtgtggtgtgctatactttaagtaacgtagtgagccaatcccacttgcgtgggtgagttaaataaaaatgcgggtaaaatctatttttcgttcttgtatttttatttaaaattagttttaggttctgtattaattttcaaattgattattttgatcttcaacatttaaaaaatatgtaaatttagctccttaacagcattaacattgttaaaggaaaaggactaattctgcatatttttcaaattttgaaaacaaaaaatggttgatttgaagttacaaagattaaatcctattttgatccgtttaaaataaaaatattaaataaaagaaattttgaaaaaatattttaaaaaaatataaatgttacaaattatttattcattttaattttaaaataaatagcctatgtactaatagtataaaaagatattaattaattttacaataatttttttaatattcatacgtagtatagtttcttaatgattaatagtataattttttttacaagtaataaatttatagtttcaaattcttaattttaattgtttaatagaataagaattattgtatatctggaaatttttttacttaatttctacttatatatatggtaaactatatacatttttaattcaaaagtgagtaagagtaaattaatataattatttataattatccatgtgataatgttaaccacttttaagactcaattaacattagataatattaatatctaagaatatctttaatattggatcttgaggataaatcttaagatcttggggatagatcttaaggatgtggaacaagtatttggtgtcctctaatctcaattcgtgattatatgtggttcatcgcatgcctggaacatggatataatgaaaaatataattttggcatgcattatattacataacatgattgtcgatgacgaacgagatacatttagtgataatattgatgttgattattatcacatagacaatgacattttaaattttaaaacatctcgtggtactctcctgattttactacatacttgcaaacaagacacgttatgtgtataaaaataattgatcaacaacttcaaacatacttgatagagcatatttaagaatgttacaatcataacaataataattttttttttggcattaatgtgttatattttttattatcaaatttatgtattattttttttaacatttagtcataaataaaaaataaatttatgcttatttttctatttcttaatatttataaaaaattcttacatattttattaattaaatttaattacttaattaattatattcaatttaataaatatttatataaaatatttaaaaatgagatataggacagattaaaagttatctaagatgagatctatcactaatagaaaaatgaaaaaaatcttaaagttttttaattttatgtgacacattaaaatccatcaaaaaattatataagattcaatttgattttataagaaattatatctaactttttcttcctttataaaaaaaaatataactttttctagttttttctcaactaaactaattgatgaacttaaacctgctttaaccaacataaagttagcagctagctcaatttcacaaaaaaaataataaaaatagcagcctagttttccctatctatttaagcctagttcttgtgcccattaatgcagtcaggtccacctctcacatctacatatcaagcaactaggcttctcaaattgcattcctagtacataacataacaccctccatccttggacttcattcacactcccaacgcttcctctttctcccataaataccttcattcatttcaacaccacttcctcacttttgttactttcctagtttctctctcaatatggttggagcccttctcctcaacgccaacttcaagattcatttctcacgcatatcaagccaagcccgtgtccccttacccgtcaagcccgcaccgctcagaatgcccacttcccaatacccccactgggcctccttgcaggccgacattgaagcccacctcaaacaaaccattcccgccaaagaacccctcgaggtcttcgagcccatgttccacctcgccttcgccgccccccggaccaccgtcccggccctatgcctcgccacctgcgagcttgtcggcggtcaccgccaacaagccatggccgcggcatcggccttgttactcaacctcgccaatgcacacgcccatgaacaccttcctctaaccgacgggcctgggtccaggcccatgtacggccccaacatagaactcctcaccggggacgggatggttccgttcgggtttgagttgctggcgaggcccgacgggccagcacgtgcgagcccggagcgagtcctgcgtgtgataattgagatatcacgtgcggtggggtcggtggggttgcaagacgcgcagtacgtgaaaaaaacgttgtgggagggtgaatcggacggtggtgaggaggtgcaacacgtggaaagcatgcaacgcgttgtattggagaaaagggacggtgggttgcatgcatgtggggctgcgtgtggtgccatgttgggaggtgggagtgaggaccaaattgaaaggttgagaaaatttggatttcatgtggggatgatgaggggaatgctagaaatggggttcaaggaaaaacatgtggaagaggagagagagcttgcactcaaggaattgcaatttttcatggacacagatgttcatgttcttcatattatttctagttttctttattaatttctacccaccagttttaaggaatctatctggaatctcaagtgggttattatccatttacatatgtacggaacatgatcaactgtgcagttcataaagaataattgcacgatcatgcgtttcaaatctgatggtaaaattatattttaatgtgtaaaatttattttcaaggataatactttttagtacgaaaaataatataccaaatattcaccgtgtttttacatcaaccacatgcactaatttattttttccattcataacttccaattaaccaatagaaaataatcaaaatatgcacgagtattcgtgcgttttttttttgcactaaatagcaggactctatttttattaatgctatttgagattcatgcttatgcagttgaaaattcaaactgatccatatatatatatatatatatatatatgtgtgtgtgtgtgtgtgtaataatactatttttagtgaattaaatacaaacccattaactgcgtgttttaattatttctgttaagcgtgaagaaacacttagttacctaaactcaacttgaaccagacgacgtttttctttatcagtaaaagtattaatattaaggggtactaagagctaccccaacccttatacaaaaaaatgtattcatcatccatgtaagtataaagtcaaagttgatgtcgaaacccattctcttaacttcatccatgcaagtactaattcaaattaataagagtagtcagaataattaattttttttttaataagagtagaaattttgtagaatacatgcgcttttatttatggcaaccctacttagtcaaaggagaattttgtggaatagtactgggtctatctaatttgatgctgaaaatgctagcttggtcctatgtagggattttaatgccattctcttttaacatgagaaatagagaaagtggggaggagactccaatcttcatatagtatgatggaggtagatctaatgttcttttttgcttgtgtgaggagagaaacaaagtattgttaggttgtttggtttaaaaaatatatatgataaattgagtgaaaataaaatgttaagattacatattattttgttatttgtgataagatagtaattagtaatttagtcctcattacttattattaggggtggaagtgggccaggctgcctatcaggggtctttggcctggcctggcttgtttactataaagaccaagctaaggctttttgaaaagtctatttaaataaaaaggtcaggctcaagctttaaaaaaagcctattaggcctatcaggatggcttatttaatatatatatatatatatatatatacacatatacatatacacattaaaacttaaaataatatatttatttttctaaaaatattttttcttattatgaaggtggatgatcaaccacttcaaaaaagtaccttgaaaatttcataaaataattaagagaaacatatctataacttataagaatttgaaattttataatttatgagataaacatatctattatgttatttttatttttaattatttatttttatttaatcaggctttgtatacaggctttcaggccaggccaggcccttatgcaggccaggctcaggccttaataacttatgtttaacaggtaacaagccaggcttaggcttaatgattgtgatgcgggccaggctcaggcctatcaaagcctggcctggcctatttccacccctacttattattagattgattatatgtaatcaatattgattatatttgttcattataaataaatcgttagtgttgtcgtccttaacacataacattatagtaaaatactgttgtatggtataaaaatttagattattcttcacaaagaatagtgaaaatcgtgctccatcgatgacttactgtcaagtccccggtggatcttctgctcattgcccatcttccaatgaccatttctcctttcctaatgacttttctaagcggtcattcttgccattgtctcgaaccaaacaattttagttccattttgtttttttccctcttttctcaatcgcagcccctttgtcgcttgaataatatcatgactattgtgagcactattacattgccactatgttgcattttcgttggtgtacctagacgatcgaaagtgtctccctccaacgaacccaacatcgcaaatctcactgtcatatgtcgccaccctctgatgcgtgacactcacgcgcctgcaccgaatcaacatgtgatgttgttttttgaatgacccatcctccaatgacctccccatcatgcttcttcttttctagaaaaacctatttttacttcatttggctcgatttccatttgtttggttgctttggctattgtatctacacacctaactaatagttggccaaatagccatgtgacaccttttccagcgtggtgaccatgccatcattctcatcttcttccgacaaccctatttcgttgttgtttgactctgttttgtcgttgtttggttgacccacaatccagcgatcgcatcatcgcactttgtctctttctagcgacctagccaaagaccaccatgccatccatgtgcatagccaattcaaaacaccacaacatgccccccacatagggtcttggtgcatgatgatcacgcacacgacacgtaacacatctccaacaagcatcacagtggtcttcatcgtcattgcgagcctttgttgctgccatcgaatcatgtttatccgatacaatcacatacttgaatcgcctttagtttttatcaaattgaccacatttataacaagctcgagcttaagggagagttttaagattacatattgttctgttatttgtgatcagataataattagtgatttagtctttattagtcattattagatttatccaatataatcaatactgatcatatttatttgttataaataaaggtttaatgtaatcatccttaacacaacattacagtaatacttgtcatatgaaaaatattgatatatccttattaatatatgtttctttttttttttcaatcaaatgaatcaattttgttgataaaaaagacaaaaaaaaaaaaaaacacaaacataaatgtacacaccttatccttaccaaggacaaaaatttcaaaggaggaacgcaccttcacccaattaattaaattaaatcttgctcacaaatcaactccataaaaccacctaaaaaaactccatcgttgctcattgtccctatcttgtcgctgacaaacacaacttcaaaggatatggtttgattgtgtgggggagaggttactatataaggggaaaaaattaaaaaatagtgagtctcacatttattttttattttaattcaaatatttttttttccatttctctttcattcttttctcttctatacaaacaaacctatcccaagggatacaagtacacaaggcaaaataatcctagaaatattttctctacaaagaaaaagctagacaggtctctaactatagtgacaactacgttaggtgtgagttctgatcacttttccttagtcattgattttattccaaaaatgagaagtgataaaaaaaagtacaatttaaatatatagtctcagttaatataccaaaatttagatttagttattcaaaataacttttgttggatttgatttttatatattttttaaatggtcgctaacattatttagtgattgcaggacatgtatgaagacatgttacctcggtgactattttatgacatgttatgccaatgtcattaataaatgataatagagaccattttaaatttttaaaaatttatatgaattaaaaccaataaaaaattgaagtattaaaacaagaattcacagtatttatacataataacagtatatttttaccaaaacttaaatacgaggcattatgggaaaagtacaagcattgtggaaccttagtgaaaaaatggtagagacaagggaagggtaaggaagatgctggggaatagttaactgaaaaataaaaaaatctgcaaaaatacctactacagtggcacataaagacttcaattttttcaaatgcaaatctatagatttctagactctaacaaagactaacagttctttgaaatgacccccataataataaaacttgtgaggaaatggagagtaatcaaaggaggactatggaagtagaactactactgtgtgtaaagatttagattgaaatgactgaaatggggagataataacaagagtttctttcatgctactacaatccaaagatataggtatgcttacaccaattgaaaggtgacagtaaggcatggttggaaggttaatattacagacttatgaatgtaatcactttagacacattagtccccataattttaatgttcaaggtattgtaaagattattgtgttactgttaagtttagggttctataacataattgatttctccatatctgagtacctttgtaggagccagattaattcaagacaaaatagtcatagcacatgaggactttcatgctttgaagaggagcagcgaaggcacaaaaagaatagccctaaagcttgacgtgagtaaagcctatgagaaattagaatggactttcttggagaaggctctaatagcatatgggtctggggataaatgggctaagttagttatggccttattgtctagtataacatatacagtctaaatgtgttccaaagtcctacagaggcctcaagcccatttattattcttgcctcaaatactctctctcaaatattttagaaagaataaatcattaatttcgtttttaaagtattactgtctcccttaaataatccataaattaagaaaaacatttaaataatccttaaagtattgaataaccataacttttaatttaagttaatgtatttttaacaaagtttaagaactattttgaaggtattttttaatatttggagaactacttaacacaactttttatacttttgggatcacttgagtagtttttttttttttttttttataaaaaaaatagagtatttagaagagagtaatattttaaggatgaattgattattaagaaagctcttacatatggagatttattgtgaaccccttctagcccaactctttcctacgtaccttctatttgaagattatgctcttatctttgggattacttgtgctggagaagctgtccatatttttaacctgtcccgggtcaaaggattaacttagcaaagtctggattaatctttggcaaatatattctactgctactaaaagagatatatattattagtgtcttaggaaaagaagcttgggaaattgttggtaattttcttggtctcccaacagaatggggcagatctagaaataacactcttcagtggattagggagaagaggaaactctaatcaaggtcgtctttcaaagggattccctcttatgcaatacctgttatacactttccttagtctttttgtacctttctaatttcctcagtagctaggttctgatggaggaataagggtaggaagaggattgctctagaatagttggcaaatattgtcctttggtggtattactaatctagcaaagtagaattggccggcttatagagacccaaattcattatttttgtttcatgggtttgacatagtattcttcaaggcaaggagtttgttaagtagggtcattgaaccataataaacgagaataaggtaggtattaaatgatagtagatgaattagagccattcgaccccattctaagtttggattatttagttaagagaagctatcatgttgctaaacaaatatcatgtgaagtgagaagatcaatgagctcctcttcataattaaggcaccccatataaggttagacattttctagggaaggtcttccataatgcttttttggtcataacaaacattttcgctatgaagcatggctgtctatctactatgtatgttgtcccatctggtgcaagagacaaatcagcatactctattactctgtccctagacctaactagtttgatttaggacacaaatacgatgctatttttattttacgtgtcaaagattaatcaagtacattctatatcccttatgttgtggtactggtatatttggaaagcaagaaacaaattgatcaatcaaaacaatactcataatcctaccatttagtttacatttaatcattgcaatcattaaaacaatataatatatgaaaactttttttattattaaaaaccaatataatgtttataataaacaaaacagtttgaattatatgtcacggcaaggtttgaagtttttttccccttttagtttaaatacaaaaactcacatgaggttgcattgattcaaaagacacatgaatgttttgcaataataaagaatatatgttagttacatattttaattttttttatcattgaattaatttcatatattgggtcttactaaaataattgttcaaatttattcaaaaatatgttgaaaacatcctgttggtaatatttgactttttgttcctcctacagtggcatgtagtttatatttggagaactaaattaaacacggaatctgtcgtgaaagaagttgatacttgataggttgactgtactataatgctactagaattgtgcacaatagataactttattatttctttaagtatttctccttttttttatcagttatgtatttctgatttaaaattttaaaaaaagaggtcttaatcagtgtatttgcatttaataattttttggcatggatattcgaaacagacaataaaggtaaaaaattgattgggaaaaaaataaaactcgtttaaaattgaaatgagctacaaaaagcgtacactagacgtaggttgtattaaattaatcttatggagatcaaagctgaaaattgatagggactcctacatactgggtgtttctgtttccccttcccttctcgcattatcacacgtcattagatactatacattgagagtctataattattagatgacacgaagttggtgaatgtctatgtcaatttcccaccccacaacatgattgaataatttagacccttcttacagagttctgaagtctcgttattttaaagatttataaatgcttgtagttctaaattggaccaacaaacaattatttgaggctaatcgagtttataccacatttattagaaattctcaactcatatagctttacacaaacgagtaactcatttcaacttttaagtgaaatggcaaacccttggtttattggactcagaaaattgcaaacagtctatgtatattacaactttgtggaagttgtataactaatattattttccgactcgtgtaagggttattcaattttgtcatggactttgatttcacttaatactatactacatccgatcctttttactaaaaacaacaaaaaagtaatagtctaaaatatattatcacttgtttcttgtaaaaaatacggtaggtaatagcatccaaatggggaaaaaatagcattaaaaacatagaaaaaaaatgattcacgcatcaatgatgtagagagtaataatttttatatacttctgttttctaacaactccttctccaccttctttttctttgtataattgtatctgttgttttcgctcatcacatttcttattttctatcccatcacttcttatcactctttcctcatccaaaggtggatggatacacctcacagaatctttattcaatacagagtaataaaggaatagggaagtagaccaaggcttggacagttggacttgtgcacagggaaaacaaaggggaaaagaaaacaaaaaatcagtgtcaaagtaaaatagaaaaacacttgtatccttcaaaatgttttatggctctataattatgattcaccattaagtttgtatggatgctcaaaaccacacatctgatcccatgaatttgttataacagaaggagatgaaaccagttatgattgccacaaccaatttgattcattgttttcatggtaaatggctaaacaattcttttatataccccaagcatatgaacacaacatccattcctaaataacctctaactacaaaccccactatacatcccaaatgtaaaagagctactactatcatgtttggataacacataagaatcaattctaccccatataatcaggtgataccataaaaaaagtagaagaaactatttgttgtttttacctacaccatgaaaaattaattgattatgttttaccataaagctacatcactactcaagagacccctttatagtgattcaaggaaaccagtttttgagagtacagcattcctcactttgctaagatccctacctttgagggttctcccagcaccttctaaaacagaaaatgaggatatctgactccttgcaagccttctggcaataaactcatgtggaggaagcttatcactgtcatcattttcctctccatcctcatcactactcccaccatagttagcaacaccatcatcatcaccatcataatcaccatcaaaccttgaattagcactattcttggggggtttagtgctataaatctttgaccagtcaggaatgttgacaggtgctgattgctgaagaaccttatcttcattggaggaactagcactgctgctattgctagatcttgggatcattctggctgaactaggcctagcaggaacaggaacaggaacaggaacagaagaggattgatctttgtctttgaacttgcgaaccccagaagtaccataatcactacttctgttcttgaaaacatcccaaacttcttcttcatcaaaatctccatctctcaaggacttccatatcccactatgctgcctgcctagactatatttatcttccatcacaaatcaatcacttcctgcatagtcacataacacaaatgtgaagaaaattatctcaaattattgaactagaattttcactggtttaagcaaaagacaaaaaggagaatttggaaattgaggggagaaattaagaaccaaaactataaatcacagggggtgattatatttgatacaataagatatttggtattttattgaggaaaaataaaaggaaccacctttatgttgttgttgttgctgtcctggaatcagaagcttgaaataacccaactttatattgattctaaagtggtttcttgctggaatatgcaaagaaaaaatgagttgtgaaatgagagatgagtcagcttgaattaattctgataccataagaacttgaattgactgaatatatatgatggtgagtcaaaatccataatattatggcttacctgaacaagtttgcagagagattataggagaaacagcaaagcaaagagagagcaagttcgttctttctgaaggggaaagaatgagacactgaatgataggtgtccacgtatttaactctggtacctcacaggattaactttttagtttttacaacgtagtacatgtacatgcccactatcttttttattttcaacacctctgttctgagttctgaccgtctaaaccttaaataattcaattactaccttttatttttatttatatcgcatttattactaataactcatattatcaattagagttaatgttgatgcacgaataatttaattcattttatactatcatttaattataaattattatttaaattagtttaagataattattttaaaaattatcacatttatcataaaattattattagatgattatataattttttttctttccatgagtccaccaagattattgtttttattttttattttttcacctactcattcacaaccttttccatataagtgatgattaattgagtttagtatacagtccaaaaataaataaatttgagttgagtatatgttgtgaatctctaatgcatctatatttatacgaggaatagtcatttgatcctaaaattatagtgaattattacatgtccttgtcgtaaaaaaaatattagtccttgaaaataaaaataaaaactcaaataaatagcggaacttttttagaattttagttaacttgttaaaaattaatcattttgttgcttttaaataagaatcctaaatggtaataataacatatgtatagaaaataattttattattattactatattttttgttaccagagtaatgctgtgaaatattcatcaatttcaatgatcattaatctttattcattgatcatcatagtaaatatatgtttttcatcatatttttatttatttataagactctaacctcaaatcttccttgcttgaagtatagaataaattaacttataaacatttttatccataaaaatcaaacttaagtactaataaatttataataatttacttatgttgcttaagtaattgaattagattttttatatttataagcatattgtatcatgaaaattaaatacatacctatattaaatactaaaattattaaatgtaatacataattaacatacataataatattcatttttgcattaattaattataaatcatttttcaaattaattaattttcatattaataaatatattcaaacctttttatcataaaagtaattataaaaaatttatatctgaaaaaatatattaaatttttcttattgtaaaattaattatattaaaattaatatctaaaaaatatactaaatacattaattttttagaacaaaataaatttataaatatattatattaataaacttaactgatattaaaattagatgctatatttgttaaatacaagcataattagcttcagtaatacattgactataacatacacattcatctattataatatattatgttgattaataaattttcatattgataaatattttttataaaattattatcataattgaaaattaagaatttcatacctgaaaatatagtttcatcaagaaacttatcattttcattattatttggagcatattataatgtataaacttgttgaaataaaaggtaatcaaatgcttaatcttataatacaaaaaattcatgaatatataatatatatttttttgaagaaaattcataaattttgagaaattaactataaacataataaattaaaataaaatatttaaattcaataagatggaagtcaataaatacatattaaactaataatacgagaaaacatgaaaatattgtaatatgatattaatatattgttattattttctatttatatttaacactatcttatctctctctctctctctctctctctctctatatatatatatatatatatatacacacatataaataattaacagtacattaatattaaatactatgtttattaaataatgtaatatatattccatgaaaattaacaatgtaatatataattaatttaaattaaactattaaatgacatggtaattaattatgacatgtttctaagctatatactttttcatgttaataaataataaatatattaaaagaatattacataaaagatagttattacaaactttactcttaaaaataagatagttataataagataaatttataagcatattatataattaaaattaatttcacattaatattaaatgctttattaattaaatgtaatacataattaacttaaatacatattacatgcaataatttcaatatatttccccgatacatgaatttccatgttaatatttaaaaattattaaaatttcatacataaaaagtatactaaaaagtatttttttcattattatttataataaattaatgtttcatttgtaactactagtatattaccattaaataaagttgataatttcttttattgattttttattgaaaatttatattattatgcaaaacatgttatctacaataaaatttgttaataaattataaactaataaaaaattattttctcaacatcttttttttttatattttaaattgtatgttttttttctccatatttatacaaattgctcacgcacctcttgacataaagaacatttaccctttcaataagtgcccacaactcatgattaattttttccttcactatttctttcattaaataattttatactatcattcaatcataaattattatttttttataaaaaaaaatttagtatttaatattaataaacaggctgccataagatgtgtcaaccagaaaagttatacaagcacaatatagtaagtgtgatgctgcaatcatgatccaataagaaatcacataaatattgcagccatgtattcaccatagtagacccaatcccaaaacaataaaccaagtagacccgtgctcactcatgcatacaacggcactcaggggttctattttccaaacatacaaggagaaatcgaatccttttgctttacaccagttccacgccctatatccaaattcatcacaaatcaaggttgataatgatataacttaataaacgcgagtgacatttgattattggctattaatggagcattaattgaaaattaactctgattaaattgtggtcgtgtcatttaataattttctagatcctcttcgggttaaaatgttgtattgaagaacatgtgcttgaaaattctaaggaagactacaagaaacgatggtatatacagcccccttgaattggtggcgaacagataaagacaggctattctcgaggaaacagacaaaagagtcgaagtttcaacaacacacatgaatacaagtgttggaaattgtgtaaaaaaaaatacttatgatgcacatttgaccctaattacacgaccattttttgtcttgtcttcctctttttgttttttctttaacttattttcatcctagagcatacatttttattaccatatcatcaagagggaaggatatatatgatatactgatgtttgtgattagggtgataaggttacaaatatatttttttagtacatttttagtatattataggagtattttaaatttaaatgaaatttctaaattaaaaataatttcaatattattaatatatattttattttattttatgaaaataaataaaatatatagtagttttaaaatttagaagaaagatataaaaaaatatgttttttatatataactttaaatttaaaaaataaatttaaattacggttatagggactatgataattttaaaattccttttagtttaaaaaatatatatttaatttacaatgcattaaaacttaaaatttaaattaaattaaatttaagtaacagtatttgaaaatataaatataaagtcacgtaaattaatgaaaaaggaaaacatttcttaaaactgatctcattttaaaataaaaagactcaaatatgaaatatgtaatgtgaacaagatctcaaatagagtcttgcaagtggaaaaaattgttaaggagcttaaataaatccatccaattcaaattaattataatctaccaacattaacatattaattgtgatgaaacttgatattaatccttaagcaagggtcttacatttatgtcttatgaataataaaaaagtaattaaaaagagatatttgttaaaaataattagtcaggttctcaatgaaaaatatatagtaattaataagtaaaactaataaatattttacgtctattacatagttatatatatatatatatatatattccaatgtgacttttaaatacgttaatttaatataaaaaataaagttgaaaggaaggtaacgtaaaactattagtagataaaaaatgaaaaagttaaaattctataaggagaaagaaaattagtacacggaaatgatctctgttctggcacagcatttgctttgtcaaagtttttaattcttttttttctttaattttctgaaaaaagctgtgtaaattgaaaccaaagggaaatggttcgtgaaagtttctgatgttgaagaagatcaacgtggcccacatgcaccaattgccaatccaccattcaacatatatggatatgaaattttgtcagggagaataactactcccaggatttagtgggaatcttatgtaaagaattaatctgctatataagattttccaccgttggagcagaatcttcttgctaaaagctaagccatgcacagcattgaggtggcggctgtaaagtgacagcactggtgttgagtacgataatcaacacttagcacagttatctgattttagtcataattaaaaatttatatattagtaattgttatatgtcacttaattatttgatctcagctcaatttttgtgttgttgtattaatgggaattgaaaacagtgtcattaggcgcagtgacgcatctaggattctgggttagtggggacaatttattttaaaaaataaaaattgataattatcattatcatatgagatagttgagtttaaacacaaagataaaaggtacaaaatataaaatttcaagataaatatgtgcattttattaaaataagaggatacatttacttactcttacatatacactgataataaaattcaaatacatgaaattacggaatgcaaaatataaaattaggaaatataaaatataatatttttggacaaatattaatggttttattaaaatgaggggatgcatttgcccactctcatttcaactggatccagcggtttgaatatgcaacacagaaatgtaattgaaactgacggcaatatatctcactcacttagccttcactttcttaatttcctgcaaatttacattggttgtctaatgtgcatcactgatgttggatattattggattacgtgcaaatgtttaattttgtattatactatgtaatatatttttctgttggcgtatattaattaattgattgagagttttgtacgtgttttaatttctttctttctttctttttaggtgggtgtggggttagagctagtatctgagcactgaagtatatttacgatggtgaagaaatgcgtatattacactcaagaattaatgccatatatgccaatcaatctcatccagtgttcaccaaaaatgtagtttacgcagctgacaaggtagctgtatgtcataattcattaagtagtaacaagtgaagacaaaccccacgttcagccaaaaagttttcatagttaacgatatgggaatgtaggccaaaccacgtgcattaggaggctagatttgtttcgagtatttattgctttcaaagttcaaacatttactgatatatggccacaattaatctacctgcaatgtacgtgaaatatcgagacagacatacataactttggcttcaattcattttaagtttatttctttttatattctacaattgaaattagaggtgtatttaataatcattatttatctttaatgccgaatttaattatagaggttataaaagtaaaattataattttaatgaggagaacaacgacaaaaagtatttctaattaagttctatcctatttgttttttattggctcaaagctaggaaatctctcacaaaccttcaggttgaaagtacgttgaagggttggtgccctttataagtgatctttttagttaggtatatgatgagaggaaggtcacaactgtaaatgcctctaatgctttaagtcaataagagtaagagttaagacgtagtggttagtgtttaaggcgtacttggtatatgatgctaattaagtcttctttataggcctttttcttagtgttcatatatatgacaggagattagatgagataacatgataatttgttacctattatggaatttaattatcattaagcgagatgataagaggttaattaactattaacatgtaatatgttacctattggtgttaaagacacaattaagtgtatcaatcatacaactaatatatatactagaatgtatgagtacatctttgtttgagaaattaaaaaaggaagtaattacattttagtttttggtattcaataaaaattagagaagaacagacacaaatgagcaactaagaaaaaaattcaataggcaagaatggtaggtattagaaatgctaggcatggggttgtagaaaccactggggtcgagctctaacatggcttccctttggcgcaaaattcagcagcatgcgcaccattgtagtgattggcgtggtggcatcatgtgtagctgaccacgatatataccaagtgtgacatttttcgttgttggtttatcttgcaagtcttagcctttttttttttttttgctttaggtgttgtcatcttttatcttttatgaaacataaacactcattattttaaacatttttatttatatcgcttatttttctttatctctctcttcctaccaaataaactctagctaccatatctatattttttctccttttactttcaattactaggtgttgcatagcattatggtgtccatcaaacatttttaaaacctaaataattaagtgaaatcatgcaaattttgaacttagaatctcagaaatgtgaatcacatgaaaattgatacacttaggttgttttctcataaaattcattaagttaatgcaatttttttttttttttttgcaaaaggacaataaatctacaagttattttaatattattgttttacaagttgttatattcaataatttttacacattaaattttatcaattcaactgttaaattaaaattgcttataatatataattaaataagttatttttttataaaatcttaaatttattagatacatcattagataaatttaactaaatgcataatatatttttaaaaatataagcaaaatattgactatgacattacataataaaaaatatttcacttatttaaaatttgatttgcatgatcttaaaatttgggtatgaatataataaattgacatcacaaaacttgcttatcccattaaatattttaatttgatcataatgagttctcaaacatatacattatctcatgtcgaggactaaacatctcaacataaaatttgtaaaactgaacatttattagtagtttgataattaatgatctaatagtggtggtttgataagcataacaacacttattaggataaacttttattccatttataaaacgtgagtttgtgtttaacttaaatctacaaaactaacttataaaagtaaaatttgctcctacttatatattttattttagtcatatttttagtcaatatacaatatccaatacgtgatctttggtcaaaatcaaaatattcaatggttaaataaattataaatgtaatttaatatgtataaaaataataccaataataatttctaataaattaataatgtaaaagttttattttactgttaatgcataattatttttttaatcttaaacatataaatatgatctaataatctatatctatagttctaatttctctccattaaaagaatctcatttgatatgtgtcctctctcccttgctatctgtgtatattacattttgggaaaagctcaatgagctatttacgtattttacataaattacaaatgtggaacatataaaacaagaataaaaaaaaagtcaatttccttcaactacataaacaaaaagtatttgtcaattctgaatcgagcatgatttttttgtcattgtttaagataaaattaggtgacaggttacatcccagaagtccatgtcataattagaattaatattacaattttaaaatgaaatacatttctcacatgaacctttctgcttagccgtgcatatgctgggcctgggccttattttcgatgggagggttgatttttctttggcgaatgctatatcatgcatatttttttttaagtacactccccttttattttaattattgtttttttattatcattagtcctctctatacccaaaatattcctttatgctgtttaatcattactcgggaaattaatttccagaaaaatgcaatttgatatcatgtaacatacaaaatacaaaaaatacatgaaatagaataatgcaatttgatagaaaaatagaatgagtgggaaggttgtgcagaagcgcttgttaatatattctgggccagatttaaaaaaaaaaagacgttttaggccttgggccgaactagtacacaaattagtttcactattgaattgtcccacagatgagtaattaaaccggtggtgaaaacatgcgtagaaaaccaagtgtatgtttaagataatttttttatcaacaaatattaatttgttaatttggttagaaatactaattgggagaatgcgagaaatgttagtttggaacctttgatttgactaatgaatttgtatacccttctatattccaaaatgccccttcgcaatggacaaagcattgtttggcctagttaatgcatcattcctggttttatttgtatgaagtccatttgttgaagtttcctatgcaaataaataccacataatatgatattgtgcatactttatagaggtacaactgtaaaagggtgctggtctggacaccattatcttggctctcaagattgggctgccaagggtcctttactactcgtgagctcaccaatgacaaaatgttatttcgttatatttgtaagtttaattattatacattaccagcttaaattttatattatcaattaatcaatcaaaaatcatgttagtactaattttatggtaggtattgaaaaagttaacaaatttaatatatatcataatttgtaatagatgacagtaaaactccatagtctcactacttgagtatatttattggactgctttcttgttttacaaatattttttcacttgcttgttcacatagggggtgaaaggagttattgctaagagctttgagagaattcaccgtggtaatctagttgggatggggatcatacccctctgcttcaaacatgatgaacacaagaagtgacgggtcatgagtgattcaactttgatcttccaggaaaagttggtgacacagaacctggtcaagatgtttatgtgtccactgacattggcaaatcttttaaatgcaagctttgccttgatgtaagtttcttaattcatgtgccttctatatatggtttatcatctaagattgatcaacgcacttgcacacagtggcttcactatgatatatacttatttagcaactcaatttgctggtggagctggcataccttgatcatggtggcattcttccctatattatccgaaacttgattaagcaatgggttttttctctttggatttctgaggcacaccatcaccatgtgaaatgtgtggaacacaataaattccattttagatttttttacgcatggatctgaatgtacttaatggcaaatcaatatgtttatgcaatgtttaattttcatgtattttatctattttatttaacacttcactgtactacaaaactgttaatctcaattatcatattacagtcaatccattgtttttattttttactaacttgagcgtgagacataaaactaaaaagatatattaaaaattttaaaaaaaattaataaaaatgaagaggttaattattgttagaatttatgatctattattttaaataataaataaaaaaccgaggcatgttgcaataacgtacagtaattaatataaacgagtatggatttaattaattaactttagctccaaaacattaactgtataaaatattattatcaaattattaatgataatcataaaaaactaagcctatcaccaaatattctgatatttcacttgcttttatagcagcctttcacgtactaatcattactttttaattgttatcaccccaatataaatcttgcaattttgttttataatatttctgatgaactaaaaaatattaacttaaaaaaattaataacaaacatcataaagttgtttgaaaagccaaaaatactcgttataaagaaaagaaaaaaacacgaatttgtttgcatttttattatttagaaaaatgacttcttatttcctttaactcatttatctttaaataaagtccaactaattatatttatttcgaacatatatatattgttggcaaaaaaatattaagctgagaaatgaaagggaagagaggaagcgtgacactgttccccaattttctgtgcttaaagtgaagcatttcgaaacagcaagacacgatgccttcggctcaagatccattctacgttgtcaagcaagaaattcaagaatctgtaagtattgtctcttttcccaaatcacctaggtttcgttttcggttcaatttggataataaagattacattctttttttcatagatcatgcgatgcacttagaatttctgtatgatttctctgttactggtattagtggatccgtgactttacgtgattcatcttctcaagcctgattcctgagctgaaattattaattgggatatttttgctcctaatatcttatgtaattgatctgagtatgccattttttaatgcaaattttggattttggatagaacccaactgcgatctgtaattggaggataacactatgatttttggttttggggttgatgtgtaatttattggctgattaattttcattttctggtaagattgataagctgcaatctacgtttcaccaatgggaaaagactgctgatgctggcgagcgatccaatctatcaaaggaagttcttgctagttgtgaaagcattgcatggcaggtataccagtcgtatttttttgaaccactgacaagttggttggcctataaatttttgttttcaatgagtttcattcattcttccaacgtggtactagtatcatttgtatgaaatgggatttgtgtattattaggtacacgttagagggatgtttggattatattacaatctaggtcagaggtagggaaaggtatttccttggggaaattttattgtggtaggaagtaaaaagagtgatgtgcacataactgtccaaaatgattctgacatatgctgcaatttatgtcaaatacatggtatttttttatcataaaaaagcagaagaatcgttcactctgatcattgtgaggatgcaaatctttgtaaatttcagctaaatatcattgttaaattttaatgttaattagttaatataagagctcattaataaatagtgaatgcattatattcatgtatttttattcatcattccattccctccccattgtattttttagccacccaataaagggagagcaagatcatcaataccttctcccttctttccctcttgttttcttttaatttgattttgccccttccctttgggtctgtaaggaaagatgaaggggagtaaaaatggagtgagctggaaatgttttgattttcactctttgttggttgttaaatcagagagtggaaaacagatagaaagttacttctaactctactagcacatcttttgtctagcctctctttgccacacatcttaggctatggtttttccttctgcaatacaacctattcaaactgctaaaatataatttttttttgataggaaggtggatgaattggacaaagcaatttctgtagcctctagagatccttcttggtatggcattgatgaagtggaggttgaaaaccggaggaagtggacccgtgatgctcgcacccaggtatctataacatgctgaacttgagtaagagttaggagaatacagtcaaattttttctcaacctaatgtatagttcattcaacattgttttattgctagcacctattagattcccttctctctctgttttttttttttttttttatctgtatggtgcttgtgaatgattgtaatacattattaggtgagcacagcaaagaaagcagtgcaagctggaaagggcttaaacaatgcttgtctaaatgggatgcacaaggaattaatgaggcttcctagttctcatcaaactacatctaaccaatatgctgcccaggataatgatgatttcatagagtcagaatcggacaggcagatgcttcttataaagtacttctttcctcccattttctctctctcactttatatggcattgaattaaatatttgtcttttgtcctgcttttacttgactttgtgcacatcttcttgatattaaacaaattgacacttgaccgtgacttttgtgcatgcaaggtggaaaatattctggtaattagtttgacctcttaagttgatttaattatattgtccactcctcctctatgctttctgagacataagtgggctcctctgtatgaaattgtggacacatgaacatatttttcttgtgcttctttacaaattataaatttctgttttttaatatcatctttgctaattattttagttttgtttggattatactatttctattaaataagaaatattaactaaaatgatggattcccctttttttctgtggaagaaaaagaaaatgggggagagtaaagactgtggcaggtagccttaacacagataaaggctggaaatacagtgctcaagtgttttcggaaaataatcaatctctggtttctattttatttttgtcttatattttatctattggtgctgataggagacaagatgaggagttggatgagcttagtttaagtgtacaaagaataggaggtgttggacttactatacatgaagagctccttgcgcaggtagatttgacatttgacaagtttttggtctgtgatcttactattttgcttagtgggagagccttgttgctgtcttgtgagttggatgttactggtgtaaatcctggaaacagcctctccccttgcgggttaaggctgcggatttctattattactcttgtgtttcaaaagtatgaaactaggcaaaactggtggtgcttatgtttcctttgagtgtcttcaatagtagctgtgttctcatgctgattttgtttccttgggaaatttctcattctaaaattgtcaaagccttgatgtttcaggaaaagattattgatgaactgggtaatgagatggacagtacatctaatcgcctagattttgtccaagtgagtttctgcttcgagtttccattattgcattaaaatgtatgatctatctggctgattgctgtgattaattagtaataatataaggagggcgagccctgacacagcagtaaagttgtgttttggtgacttgttggtcatgggttcgaatccggaaatagtctctttgcatatgcaagggtaagactgcgtacaatatcctttttccttacctttgcatagcgaggagtctttgggcaatgaaatatgtagtttttttttttttttttaatataatgagggaaatttttaatgttgaatgtgaaagttgaagtgtgtctcattgtttatgatatcagaaaaaagtggcaatggtcatgaagaaggctagtgcaaagggacagatcatgatgatattgggtttgctggtgctgttcattttcctctttatcttggttttcttcacctagttattgagatgaaccttgtcaatgctctgtttgtacatggaaaaagatctaaagcttctgtgaagatacaagattattgggagattcaatatgtttaaaaaatgaattgaagcctctttggtttgtcaaaggcagtagaaaattttgattatgatgaaaagagaagcgatgtacttggaaatatcagaagaggattttgtttcttaacaagatggattacaaatgtgatttaaattagttgtattcgttttaaagatgatttaaccttgcatgtaatgtttgatttctttttttttttttttttttctttttataacgacagcgtggtgttttgaatttatagtttcatgactgtaccaaaatagcttatgatctatcttcattcaaatcaacccattatttacctgctcactcctggtggcatgatgatcttgtcggttgctgttttgtgttggcacagtagaatattgaggggaggataacatgttatctaatttggccagatatttcaaggtgtaatttttatgcaattgataaaaaatgaaaaatgaaggctgttgtattaatcattttgtgtctgttcagtattggtttgcttaagagtggtagggtgaaaaataaggtaatcatagccttctttgaataaaagaaaaagtaaaaataaaagggaaattggatatgtatatatgttgtgcttggaagatttgtaagaagatctataagaagatataatgttattttgttggaaatgttttataaaaaaaatactggaatttgtagagaaattgagagattaaaattcaagaaataaaattgcaattaaatttcataaaaacaattcatgtgtataggcttataatcaacatcttcctaaaaaatctgatatgttaattttgttaaaggtttaaatatgttttatccataataaatacttaaaatttgtagttgttctttaataaatttttattttaagttgagtttctaataaaataataattttgtttgagtatttgataaatgaaaaaaattattagaacttgtcaatgataaaaaataaaattgttattttattagagagttaaagtaaaataaaaatttattagaaataaaatgtaaaaattaaatatttattatagataaaaatatatttaaaccttttgttaaactgggagaaagtatcactgtgatctgcataaatttttaattactatttaagaaatctaagagtttaattaatactttatatgattatatcattagatgataatattataaaaaattgtaaaaaatatttcaaatttaaattatatacttacggtgaatttaaaagcagaaagatataaataaacctacttaatgcattggaaagaagttagaaggcagggaagtctactcacatgtaaaaataaaaagtaaaaacccagaaatatcatactgatcaataatttcctttgcagtatgattaattggactggaataattttgtttctcttttgtaaaaggatttgaaacaattattttttgtcccgatctttcttttgatcttctacagacaaatattataaaataatgcaaattgagaagtgataaaaattaaaagaattcgtatctgtaacactcagacaagcataaggaacagaatctccaaagcaatttgagtctagattcttctttcctttgttcttgttctctaccacaactactatataccacacaaattatcttgcgtttctatgccttaaattacaaccagatatcaatcccatggagaataggatactccatccacccaaaaacaccttatattctgctattaaccatcattagacccattgcaatctgtgagaaattgtcacattgtaagaattttttatttattttaagacatgtaaatcaatatttaacatctgtaaacttatatcaatatataatatatacacacatttaaaaaattactttatactatcaaatgtttaattgcatggtgtaaataatttgtcctaaaaaatttcactgctattaaattgcttattctgtcacgcacaccccgctactatatatacccccaccactacctattcttctcaattcgctcttgctttgtttacaagtcctcctttctcacaggttcgtctctccttcaacattagatcttcctagctcatttttaattcctacttggtctaaaaaattgtgtttgtgaaagtttgagttccatgtttaatgtctctattacacaagaaagacattttattctcttttttttgctactttccttacgaattatatgtacttgcaagatgtgaaggaaagattttgattttaatccataaggttgacataactgtgtaataatgcaccattgcgttcatatatgagagaagatgtatttaatgaaaaaatttgtatttgatttcttctttgtgcaaatttttttgaatcaaaagcagtcacgcacctcgagtgagattagtttctaacttaatgaattaagagacattcatgatctctgacacaaaacaataaaacagcgtgaaggaaagaaatgcttaataggaggctttagatttgttatggttagatatgttgatattggcatgcatgcatgaacatgtcacatgtggcttatggtgttgtacattttgttgcagctagggtggtgattagtgtacatatatatatatggttgaagtgggtatttatcacatccctacgagcactttcgacccatttgcggaggcaaaagaaacagatgcccccggggcaaaagagtatgtgcatatccgcatacaacagaggaatgggaagaagagtctgaccacagtgcaagggctgaagaaagagttcagctacgagaagatcctcaaagacctcaagaaagagttttgctgcaatggcaatgttgtgcatgacaaggagcttggcaagattatccaactccaaggtgatcagcgcaagaacgtttctcacttcctcattcatgctcgccttgttaggaaggatcagatcaagattcatggtttctaaccaactaccactaccacctttcttgtattatgaaattaaacctatggctgcgtttatgaaataactaaggagtttgagtttggaatatttggtcattttctctctgtatgattgaaaatccaagaatagtctgagagttgttatatataatactacatgttgtgctttcatggaccatgttttaagctatttttatctgattttaatttttaagagtatcagtttaacaattctaaatttataagaccactataaattcgaacaaaataagttgttatatatgtgctaatatatatgaaataatgcgttgcctgcccttcaagaatcacttttaattttaagattagaaaagaaaagaatataaacaagaaccaaggctatttacttgcatgtgtgagacatttctcttgcctcgtaatcattagttctttgatgcaaggttgccttttttgagataagaaaaaaactttaatacaatgttttttgtacatttggtctacttaacacttgatcgcatgtgttaacaagattttatagttattatgacaaaggaaaatgtgtgggagatactttgatgttttaatatgcacaaatccgtgaatacatgcatgtatgataaaattgtcttatatatgattaaataataatttatgaaattttacattattttcaatgttattaaaattggttcgaacctaccggttgaaccggttgaactaggaacctagtatcaatcgggccgagttggctaatgaaccggccatgcatatggcccaaagaaaaccatacggttttaggaagaaccgaaaatctgaccgatttttaggacccaaaccgagttggtgaagaaaaaaaaaagcttcagacgcataaaacgcaaaaaaaagcttcaacttttcttcatcttcaattcttcatttgttcacggcttagctcagggcctcaggcactcacgctcactgcagcagggcatgccatctccatcgttactagcgtgtgtgggtgcaacacggtgtagagagtgacgatggaggaagtgagaatgacttcggacggagcaacgttgatggcgacgaataagaggaaacagtcgtggaggaagagagagaacaacctccaaatgtagagatgatcgaagagaagattatatatatatatatatatattgagagtttagttttttttagttgggcttgactagatgttgcttcttgtacctcgtttattattttatgcaatttttattttgcattgcgaattagcttattgttattttggatttttgagtatgaaattatggatgaacttttcttaatcaagtaatattagttatatacatatatataatataattttaatttttttaatacagaccggctcaaaccaggccaattactggtccaccggttggatcactgacctactacctcaactgggtcaataaccagaccgatttttataacattgattattttctttcgccgagtttatgttaattatctcttctttcaacctatcttttgattataattaaatcgaatattacaaaatacttaaatttgttcatcaatccaaattattttaattagagtttctccatatcaattacatgccaacatattttacatgatatcaagagaacctctctaataagttaaatgtatgttttcaaggtctaggcatgttcatttatttgcaacaaattaaagtaactttgagatctcttttattagttactttgatacattttacaaataagacaacctagctcttacaatttcaaatgactagagtaatcaaataggccgtgtgatttgatataccgagttgcactactctttaattaaacaatacccaataataacaggagatgggagacaccttaataacacgtcattctcactcacagatgattatgctcctttaaggccacaagcatcaaggaagcaatagtgttctcggcatcattttttcgagatttttcatcccgtcatgtgaatgaaggatactgttgctatctgaacaacgcaaacatatcacaatgctagtgttgacagcacgtagaagagagagttggcctggttggagatcagggtaagtgcgataaaggttgttggtgatggtgtgattgagaggtggagtctccaataaactccaaatgctcgtaggagacaccctctttagaggagaacttagtgagcttctaattaatagaaataatcattcatacataatataaactactaccttttacacataattcatttccttgcttttacccatgccatttccaccctctcttagcactgcaaaggactatactgcttaagagttcaatgcatgacacatgcaaaaaaacatttgtatgctttaataaccttactagaaattttgacaagcgaataatcaaaagggtgcaataagagtttctagtttataaagagaaataagggaacaaagacacaaatgaaaacgcagtaaatgaaggataaatgtacaagcaaagaaaattggtattttattatttcttgaaagtgttggaagtgaataatatcttcagacccttctaaattgacatagaggattttgagggtgatcattcatagatcttttacagtaattatcaagattgaaataacagaccatcacatcacatgtacagcatcttcgttcacagcttgacaagtgcaaaccagagaagagaggagactctgaaggaccaaacctgcagcatatcatgcagtttgagatcattctgaagcacaattttgtcccatccattggtcaagtcgtagaagcagcttcttgaacccttcttgaaacacatgttgcactctctaagagaaggatccaacacaatgacgtgcatgccagaaatcctttcgttttcctctagaaaggactcctccttttgtgtcagaaaattgttggcaattttcatagagaagctggcatcgtttaggtttggattcaagtctgactcacagagtttcttctgtatcagcaacttcacctcacatcccttcatttcttgaatcttttctttaaatggacttggcaattcatcactgctactgctagcacctttcgtggacgtgccttcttcttcgctctttctttcttcttctctctttctttcgtcttgtcttctgaggatgctattcaaaatctcagtgtcatcatcctcgaggaatgaaaataagtgaggattcctttgttgttccagtttaagcaaggcacggatacccttcctcaaaaatatatcatccgaatctccttctttctttacagctcctcccgaattcttttcctcatttgccattgttatgtatcaacgttgcagattagagaagttttccttactctactctctctgtctctctctctatacctctgtatatatatatatatatatatatatatatatatatatatatatatatatccatgagtctagatatagtctctgtctaataaaaaaattcagttttttttttggacgggaaaaaaaattgagatattgataactgaatcaatttaataaggactgcaaaaagtaaacaataaaaagtgaaaaaaaagtattagattgaattgaattttaataatatttagataaatagtcattttcgtattaaaagagcctacttaagatatttatggatgaatttatgtattatatgaaacaaaaataattatttatccaaaatataatttaatctttatctttttaatgtaagaatattttattcaaaatagaagactcagatcaaaatataaccattagattaatccttacaaaacaaaaataaatctaacttgatactaatacattcaataatattaatagcatcttagcaatagattttaaactacacacacccaacaatctctaatcattgtgtaaaacgaaaaatttacgcaatcataaaaaagtcaagttagatccctcgaattgatcttcattactaatgtttgatcataaaaaaatttacacacccaacgtactaaaaaaaattataatttattatcaatttagttcgtaacaaaatcataaaaaataaatatccctcaaattgatcttcattactaatgttaagttaactccaaggctatttacttgcatgtgagacatttttcttgccccgtaagcattagttctttaaagcaaagttgacttttttaagataagaaaaaaaataaaatgttttgtttggtccacttaacatttgatattgcatgtgtaacaagattttatagttattatgacaaggacaaatgtgtgctgagatactttgatgtttaaatatatacaaattcgtgaatacatatatgtttgataaatgtgtcttatgattaaataataattttttaattcttatatcattatcttttggtctagttcctgttaattatctcttccttcagcctagcgtttgactataattaaattgaacagtacaaaatacataaatttgtttattgatccaaattgtttttaattgataatttacgtacattgttattatttataaatgtaacttttatttaagtttctttatatatggattacatgtctacatattttacttcatatcaggggatgctttccaataagttaatatgttttcaaggtctaggtagattcatttgtttgcaacaaattgaagtaactttgaaatctcttttattaattgttttttgatatattgatacattttacaaataaggcaacctagctctctcaatttcacgaacaaatgatcaaagtaatcaaataggcctcgtgattacacataccaagttgtactgttattggaaataatccaagtcccacatcgactagagatagtgccaagtcaaaatatataagtggagaacaatcccttaccctatgagctaacttttggggttgagttaggtcaaaattcacattctaatacgatatcatagcctatcctaaatccattaatgggccacccaccatgttatccacgcaccaagtccaaaagtgctggacgtgaaagggtgtattgggaataactcaagtcccacatcggctagagatagtgccaagtcagagtatataagtggagaacaatccctcaccctatgagctagcttttgggattgagttaggtcaaaatccatattctaataactgctatctaaattataatcatcaagtgtttttttttttggtccaaatcatctggtgtcaccatcggctggaaaacatgcccaattacctaccatagtcacaaatgacaaagcaactttcatcatattgaattatacaaagaatttaaaatttttccactattgcaattgtaatttaaaacctttattattaatcattaataaaacttataattaattatcatcatgattaattgattgcaacgaaatctaacaagtatttgagataaatatcattcattatcatcgtgatggattgataaacgtatgcaaggacctttgatgccttcactaatctggcatcgcgattgtgtttaaggtataaaatagcaacaaataaacaacgatattattcaataataagtactacgtacgaatcactgaactctttcagcattattctatgttttccaacaaacacagaaagaaaaaaaagactcctaaagcaattgaggttttgaaaatggctgtgacatcaaagtaattaattaaaacgtttaaatatattttctaaattaatgttttaagttttttaagtaattaacaaaaattcttcacgctataaaagaaaagtctatttatctaaataattatataaaattactttaacaacaataaatactatactaatatttttatgaaatttaatttacttatatttattttccaattttcagatgttatattaacatgtaaatcaatatttaacatctgtaaaattatatcaatatataatatatatacgtacatttataaaattactttatactatcaaatgtttaattgcatgctgtaaataatttgtcctaaaaaatttcactgctataaattgcttattctgttttgcacaccccgctactatatataccccaccactacctattcttctcaattcgctcttgctttgtttacaagtcctcctttctcacagattcgtctctccttcaacattagatcttcctagctcatgtttaattcctacttggtctaaaaaattgtgtttgtgaaagtttgagttccaagtttgatgtctctattacacaagaaaaacattttattttcttttttttcctactttccctacgaattatatgtacttgcatgatgtaaaagaaagattttgttttaatccataaggttgatatagagatgtaatgcttcattgcgttcatatatggaaaaatgatgtatttagtgaaaaaattatattcgatgcaaaaaaaaaattgaatattttattcagcatgcatatatatctcaaacaacgttgtcactggttgaggttgttgctccaaatcatctggtgtcaccatcggctggaaaacatgcccaattacctaccatagtcacaaatgacaaagcaactttcatcatattgaattatacaaagaatttaaaaattttccactattgcaattaatcatgatgataattaattataagttttattaatgattaataataacggttttaaattgcaattgcaatcaattcattaggttagaaactaatctcactcgtgatgcgtttatatatggaaaaatgatgtatttagtgaaaaaattgtattcgatgcaaaacaaaattgaattagtaaccatcacgcaccatgagtgagattagtttctaatctaatgaattgattgcaattgcaatttaaaacctttattattaatcattaataaaacttataattaattatcatcatgattagttgatagcaacgaaatctaacaagtatttgagataaatatgattcattatcatcgtgatggattgataaacgtatgcaaggacctttgatgccttcactaatctggcatgcagcacagggcacagggtaattgtcttcggcaatagcatccacaaagcattccaattgctgaacaaggggaggggcattgtggcgaacgcagtggcctggtgacggtgttgtttgtttataagatatattttatgaaattaataacatattcagataaaaaaatttaatttacttgaatagaacattaaaaaataatttggattctcagttacggagccattgatggtgatggatttaggagggcagacagtggtaccctatacacaggcaattaggttgtgataccatatagaagaaaagaaagatctgaatttattgatgtataagtgaagtacgagtcagtttaatttgttacataaacaactaaaggatatataacattgttatgcaacaaatgcatagagtttattttttgaattaaagataaactgaagaagtgcttgtagatattcagagatctagggagagctagttccaacaaacttcacctcacatcccttcatttcttgaatctttaatttcttcacatggccttgtaattcttggaatctccaacattattattagcactgctattgcaagcacctttcgtggacgtgccttcttcttctctctttctttcttcttctctctttctttcgtcttgtcttctgaggatgctattcaaaatctcagtgtcatcatcctcgaggaatgaaaataagtgaggattcctttgttgttccagtttaagcaaggcacggatacccttcctcaaaaatatatcatccgaatctccttctttctttacagctcctcccgaattcttttcctcatttgccattgttatgtatctacgttgcatattagaggtttcatttctctagctactctttctgtacctatatatgagtatacactaacctaacaaattttacaactaatcaaatatactaatttaaaaaatcaaagcggaaaaactggaatattaccaaatcatccgcagtatatataggtactatgagaataagtcttcttaaagaccagtaactgatgcgaaattatcaagaaaaaatatatttatattctttcttattttataatcttctacctaattttttgttgaattgcattgaaattgaaatatttacaagattgtaattcgaatttagaaaatataatttaaatttcaaaaataatatgttttggtgatgtaaagttatagagtatcttattttaaataataactttattcaaaacaaataaaacacgttaattttaatcaatcataatattttgtttttattggatttataattttaattttaagaatacaattttaattaagattgataaatattactgtaattatcaaaagtttaaaattaaaatcacactataattataataaaaattaataattttaaaaacaaaaattataaataaaaatttaaaattaagaaaaaatttctcaatgtgaaatcacatattgttcaaggcataacgtgtttaagaaataattgatttatttgaattatgtgctcgtttttataatttaaattatgtatacgtgattagactttttcttataaaaaattaatattactaatatactttataaaatatttttggcatatttttatgttggtaaaaaaatttattgtaaagaaaaaaaattgtagatttatttttttagtttatatatatttagttttgccaaaatttaggaagaagattagggaaaaaaagaaacaattaataccaaaattattttaatttgatgttctaatttttattttactagtatgtaagtccatgcaatgcacggggaattaataataatattattattgttttattttttaacataatatatcttttattaatatgtaaattttaaatgtgttttatcttagtacttattattaaaaaaagaactgagtcttaataatattagtgaaattgcagtaaaaaaatatattagtgaaaataagtatgactataggccataaagcattccacttgccgaacaagggtaggggcattgtggccaaacgcaatggtggaggtaagagacctggccaggttggagataggggtgaaagtgagtcaggccgtctatcagggacctttggcttgacatatttaagggctgacatgacttatttactataaagattaagttaaggctttttgaaaagtctgtttaaataaaaatgtcaggatcaaacttaaaaaaaaacatgttaggtatatcaggctgacctatttattatatatatatatatatatatatatagtaaaacttaaaatagtatatttatttttctaaaaatatttttccttattatgaaggtggatgatcaatcacttcaaaaaattatcttgaaaatttcatatatatatatatatatatatatatatatatatatatatggttgaagtgggtatttatcacatccctactagcactttcgacccatttgcggaggcaaaagaaagatgcccccggggcaaaagagtatgtgcatatccgcatacgacagaggaatgggaagaagagtctgaccacagtgcaagggctgaagaaagagttcagctacgagaagatcctcaaagacctcaagaaagagttttgctgcaatggcaatgttgtgcatgacaaggagcttggcaagattatccaactccaaggtgatcagcgcaagaacgtttctcacttcctcattcatggtttctaaccaactaccactaccacctttcttgtattatgaaattgaacctatggctgcgtttatgaaataactaaggagtttgagtttggaatatttggtcattttctctctgtatgattgaaaatccaagaatagtctgagagttgttatatatattactacatgttgtgctttcatggaccatgttttaagctatttttatctgattttaatttttaattaagagtatcagtttaacaattctaaatttataagaccactataagttcaaacaaaataagttgttatatatgtgctaatatatatgaaataatgcgttgcctgcccttcaagaatcactttaattttaagattagaaaagaaaagaatataaacaagaaccaaggctatttacttgcatgtgtgagtcatttctcttgcctcgtactcattagttctttgatgcaaggttgccccttttgagataagaaaaaaactttaatacaatgttttttgtacatttggtctacttaacacttaatcgcatgtgttaacaagattttatagttattatgacaaaggaaaatgtgtgggagatactttgatgttttaatatgcacaaatccctgaatacatgcatgtatgataaaattgtcttatatatgattaaataataatttatgaaatctaacattattttcaatgatattaaaattggttcgaatcggccagttggagcggttgaaccgggaacctagcatcaattgggctgagttggctaatgaatcggccatgcgtgtggcccagagaaaaccgttttgggaagaaccaaaaaccttgccgatttttaggacccagacggggttggtgaagaaaaaaaaaaagcttcagacgcacaaaatggcgtcgttttgatgccccagaaaaaaatgcttcagacgcataaaacccaaaaaaaagcttcaacttttcttcatcttaaattcttcatttgttcaaggcttagttcaaggcctcaggcactcacgctcactgcagcagggcacgccatctccgttgttactagcgtgtgtgggtgcgacgcggtgcagagtggtgatggaggaagtgagaatgacttcggacggagcaacgtcgacgacgacgaatcggaggaaatcgtcgtggagggagagagagaacaacctccaaatgtagagatgatcgaagagaagaatttggtgcaagggagaagcaggaagaaaaaattggtggacgggggcgctgcagcaagccaaaatgagaagattatatatatatatatatatatatatatatatatatatattgagagattagttttttttagatgggcttgactagatgttgcttcttgtatcccgtttattattttctacaatttttattttgcatttcgaattggcttattgttattttggatttttgagtatgaaattatgaatgaacttttcttaatcaaataatgttagttatatacatatataatataattttaattttttaatatagactgcgtcaaaccggaccaattacttgtccaccggttggaccactgacctactgacctactacctcaactgagacaatgaccggatcaatttttataacactgattattttctttcgccaaatttatgttaattatctcttctttcggcctatcttttgattataattaaatcgaatattacaaaatacttaaatttcttcatcgatccaaattattttaattagagtttctccatatcaattacatgccaacatactttacatgatatcaagagatcctctccaataagttaaatgtatgttttcaaggtctaggcatgttcatttatttgcaacaaattaaagtaactttgaaatctcttttattagttactttgatacattttacaaataagacaacctagctcttacaatttcaaatgactagagtaatcaaataggccgtgtgatttgatataccgagttgcactactctttaattaaacaatacccaataataacaggagatgggagacaccttaataacacgtcattctcactcacagatgattatgctcctttaaggccacaagcatcaaggaagcaatagtgttctcggcatcattttttcgagatttttcatcccgtcatgtgaatgaaggatactgttgctatctgaacaacgcaaacatatcacaatgctagtgttgacagcacgtagaagagagagttggcctggttggagatcagggtaagtgcgataaaggttgttggtgatggtgtgattgagaggtggagtctccaataaactccaaatgctcgtaggagacaccctctttagaggagaacttagtgagcttctaattaatagaaataatcattcatacataatataaactactaccttttacacataattcatttccttgcttttacccatgccatttccaccctctcttagcactgcaaaggactatactgcttaagagttcaatgcatgacacatgcaaaaaaacatttgtatgctttaataaccttactagaaattttgacaagcgaataatcaaaagggtgcaataagagtttctagtttataaagagaaataagggaacaaagacacaaatgaaaacgcagtaaatgaaggataaatgtacaagcaaagaaaattggtattttattatttcttgaaagtgttggaagtgaataatatcttcagacccttctaaattgacatagaggattttgagggtgatcattcatagatcttttacagtaattatcaagattgaaataacagaccatcacatcacatgtacggcatcttcgttcacagcttgacaagtgcaaaccagagaagagaggagactctgaaggaccaaacctgaagcatatcatgcagtttgagatcattctgaagcacaattctgtcccatccattggtcaagtcgtagaagcagcttcttgaacccttcttgaaacacatgttgcactctctaagagaaggatccaacacaatgacgtgcatgccagaaatcctttcgttttcctctagaaaggactcctccttttgtgtcagaaaattgttggcaattttcatagagaagctggcatcgtttaggtttggattcaagtctgactcagaaagtttcttctgtatcagcaacttcacctcacatcccttcatttcttgaatcttttctttaaatggacttggcaattcatcactgttactgctagcacctttcgtggacgtgccttcttcttcgctctttctttcttcttctctctttctttcttattctcttctgtggatgctattcaaaatctcagtgtcgtcatcctcgaggaacgaaaataaatgaggattcttttgttgttcctgtgtaagccaggcacggatacccttcctcagtatcttatcaatcgaatcaccttctttctttacagctcctcctgaattcttttcctcatttgccattgttatgtatctacgttgcagattagagaagttttccttactctactctctgtctctctctctctctatacctctatatatatatatatatatatatatccatgagtctagatgtagtctctgtctaataaaaaaattcagttttttttttttggacgggaaaaaaaattgacatattgataactgaatcaatttaataaggactgcaaatagtaaacaataaaatttgaaaaaaaaagtattagattgaattgaattttaataatatttggataaataattatttttgttcgttatgaaaagattaattaagatattcatagatgaatttatcaatattatatgaaacaaaaataactatttatctaaaatataatttaatctttatcttgtaacaatattttattcaaaataaaaattcaaaaaaaaaatacataatcattaaattaatccttacaaaacaaaaataaatctactttaattttattactacttaatacatttaatacattcaataatattaatagcatgggagcaatagatttcaaactacacacccaacaatctctaatcattgtgtaaaacggaaaatttacacaatcataaaaaaatcaagttagatccctcgaattgatctttattactaatgtttgactataaaaaaatttacacatccaagtactaaaaaaatttataatttattatcattttagttcataacaaaatcataaaaaatagatatatatccctcgaattgatcttcattactaatgttaataagttaactccaaggctatttacttgcatgtgtgagacatttttcttgcccagtaagcattagttctttgaagcaaagttgacttttttgagataagaaaaaaataaaatgttttgtttggtccacttaacatttgatattgtatgtgtgtaacaagattttatagttattatgacaaggacaaatgtgtgctgagatactttgatgtttaatgatatacaaattcgtgaatacatatatgtttgataaatttgtcttatgattaaataataattttttaattcttatatcattatcttttggtctagttcctgttaattatctcttccttcagcctagcgtttgactataattaaattgaacagtacaaaatacataaatttgtttatcgatccaaattgtttttaattgatataatttacgtacattgttattatttataaatgtaacttttatttgagtttctttatatatggattacatgtctacatattttacttaatatcaggggatgctttccaataagttaatatgttttcaaggtctaggtagattcatttgtttgcaacaaattgaagtaactttgaaatctcttttattaattgttttttgatatattgatacattttacaaataaggcaacctagctctctcaatttcacgaacatatgatcaaagtaatcaaataggcctcgtgatttcacataccaagttgtactgctatctaaataataatcatgaagtgtttttttttttttttttttttggcatcttcaacagccaaggtaccaccctcattggtgtatattgttagctccatattgatgggagacttcatattaacagaggggatagaacatccaattttatttaaggcatcctttgaaactttgaacttttgcaagatacttttgagcagaggtggaggacacaataagctccccgtttatatagattagcaaagcaatacttaagtctccattccttgaatattttatatggcatgcatatatatctcaacatctggtgtcaccatcggcatgcccagttacctaccatagtcacaaatgacaaagcaactttcatcatattgaattatacaaagaatttaaaaaatttcaactattgcaattgcaatttaaaacctttattattaatcactaataaaacttataattaattatcatcatgattaattgattgcaacgaaatctaacaagtatttgagataaatatcattcattatcatcgtgatggattgataaacgtatgcaaggacctttgatgccttcactaatctggcatgcagcacagggcacagggtaattgtcttcggcaatagcatccacaaagcattccaattgctgaacaaggggaggggaattgtggcgaacgcagtggtgacggtgttgtttgtttataagatatattttatgaaattaataacatattattcagattaaaaaaaataatttacttgaatagaacattaaaaaataatttggattctcgatcagttccggaaccattgatggtgatggatttaggagggcagacagtggtaccctatacacaggcaattaggttgtgataccatatagaagaaaagaatgatctgaatttattgatggataagtgaagtacgagtcagtttaatttgttacataaacaactaaaggatatataacattgttatgcaacagagttattgtttgaacttaaagacaaatgcatagagtttattttttggatcaaagataaactgaagtgcttgtagatattcagagatctagggagagctagttccaacaaacttcacctcacatcccttcatttcttgaatctttaatttgttcacatggccttgtaattcttggaatctccaacattattattagcactgctattgctagcacctttcgtggacgtgccttcttcttctctctttctttcttcttctctctttctttcgtcttgtcttctgaggatgctattcaaaatctcagtgtcgtcatcctggaggaatgaaaataagtgaggattcttttgttgttccagtgtaagccaggcacggatacccttcctcaaaaatatatcaaccgaatcaccttctttttttacagctcctcccgaattcttttcctcatttgccattgttatgtatctacgttgcatattagaggtttcatttctctactctctctctctgtacctatatatgagtatacacaaacctaacaaattttacaactaataaaaatataataatttaaaaaatcaaagcgaaaaaattggaatactatcaaatcatccgcagtatataaaggtattctgagaataagtcttcttaaagaccaatgattagtaaatgatgcgaaattttcaagcaaaattatatttatatatatattttttataatcttctacctaatttttttgttgaattgcattgaaattgaaatatttacaagattgtaattcgaatttagaaaatataatttaaatttcaaaataatatatatgttttggtgatgtaaagttatagagtattttattttcaataataactttattcaaaacaaataaaacacgttaattttaatcaatcataagattttgttgttattggatttataattttacttttaagatttaagaatacaattttaattaagattgataaatattactgtaattatcaaaagtttaaaattaaaatcacactataattataataacaattaataattttaaaagcaaaaattataaataaaaatttaaaattaagaaaaaatttctcaatgtgtaatcaaatattgttcaaggcataacgtgtttaagaaataattgatttatttgaattatgtgctcgtttttataatttaaattatgtattttttataatattgtttgtaaacgtgattagactttttcttataaaaaattaatattactaatatactttataaaatatttttggcatatttttatgttggtaaaaaaaattattgtgaagaacaaaattttgtagatttatttttttagtttatatatatttagctttcccaaaaattaggaagaagattaggaaaaaaaagaagaaacaataccaaaattatttttatttgatgttctaatttttattttactagtatgtaagtccatgcaatgcacggggaattaatttattattgttttatttttttaacataatatatcttttattaatatgtaaatttttaaatgtgtttatcttagtacttattattaaaaaaagaaatataagtcttaataatattagtgaaattgcagtaaaaaatatattagtgaaaataagtatgactatagaccataaagcattccacttgccgaacaagggtaggggcattgtggccacgacgcaatggtggaggtaagagacctggccgggttggagatcaagctaagtggtgacttctaataaaagcaacttatcttgataattaatatccatttgacttttttttaaatgtattttataaaataaattttatatattataattaaataccaaaattgtgtcgtagtatataataaaatgtatttgttttaatatttatataaatgctatattaataatattaaatattctatcaacatgtcaagtataatttaattatataaagtcaaaattagtatatttctaattctaaatattgtattaatatacatttaaattttccttcatcttgaatggaattttttttttaataacattgtatttgaattttatacttaatatatttgttaatgctccattcaactaaattattatttttttatcccaatatcttttttattttacataggatatatgatgaataaaatagtttaatagtcaattacataaatttcttttataatatcattaaatcatatcttattatcatgtacgataaattttaatattttataataattattttgaaagtcattccaacttgatttgtaattaaagaatactgtaaaattattttataatgtcagaccatcaaattcttctatcaatattgctttttaagtataacttatctagagaaattaatattttataattttaatttctatatattatatatcacattaatattcattcaaaattttctttttgaaaacatttttttaaactaatttttataaaattttaattctttaaaaaaatcatattattcaagtaaacacttatttattttctacttctattaaaatttactaatgcaattatgtcaaacaaaaaattgaattaatttttaagtataatttaattatataaattatgaattaatatatttcaaagtctatattatattaatataaattaaaattttattttattatattttttgtcaagtaaaaatttgaattaatttttcaagtataatttaattatatatcaattatcaactaatatatttcaaagtctatatatcaaattaataaaaaaaattgtagtttttttgcaataaatagaacaattttatcacacatgtattcacaaagttgtgcataattaaacatcaaagtatctccctcacacttaaaaagtttttgaaattattcatgttttttatacttattctactcaataaattatttaaaaggctaagagtttttgaatttgtttgtattttttatgtttaatagatttcgtgaaattaaagatatttgaaaatttcataatttatttgattcacttaattatttaaaataatattttgggaggaatgtgtttaatttaattaccttaatttaaaataatatttcatgattagtaattaaaatgaataattggggtttaattgaatagagaattgaggagaatgtaaataggtatctaaaatcatgaacctaggtctcttaatttgtcagaaacgttcattagttttcatgaacctatgataaatttgttgtttgggagtctctaatggacttaagttcgttgttactattgtaaaataaatttattatttaacaatatattttacggaccatacatatagtgtaatatattttatggaccacgcatatagtacatgcttaatacttggtggccaaccataacaagtcataagtagaggtagaaagggctcaaggcttaatctgatttatttattaaaaaggtttgacttagacttttttaaaaagtttttctaattaaaaagataagacttaaactttaaaaatagcttattaaacttaatacattggcttattcataatatatatatatatatttaatatatgcataaaattattaatattaacattaataaaagcttgatacatttgttttctatttaggtttgttggcctagatttaaaaatattattttgatataaaagaaagacttttataatcaagattttatagtttaaattttattgaatttatataataagaatttaaaagatggcatataatattatgtatttataagatttgaaaggatttcatatatttttagaaaacatttaaaatcacaagagtcgtgaaaaaaactaatcaagaaatgttaatgtttagattaaacaaagtaaaaacaatacaattttttaataatcttttagtagctgattaattctaacttcatattcttcacatatctaaaactatactagtcctttatgtattatcatcttcttatccctactcttgcatttgaacaatagactcaaaaaattatggtcatcattatccagtaatactgaagatgaagatttgaatactagctagttcaattgaaaatatgacgggtgcactgttcagcgaacaacgatacctgttgatcagagtgggtaaaacttcatttcttaaatttggagttcccaatacctatatacattagcttttgtctttttaactcaattttgacgatgtcgatgtatcataccatgggttagttgagttgtttttgttgtttgcaatccacgtgctttgaccccttgcaaggtgactagtcgtcggcatgcaaatatttgtctttttttctttttttctttcgaattttgacagatttgttttaccgtcattaacgaaaacatattgtgtttgttgctaaaacatatcttacatttgttttttttttcttctgaaaaaaaattaatgaagactccggaaccattatccttaaattaatgaaggagtactttatatgatttttatgtttcaatataataaatattaattttttcttacttttatttcctagacaagtatattcagttgttaacatttcccttttcagctagcagtgtttgttatcatatatacgacgtcacgcagagttcctactcctatatatatatatatatatataaatataaatatatatatatatatatatatatatgtgtgtgtgtgtgtgcaccaagctgtatatgataaaaaaaaatactagcagttctagaaagcaagcaatttaaaatggaagatgtgaacacgcggaaaattaagcaaccaataatctaacacgttttgatactaataaaccatttgaccatataatgtgagagtttctctgaatgaaggcaacgcgtgaccctaaatattgataaacaaataaggaaaagatatttttgaagcggcaagccaaccttgaccatacattaattatagtggccgcaattaccagaactatatatacacaacggggtggcatcacataatcgtttgagagtaaatttgtattgtatatttctgatcattagttattattctcaatagctatgtacctctcaaacatcttcgggtgcttctccgagggctcaccagaagaatccaaaagatacacatgcgatgggaatgtttgtgttctgaaaaacccgaaggcaaacatggggaaaccacagacattatctaacagcaagaaatcaagacatagccttcggatttcgtttgctcgtcgtgccaaaaggtcttctagttgttagatatatatatatatatatatatatatatatatatatatatcactcttgtgaatggagagagagaggctcaggttctgcatgatgccatcagcccatcaacactacagggttacgttttattggtttcatatttgattctttgatcgctttcatctgttgtacaacggcgtagcttattctatatcatttataaattctacctctagtaatcttaaattcttaaagatattttaacttttatttttaatgttcagttattaattaacaacttatagatctctcatatgctaccctgtttgtgatccttgtgaagtatactttaaagatacgggttgattttgtagcttaaaagctctttagtatatgtattgaatcaatataagagtttggaaaattctgttcgacttttctacttgattaagtaatgcttcttgtgtgagtgaatatatatatccatctagctattttaaatgttcatccggtatctcatttatttttatctttcttcctattgcatcataaatactcatcaaagatttttcttctgtatttatgtcacagaaacagttggtaatgtacattaatgttacaaaggatttgaaaatgccaaaaatgaagatagagtagttacacatgagcattttcatcactccaaaatgccctgacagagagagctaaactgacttttttttttttgtttacaaacgagaaaaaaggaaaacaaaaaacaaccaacaagcctaaatcattattctaggaaacttaatccccaaagcatccaccataagactatcctttaacatctgagtctgaggagcttcatgcaacagctgaagctgattcgtgcattgatttgcttcccaaaaccaatgctgagaccttaaagcaggaagtttaggatttgtttagatataagttaaaagttcttttgaaaactttaattttttattagaaatataatattttttttttcagtagagaagctctcaaaaagacttctaaccttatatctaaacagactctcaatcatctcaaatgctggattcctagcacaccaaataaaccacattatgatggggattagaattccctgcttgcaaatcagctccttcagagcatcaagaccgtcagggacatgcaactgaccaaatccgcggttgacaaagctattatttattcaattactttcaaaagccctaagttccactttaggggtgagagtgagacaagggatatgggaataagtaacgcaatgaactaatgggtaacttctcgccaaatccatattaaacaaacaaacgtagcttaagtctatctgttaaacaagttagactattgttttaatttaaggtttatttagttcaaaaaattaaatcttaaatcatttaaaaaatctttcagacataataaatctgtgtatttgaatcataattataattatattaacatttcactgtgcgtgatatttaattttgatattttattcttgtttgtatgttttttttaagtcttgctaatatatttaattaaaaacttaaactaattaatttacatataattttaagttcattagattatttaaagggaagattctaagctactttaaaaggttttattacaaaggagattttactaattaggatttctaggtcaaaattttaaaagattaggtcagatatttaaaatatctatattatataaataggttagactcggattttaggtttaaaaaatatattataatcaggttttataaatccttgtctaagacaactctttgctatccttaaaagtgactaaaaattattaaaaaatgatttaagtcaatcatcttccaatatatgtgaataaccacattatgtaattccaaccaaacatgttacatacaagtgtgagcctgtttctcgtgagccgcattagatcgtatttttaaataagctaaactcatcaaatttcatatgatttaagttattaatctttataaataacttcatttggtcttaatctttcaaataaattgttaattttaattcttatcaattttaatttttttaagatttgttcatattattttttaactatgacatagatataaatcatctagcatcaataattatgagataatatgtaatgcaacaaattaatgtcacattgtcactaaaatagtgataaaagtattttgaaaatgttaaaatttacaataactaaaacaattttagaatctttaaaaaaatagaaaataaaaaatgaaatagagtcatttatgagaactaattaagaaacataattttaaaccatcttaatattgagctcatttcaaataaatgcatgagacttagaaaaaaaaaattaatcataagtcatttcaaccttcgtatttccaaagaaaattaaaactaaataaagtcatttatgagaactgaggaacataatttaaccatttttatgtttagtttgtttcaaataaatgcatcaatcttcgaacaactttttttaatcataagccacttcaaccttcatatttccatagtttgatacttctaataatcacaagctactccaacctccataatatttatgtcaacctagaaacaaatttacacccgaaacacccaaaacactagttccgaaggggtgtaccgtattttacttaaatgttgaactagcagagtcgggtaaaattaaacaaggaaaagcaagttgaggttttgcattcgagacatgtacagaaaaatatagcagcattaagaactaaaaacaagtgatgccttccccatcaattcagataaacaagtaatcataatgaaatcaatatcaaggcaaccgaatttcaaccatttgtaaagaatgtagaaagcatcatcaacaggatttattgcccgctaattgaaaaatctaagtaacgcttgatcatgaacgactcctaaatgttttatatggtttcaactctaggatagaacacagacatgctgcattaactcggtagttctcatctggaaaagatggaaagtcttgaagttgttttctgccaaatctgctcaagtcttctgtggcgatcacaaatcctacttaagaaaaccatcataagattcccaacataagcatccaagggaaaacaatcttcccaagcacatggtattcatttcatctgttctaaaagtagcacaaggaaaacaattttttttttttatgcatgcaagaaggtttttggatgaaattccacaaccagtcaatattcctgtggaagcatccacatcagaaatacaataattccatgtcatagttgccggtctggttgctgagagtcaaccagcacaccagatgattgttttgcagttgacacaggagattgggaaccaatattcatgttacttggtaccatttctttgggctcatacactgctgcagctgtattattacttgtaagctttgcaactagacttgcattattctgatcactcgagggtaaagagttgaattccacttgtttcaaacccttgttctcataattgttgaggttcctggtttggacattgagctgctgataaaagagattgacatgagaattgggtcttggttcattagaaccaaacaaggatgatttttcatctgatgtaagcccactactagaacaagctgaaggctgttttccctcatccattggtccattaacagaatattgttccatggtggattccacattcttacaatttgtttcaacctctattaattcagtagtagactgcaacttagtcgctaaactaggttgtggctgggcatgattattaagcattaatactggggttggaagtggttcatactctccaacccaaccacgaccaaatttacagccagatggcagtgcctgctgaatcttctgggaagcaactttccatgcagtaggtcccagagttgcagcaaaacgagccaaactcctggcatatgaatattcatcttgtggtccaacctggtgccgaaaaatacaacattaatgctttaaacaagaaagctaaactattcaaggattagaaataacaattcactccttttgatacatacactaactagccgtggcttaacttcaccctcaaatgttgtaaatatggaatccgatctagtagctggtagattagacatattatcttgcacagatggtttcctttccaacttggagagcagatccctccctgaaacaataaagtaacagtcaaaagcgaacagctagataatgacagtaatatccaactgagagtatgcaaagttgaacaacgaaggcatgaaatctatgaagcacatatacttcaatttgtttcacgtatccatatccgataccaatactctaaaatacttcatcgatacataccgaagaagtatccaaatctataaagcaccaacaattaatagtttaatttgcttcacatatctaatatcgatactctttctatactttaccgatatacttagtggtgaagtatccaagcttttaaagcattttatgaaagtccaatacaactacaagaaacatgtaagcgtgtataatatagaaacactttcccttaatgaaccaaaaataaaaattgttctctttatgtatgattttaagaaaggaataagattcatagtattgttcctatattcaaaataatagaaagtaatttataatgacatgcaatcatttataattttatttttcattagagacatgtaagggaatttcaattaaattaaatggaatgcaagtttctcatcaattcagaatttgtacaataattatttttactaatgttcaagaagtatgcttataatttagtttgcaaaattataattatatatttatcatgtttatgaattttatatatgtatcttacacgtaatgtattatatatatttttaaaataatcgtatcattgtatccgatacagtattgtttctgtgtatcatagcatgaaatagacatttcttctgtgatacctgatatatagttttctgctttctcttgatttgcatcaatcaataaagcattcccctccagaagggcatcaatattgccaggcctttcacatacaacaccttgcattggaagggaagttggcagtacatcaccaatagtagcacgagttgcacctgaggtaaaatcaaagccaacaggttcctgtgaagcatgacccagcggcctcttttctagcttcttaacaagggaattagatctccttttttgttcagacttcagctcactttgagaacgttcagaatcaatccttaacttttcaaactttttccttgctagttcttgtattgatcgtgcctgtaacaaatatatagggatcatacagcaagcacaacaaaattgctacttgcgttaatttttcaagggaaagcagtcaattttatacctgtttgtggtatatggtctccgccacattgtattgcattgcatttgaggaaatcaaaaatacatcactctgcattcaacagttgcattcaaatcatttatttgcctttcaaaatcactaaatcaggaagacaatatactatgtacggtttaaaaatggttcagatgataataaggggtagcctaatgcacaacgtttgaatggattgcggatattcagcagctgctttaatgcacaaggtttgcggatatacaagtggttcaagatgcaaaggggtctttgacaaagggatccaatggaaccatttctctttcttgtagtggcataagggttgaattgattgatgatggaagctttaaaaatgggtctctaattggtaaagacaaggtggaggtcaacctattgtttttgggagaaacaaaattgaacaatgtaattgacatcaagagcatcttgagatcttgagttagtatcaggcttgaaagtcaatttttccatgagttgctttggagctttaggcttgccaagagttgaagtggagagatttgcggatatcttgaattgtaggttcttgagagttccttgtgtacctcgacatgtcaattggcgctaatccaagaagacaagcgacttggagacctattgtggaaaagtatgagaagaaactagtgggtggagccataagatcctctcaatgacagatagagtgtgcttaattaattttgttttttcatcattaccgctttacttcttttccttatttaagatcccatgtggtgtattgaaaaaaaatatgtccatacaaagaaggttcctttgggatggaggggaaggtgataggaaaatatcttaagtgaaatgggatgagatatgtagagataaaaataaaggaggtttgggggtaaggtaccttggtacttttaatgtagcattactagcaaaatggaggtgcaagttataccaccaaaaaggcatgttgtggagcaatgtgatggagtcaaattacagagcatgaaaatatttactcaatgataattctttaagagaatattcgatttggtggaggaacattaaaaaagggtgtaggggtgggaagaaaggtaattggtttgatagtatagtgagatggagggtgggagataggaaaaatactagattttagagggatacatggttaggtcgtgagtcattagctaataagtatcctaggctcttccatatttctaaccaacaagataggattgttgcaagtgttggaagatgggggtgaggtttgggagtggacgttcgagtggcatagagagtgctttgattaggagaaaccctctctagaacaattatatcaaaacttgaattcgatgtcgatgcaaagagaccaaccagacaggtgggaatggcctattgaggcaaaaggaatatattcaacaaagtctacctacaaatcattgcaggtagacaatggcaatgaccaatcagatgacatatggagatttatatggaacaccaatttaccaccgaaagttgtagtgatgatatggaggccatgttggacagattaccaacaaggcccaacctgttaaaaagagatgtgtggctatatagtaaaggaagaagcatcatgccctatttgcttagagaaattgaagtcaattgaacatttgttatttctcagtccaagggctcagtggtggtgggtacaatgttataagtggaaggatatctcaacagtggagtggttatttctttgaaggaggcaacaacaaaatgagtctttatatggtgtgcattgttgtggtgtacatggagatcccgtaataacatgatcttcaacaatggcatttttaattcaaagaaaatcctataggaggtcatatatgtaagttggacatggttgaaacatccacccactaaactctcatactcattacaacaatgggctagcaatgtgtatgcatgtttgggatgatcatataggaaaggtgtttgagagatttttctcgagcaaggggataagttttacagaaactgaaagttggttatgaaatattgggtaatcattcgtccaaatatgacataaccaactagatagccacttggatgtttcttttctttagattatttacttatggtatatcttatatctctttgatcaatgaaatcgtttatttgttgataaaaaaatgcacaaggttcgaaaatcatactcctcaagggaaaaaaacaagctacatataacttatgctaaatttcatatgattcctataaatagtatactcccgcaaaagttccccactagtttcaatcaaaaacatccaaatcactattgcctacacaattccattatcaacataagtgaataaatcttgacaaactctattatactgacaagtaagccatttaaatgtttcccctcacataaatagcatgcaacaacctcttgctcacaacccacataatcatattgcaaaaataaccaaaatctcagaaaagaaaaggaacatccccaacttcaacagtaacaactgacacatttacacacctcaaattgttccaaggtagaataagatccatttgccaacttcttcctcactgtggcaaagtccatcggatgctcaatcactttgtgataatcaggaagctgcattcaaacataatttgaactttcatcttagattgccttccaaaagcaagattaacaattaacaggaagaaaagccctcatacctctttcggatccactggctccgcatacacaccatatgtatctttcctgtcaattcaccaaaagacatggcatcgccatgcaacaataaaagttgaagattgaagatgttatacaaatcattcaccacaattaaaaccaacaggaatgcatgaagaaagaaaatgggaaacaaaatcgccttacttttgaagcttgtcaaggataaactccaaggtcctcttgtcaggcaacgaaatccaaggtggaagctttgatggagttcctaacactagaaacaaaaacaaaataaagaacctagttaagaaactcaagagaacaatgcaataaaagaaacaatggcacacctgtttcagtatccaacatggtacatttttttaaaaaaagtaagaaattatgtaattaagaattacgaattacattacaaccaaaacaacaaaacacacacacaaacctggaatagagtaaagccctttagaatccacttttatgccctttacctatcacaagaaacccatacacacaaaataaataacataacccaaaaccaaaaaaaaaaggcaaatattgtgtttatgtaataaaaatatgcaatggagacagagacagagacaaacaacaatgggtcctaggttatctaatttatagtcatagagagagatgggggttaataaaatggaagcaaacacaaccagagagtctggatgtatgtgttagttttttatagttgacccgttagttacttatttcccccaaattcctgacacaaagagagagatagtaaacataattcaattatggaccaattggtaccaaaaaaatgaggtagacattgtctcaaattttcaacactttgtttcgttacctcacgctcttcttcatactcattcgcttcctcattccctttttcttcttcttcttcttcccccttttcatatgatgcgtgcaccccacgctcccctttgcgactcggctcatagtcatcctcatcattgtcttcttcattgttgttgagcttcacaatgagctttaacttcttcttgtgcctcttctcgtcctcttcctggtcctcgtcctcctcgttgaggtagtcaatgttgtagcacacattccgacggcgacgaagactccgtcggaggtctggttgcgaggtggccaaagatttgtcggaacggcaagccagatctgccttggagggacgccccctcttcttcttcgttacgatctgatccatcatttgttgttgttgttgcattcttactctcactctctttatatctctccctaaaaccctatttgagtttctctctcttggtttgctttgggaggctccattattttcaatggtgcatgtgaggtcctaacctagctgtcaccactcggacctcagctttggattagggtgggtgaggtaagctgcatgactttgagtgtctagttcccactatttccttcatttctttctctttcttcctttattactacaattaataataaataaactagtaaatacaattaatttcaataaattttttcttattttgtgtgtgtgaaatggcgttactggctaggaatgacgacatcttttgctactcatggcctgaaccctcctttgcatacctttttgcctgctgcccatatctttgtcatttcctccttattttcaccaactatcacctcttgcatcatgtaaatcccacctcaacttaaaaattaattaattaattaattaacatgacaaattggattaatgactactgcattggcttttctcgagaagctcagtgaggtccgagcctgactgtcaccactcgaacctcagcttcagattacgatgggtgaggtaagttgcgtgactttagtgtctagttttccctatttctttcatttctttctctttcttcctttattactataattaataatgaataaactagtaaagacaattaatatcaataaatgttttcttattttgtgtgtgaaatggcgttactggctaggaatgacgacatcttttgctactcatggcttgaaccctcctttgcatacctctttgcctgttgcccatatctctttgtcattttctccttattttttcaccaactatcacctcttgaggcatgtaaatcccacctcaacttaaaattaattaacatgacaaattggattaatgactattgcattggcttttttcgagaagctcagtgaggctcgagcctgattgttaccactcggacctcagcttcggattacgatgagtgaggtaagttgcgtgactttgagtgtctaatttttcctatttctttcatttctttctctttcttcctttattactataattaataatgaataaactagtaaatacaattaataccaataaacgttttcttattttgtgtgtgtgaaaccgcgtgacaggctgggaatgacggcatctgctgcccgtgcccgaaaccgtccctcgcatgcctctatgcctgttgttcgcatctttttgtcatttcccccttattttcaccaactatcacctcttacagcaagtaaatctcacctcaacttaaaagttaattaattaattaatatgacaaattggattaatgactactgtactagagtgagggaataaaatactcctatagtaatgcagattttttagttattacaatggagaattttaaaggaaagtttatgatgattttcttaatctattttgtgatgattattaggttcatgaaattggagtgagttagtactcctttgtccaacttttgcatctattaattgactttacttaatttttgtctctctttccaggatttaaataggaatacataatcttgatgaatatcttattcccttcaattcattgaataatacttttttaagtctttttaataaattccgtagggtaacgctttgatatgtgttttaaaatttaaaggtttaaatcattttttagtaatgttaatttagcattttttttttgttgccgttaaaaaaatgatttcgatccttataaattatgatttttttttcatttttaagtggtttagataatattttttactgttcaaagagttatataaattactttaaagatacaaaataaaataagcataatttgtaagaattaaaattttaaaaaatacaaggcaaaaaattaaagaaatacattaaattgcaataacaaaagatatttaatccaaatttaaattatgcatgtatatttgcaagctttaaaaaggggttgcatacaagttattgattctcctttttaactcgacatgcatgttcttttgattacaggcttttgttttttcttttttattattttttttgtctcaaagctttcagactttttatttctcatgtaaatcacataaatattaaaataagtgactataaggaattttacctacaacacacaatacaaaaatcaaccacgaaaacaagttcataataataactcaatatttttgtgaaactttttattttgttttattctgatatacctgtatttttttataaacattatcaattattcattaagttagttagtaacaaaaataatttattgtctatttatatattgataggcaaactcttgtttttcacttaaaaaaaaaaacttttgtttgacaagtctcatagtgttggtctccgaatattaattatatttctttgttccacaactaatgcaatcaaactacttgtgaattttattaagagcaaattattgaactttccttgaattttactcaaatttcacatgcattttctctctcattttacattactttggcctcctctaacactattaattaatgtcatttttttttcaaacccataaaagtccatctcctctacttccaacacaaacccaatcctcatcccaatcctcatccgctgggagctgctgttgcagcgttggtgagagggagctgtcggtgcaacccatcgatcaagcttccttcttcttatggaacaaccaaacacctctatattaatcacaaactctccctctccctcaacaaccttcataatcacttaattccccacaaatgcattattaatcaggaaattgggattgggataaaatcatcaagagcaattcaagaattaagaaatatttttgtgtatcatttttttaaaatatcagaatatttaatacaactacataattctattttttgcacaaatataagtacatatttaaaacttaaatttaagacaactaaaatgtacttggttttgagtgtttattttttattttcattttcaaattttcaagatttaaaaaacatatatcaagaaaaaactattttaagatatcattaaattttcacttctttaaaaaaatgtagaaaatattgatttgttgttttcagttttaggtcagtttttgaaaatattttttaaattttaagtaaacatattttcactcttatattttgatttctttaaaaaaaaaaaaaaaaacacttaaacaagtgccttgtaattgagttaaaataatctcacttttggttttcatgcttgatgatgtactcccgtaagggtacttgtccaaatctttgtgacctctttctaatttttatttcagattcggattgcctacagtcaagaatttgacatattcaatcaatcacaatcgtgaatggttaaacaagttatattttatatcaaacttaaaatttaaactgtccaatctctgtctaactacatggattcattgtatgaatgtatgacatccttttatttcatagattattcctttctcatttcgaaacttcagccgagtttgtaatctatgtcctcatatatatatttgtctcaaatctcaatcatgattcaagaagcaggcacagaattaaagaacgccaaaatgtcaatataatagtagtacgtatatttgtacgagtatgtacaatgtaatagttaaccgtgagtcgtgtgattgaccgtaagtatatgtctctactcgttagttttttggcgggttactacttaagccttactagaacctgttaagtaggaaaaattgtagtgtattcttcttgaaagcctagatgatgaacgtacaaagctacatgaacttcgaaaaatagttgtgtgcatgtagtgtgacatggttaacatttaaatatgtgattagggtttaattttagactggtgcttacaagaaaaacatgtgttagaagatgtcaagtccataagtagatttataataccttgagagattacttttttaataactggcggcaaaaaaaaaaaaaatcggattaaagaaaaaaagttgttcctatttagataaacgggcttttaagtggtatatataaagtttatttttttttttttgtaaaccaaagaaatgattatataaataaaggggtctaagaaaaaaaaatgttaagtttcaaagtgtggggaaatgatgtatgttgtgtgtgacgttgaaaacttgaaagagtctgaaaacaaaacgtaacttgagcggagccaccgtaaatgcgtacgtcgggacggtcatggtctcttgtgtggttgtggaacattatgatgggttgccctatcgattcttttcacgaactcaatgcactgtttgtttgtgtttccttaaatattttcaattgaataatttttttaaaagttgcacataattaaatatttttaagaaaataagcaatagtttctatttggaccaaaaaaaaaaaagctttaaaaagtgtgtctatgtgtgaatattgtacccttcttgctaaatgctagtccttttgcgtccaataaatattaattatttctctgtcaaattgttagtgaagctcctaaaatgtaatattttatttgaacggatttacaacatgtgaagacgaataaatcacatatcacttactatattttttccccttgaatgtcagagaatggtgttttttttctctccttaaattgtaaagggatcatggaatggaggtctgtggaatatatacacagagtgagagggtttaatttatatattgttatttttacactggcatctattgaatattgattttattgttacatcataagacttatgacgtaggaaaatgattaaaccatattagttagaaatagatgtttacataaattaaattatctctcacatgcacgcacatatacacacatttcaagatagatcaaattattttaagaataatttttaataaagttacttatttcaatatatttttctgtatctattaaattttattaatccaaccaaagattctgatattgtcgaagttctggcttaaaaagatttgggttcagaaaactgtcttcagtgtcttttatcaaatgccacacaaagatgaattggaatgaaaggaactttattaagctcctcgtttccttagaatttctactatagtaacaaaatcatgatatgaacatagagaagtggaaagaatatatggggcggcaaaagtgcaatgaattcgaatcacaagtctattttagctcatcaaaatttatatatatgcatgaatgccggattgaatttggggagtgatttatagtgggatgaagcatatatgttgcaagctgacttccattgggtcaaggtggtattgtgtgatcatgaaaaattgaaattcttatgtaatatatattcagcagtgctttcaaagccaaaatattggggggaccactgtggaccttaaacgtgtactactgtacactttatgaacatgagggtttgacctagctttaaaagctttaagttcaaagcattaattatttatataaaagtgtgtatatatatatatatatatatatatatatagaaccttttactttgagctgaatgaggcttttacttgtcggatgttgcgtattttgatgtggctacctctgctagctttatatacaacccatctactttattaaatcattaagaacagttgagcaacatatactatatagtaattattttcgaagttcatcagagcatctttagtggtacatcttaagtaaagattttgaactcaagatctgatcttcacaagatctcccaataaaggaaatggagagatctccaacatggagaatgagttcttgtacaagatccctcaagatctgcacattgttcaaaaaagaataaattttctctctctttctctctccctaagatctcaaaatgagatctaccattaaaggaaaaaattagagaaattttgagaaatctataatcctatgtggtactatagggtccactaaaaagtggtctaaaatcctaatttaagatctaccactaaaaatgttctcagttggttcttttttggtcattcaattagatatagggtgccacgtgatgcatgtatgatgtatcgatctgtgccttcgaaggttcattaatcagcaacatcgatcagattaattataaattaaactaactaaatttaattaagagttagagttgtgcctagctagttgggtaattatcaaaaacaggcctacttaactttgtcacagtttagttgttgagggaattaacactaaaaaccaaggcaacaagtttaagaattttacttttgatgttgacaatgtttgtcccattaacatatgacacatcatattgacaataaaataagtggatggagtatctggaaaatactctttgctccactatctctcactagcattcaatcaaatttatcttttcacacgtaacgtgtacctttcatccagctttgtggtatctttaaatatcaatcatctaacagttgtctacctccaaagacaccctaaaccaaaaacaatttggagcacacacaaacaaacccaccaagatgggtaaaagagctttccttattgtccatgccttcttcgtcttattcagctttggttcctcaaaggctgaaatcgtttctgccgtttatgtgtttggagactcacttgttgacgtgggcaacaacaattacttgactctttccattgctaaggcaaatcatcgtcactatggtgttgattttcctacacacaaaccaactgggagatttagcaacggcaagaatgctgcagattttgttggtaagtgaatccaaattcactttagctattaatatgccacttcaaacagttgtatagaatatagagacattttttaatagaatgattgtgtgggttgcagctgagaaattgggtttgccaacttcaccaccttacctgtcccttataacatcaaaggccaacaaaaacaatgcatccttcatggatggtgttagctttgcctctgcaggtgctggaatatttgatggtacagacgaacgttatgtaagtgaccaaatgtagttccctctttccctttaattttttattacctccaggctttttttaaatttatttatttatttattctgtttatgcaatatatgggccaaattaaatagggatataggaatctgacccaagatgagcctggatgttttggatcacctctcaaccaatgttattagattcgaactaattattaactcattcaagatatttagttactaagttagatattgatctaatgagttatctgtttacttgcatgatccgatttatattttaaaaaaattaaaataatttcataacatgtaagcttgtacatttaagatttaaaatttaataaaattcattatatttaaaaatatagttatgaatttatttaaaattttgagcatgtaacatatttttttcataattcaatatatataaacaaccttaaattagaatttaatacacacaaattagtcaaggaaaatttaaaaatggtaataattttatcactcaaattttaacatgcggttatgcttggtaaaaaaatataagcaaatttataaataatacaaatgtaaggtataaattaaattttctaatataagtgatgttgttcgattgggaaaaaaaaaactaaaatatgcatgacacgtcaagttcgagtcactgattcgagaacaagtcatgccgagtcagattgaaacacaccaggtcacatgcataactaatccaacccaacgggtggtacataatttttaggaaagtcgattgctaggaatcataattcttagaaatgtgtaaaatacgtttagttagttttaatatgtttcctgaaaattaaagattcatgtaaaataagtaattaaaacttttcctctaatcaagaaattagttgtattcctacccctcattgggaatgttttttgcgaaaaaatgagttaaaattgattttcagaaatcataatttcttgacaaacttttttattaattacattccaaacataaaaatcataatttgtcactttaagattccttcaaaaataaatatttttcatctaccaaaagccccttaggcacattattaaaaatgaatgatcatatatattcactttcttctttatatcattttaatcctattttctttattcattaattatttattgtaattattattttctctatctaccctttctatttttttttctttttcttttttggctctaataaaccccaaattaaggtatacctttattattactcatcatattatatatatatatatatatatatatatatataaaggaggaattcacttactttaaaactaactcttttagagttattctttattttcattattcataatcttaattattagattttaagaaaatcaacagaaaagtaattctactcttaaattaagtgaattccctctatatatataatgttccataaaaatcgttactctcccaactgagccaccccttattctatatattgttggcataatagtgtacttaataacaatatatattattatatatcatttaagagacaatcaataccgttgaggaaacaagtggactactactcaattgtgcatgaggaaatgactcgagaagtaggaggagcagctggtctacagaagcatctctcaaaatcaatcttcgttgtggtgattggcagcaatgatatatttggatactttgaatcatcggatcttcgtaagaaaagcaccccgcaacagtatgtggattccatggctttctcactaaaagtgcaactacaggtaacacataacatcacatgaacatgattataatcaagttactatgctacaaatcttcattaatcactgatcaatagatagacttgctttacttttacctacccatcacatcaaacttcaaaaaaattgtaccgttgacttaataattatattgcgggccggggttccaatacatgcaccctatttgcatgcatgttactttctcgtaaatgttctattgtgcttagagggtcaactcgtgtgtcatttactttgtcttcttttttttcggtaactttttttattttttattttttattttttttgcagcgattatacgatcatggtgctcgcaaatttgagattgcgggagttgggacacttggatgctgccctgatttcaggctgaagaacaaaacggaatgctttatagaagccaatgacatggcggtaaaatataatgaaggccttcagtccatgttgaaggaatggcaatcggagaatggaagcataatctactcctattttgacacttttgctgccatcaacgaccttattcagactccagcttcctacggtactatttttatacaataacatatccaaatattattttctttcttttcgtttctttattaagaaacttccttctcttttatttttttatccttttaattcaaacaacttaaaaatttattcactttttttctcttttatttctttcttccatatttctttcctctaccaaaccatgtttattagttttgttttgagtaaatgaccaatatttattctctaaatttgcatttcgttatagttttaatcctaaaagtaaagaaaaactcaaataagttcgtgagtgtttttaatgtttcacttgggtctctaaaaaaaaaattctcatttttgtttctaaaattatgttgttattagtaatatcacttaagttacccatactagagaccaaaatgaaaagaaaaaaaaataggtttatttcaaagacttatttaagtttttcttaatttcaagactaaaatgatagtaagatagaaattcaggaaataaattggctatttactcttttgtttttataaagttggattctaattaaaataagtttaaatcactttcaggatttagtgaggtaaaaggtgcttgttgtggactgggagagctgaatgccagagctccctgcctgccattgtcaaacctttgtcctaacagacaagatcacatcttctttgaccaattccatcctacggaggcagctgctcgtttatttgttaataaactttttgatggcccttcaacttacacatctcccattaatatgagacagctagtagctgcctaactgaagttgacgattgattttatcccttcaatgacattttttttatctaactcaatatcaaatgccaagtgtgtggtgttgggacgaaaaaaatactactacatttgttaccccgtagagtaatctatttaggcttcatgaaaagtgatcactggctagccaagtgtattattttacttgaagtagatgatatactaagattggcaatttggcataacatgagatgaaggtgtatccatgacaagatgcattcgtgtaagaaagttgttgttttttattactcgtttaattgcaccgatgaaatgatcaacaacactatcatttatgttatctgaccaagtacctatagtgataactgataacttatgttgataaggtgacaagatccaactgattcaaggtcaagagttgatgtgaatccaagctgtgacaaaccgaaagaaggaaaggaaagagaaacggtggtaaaacatattaataatcaaaattattagaattttctaaaaaatattatgagcaagggcaacaattaattgtggatttttagctgagaaaaacgagttaatgtttaaatcattttaaagttgcttgataatatatttatttttttgctggataaaaggggctaaagcccaagaaagcagaaactaaggaacagacagaccagctgcatcaacacgcagcaaagaggaaataaacgcaggagcaacattaaaagcagaaaacaaagctgaagagagaaaactctcttagccatctcatcagcaacccggttgtgttctctaaacacgcttctgaaacagcaacccacgggaattctggacatcctctgaatggtttgcactctctcgagaagaggatgaccaagggtctgtttggatacaagttagaagtgtttttaagattttctctaatggaaatatagtgtttttttcagtagaaaaactctcaaaattacttctaaccttgtatccaaacaggctctaataagagataaagtagagcagagacgaacaggttcagccgcatctgattccactaagacgtgcgagtaacctctatccaaagctagctgaaggccattgaggatagcccaaagtttggcttctaggacataacaagttccaatgtttgccataaaaccatgcaaaaagacaccataatgatcacgcagaactcctccgcaaacagcctcgttatcagacattctaacagcagcatcaacattaactttgatccaacctaacccaggtggtatccaccctaaagtagatgtcgcaacggttgggtcagtatgcaaagagaaatcttcgaggaaactaatagtaactaggatgcttgataatttagcaatataaagaaccacttacaagaaacttattttaaatttatttgaacttattatgatatgttcataagttctttttatttttttatttcaataaattcttcaaaataatatgaaatgaacttcaacttaattttctcttcaatataaaaacaacttatacataataaatattattctataagtctctaattaaactatttaccaaaatggaccctaagtttgtaaaagacttaaaataaaacatggattcaactcgtcttgacataaatgtcatgatcacatatggcatctcaataattcctacgaaaacaaccagcagaagacttcagttcagtcacgatgcattaagaactagagaaaatacatcctcaaagaaaagttttaagtcgcctttgtcaatatcatattccaacaatttctccatggcatcctgcattccattcagaaatataatttaacatgtctctgagagagtaaacaatatccaaagctgtaatttggttcttgaaaattgatatgacaccttgtattgacgatcttaagcagagatgttctcattgcataaccgctcaacatgtttattatttgaaacggtatccaacacagctgttgctctttttatgatttcctctggtacacctgcatgaaccgtacagcttgttctaataaaataaataagagcagaacataaaatatgctttatacatttttgttatcagctaaaaggaaagaaagaacaatatgcgtagtgtactcttttgatcaggaaatatcatttttaaacagcagttttgtaaattaccagcaagcagtgcacagtgcagccctgcaggattccaaaaaccacacacatcattttcaaaggaagatcaaaacatttatggtaaaaactagcatctgcagtacacacacattccatgtatttatgatttagacacttaataaacattggattaacagaccttctgtaagagtgcctttaccaaattcatccaccagacacagagaacgtgaagtagcatgcctgcaggtttcctcaacattaaaagaaaaaattaacacacccaacccacacacacacacatatacagttatacacacactcttcttttaataaactacaaatctcctggaaccctacatctatttaattgttcagataaaaccattcagaaaaacatctgcaattataaaacaagtgggtttaattaattatttgatctttatacatgcatcaacttttcattttagtctctacctaaaaattgtccgtataaaaaattctctgttttagtccctattcgaacaagttttttatgttttaattcatgttgttcgttttctggtagtgtaaaaccgtcacaaaatggaggcataagactaaaacttaaaaaaattccttgtatagggactaaatgtaaagtttttaggtatagggacttaaacgaaaggttggcatggatatagagaccaaatgattaattaaaccaaataagtgagtaatatggaagacaggagcatcctgcatgatagtccaaatactgggagattatacagattttgcctatgatcgatatatagtcaatgtattgaagatatccttattcgcctttatcttggtatacctgagcatcatccctatttgatgtagatcaatcataaatgttgattgttcagctgtcataagccggcttcctgttgcagaaaatattcccccctccccaccaaaggaaaaaaaaattacaattgtaaaactaagatcagcatacaacaatgtaactcccatttcacaaaggacacgattcataagaaaatgatacctatctgtcagacccacagttgctgcatcagctggcacaaaactgccaatgtgggagagaaaaacaattatagcaacctgcaaaatacttctcattacattatgatcatagagcaacaaggagcaaggttgtagcatcatgtaatagccacacattagactgtatgttaaggaatcaacaatctgatgaactttaatgtggaagttaataatttttagtcttcaagacagtccctcacaaaaatcctttgcgctggaaaggtggataaacaagagctcatcacataaaacaataaaaatgttaagatttttaatttatttatagtctgtcattttaccgtcaggtaatcatacaaaaacaagataatataagaaatattaaaaattgtttactttaatattgagtacaataaatttatattattattaaattgtgatgccaattgtcatgtagtaaatttgatatattcttgtatttatcaaataatataataatgttattaaataataataatataaagtaatttttatcccaaaaatacatggtaattaaattctttttcaattggataacagaaaaaattgttacgagtgaatatcaaaaaataaaaacatgcaaaacccaaatcaagacagaccagataaatattatcaattgtagtttgtaggttgtcagaccagatgaatattaacaaccagaagttgataacttggtacacgtactgctaaagaatagttctgcaacacttttttcatttagagactagaatttagaaacattctttttggagactagaaggtaatgtcatagaatgaccttttcaacataattgctatttaaaacagtatgatcaaaatcatacagaatacatataccagaaagataaagaactaataactgacctgctttagatagatactttttccagaaaaattaggaccagtgatgatattaattcttcctaatgtaaagaacaacggaacagggattaataacaatataatgtcatcaaaatggatttcaatgatataagttagcaattatcagttatgtatgtctacatctatttaccatcatgaagaatcttagtgtcattaggaataaatgtgtctacagtcatttcctgcaaaacatgcctccaaacaaaaccagtttttatcattaaccatatcaatgattctccatttccaagaggttcttataaacttgatggtttgaaccttccattttttatatcaagcaaattttcttcagtcaacgaaggcctgacataagtgttctgccgtgcaaccaatgccattgacaaaaagctgaaataaaattatcaatgataaaaaaatgtctgagcaagcaccagttattataatgacaaaatttatcttaccaatccagttcagctgcaaaagttgccacctttatcaaatgggtttggaacaaaaatatacgtgaaaacaagtctctggtgatcgccctctccatatcttgaataaaagaattcgcaaataagtaagatttgcaccagagaccaagtgttataatttgaatttaggaagaaaataactacctacatcacatagctcttctaacacataagctgtgtcaaggaatttcatatttttttattaaactctaatttcttacaactctacacgtaatattgcatctttatagagtgtgcctgtttctccattatcccgctttccaatgtacctcaacatgactaaaccaaagtcatggattggcattcaactggattttaagtggagtttttccatttcaaggttagagcatgttacaagtctgggcaaaggctcagctacttacttcaaagtaaataaataaataacaatagggaactatcaaatgtatgcttaaaatacctagaattttatggtggatatctcccagcagactgtccaattctcgtgtctttggcgttctataaaagtattttttttgtctctccatctgtatcacaaaactgtaattgaaatgactaccatcagaatataacattaattatgtaaatcacttgaccaagtgcaaacggcaacatactgtgtattcccaatctacaagttgctccagagtggtttcatcgggtttttctccaaagatacacattaaatatcctacagtagaaagatatgcattgtgcaataataaaatatccagtattgtttaacatccgaaaaacaaattgcaatgaaaaaataaatatgaataagtgttgttaaacagccacaatggcagcagggcagtgccaccctgccaaggcgtggcagaaatccagcaaatcactgtgtgggacacttggagttgaggattccttgtggtggcaaatggtggctgcaggatcatgacaacatcaacgtggtggtccagggcgttttgtaaaggacacttttgttgtctccgagaaatcagaaaagggatatctaaaaagcccagcatcttccggcggtttcctctggcaatttacggttccttcttcagcaacttgctggcgactggactttcacctcaggctctgcatgttcatctctctgattttcccagtctcaggttttgcctttgtcactgttctctattccctgtttttgtttactatgttccctgcgttccctcactgttttcactgtccttgtctattatgttccctgcctttgtcactgttcattctctgtttttgttatacatatggcttcattgatttttgtctttctggttttttatgatgacaagatttcaacttacaatctcatccaaattatacaaaccttccataactgtatgttagtgttgtttttgacaattttttttttaaaaataatctttttacaagtcacttcaataatgactgatgtgaggataactagagacgttaatggggcaaggcgggtgactactcccccgctgctcatccccgtcctccaattaatttgagactttgtttgagagatggattttaaaagggaagagaaaaaaataaaagatttaactgatgacatttttttctttgagagttttaatttttgaggaaaaagatttgaagatttttaaaactcctctgaaaacttccaaagcttaaaaattgttgttctcccaatttgaaatttttagaaggaaaaataataaaattattattatcattcagtcattttaaaattaagttttatttgtaaaatatagagtgtattaatttttaaagtaagagtaaaattgtaaaaatatcttattaactctgaatttccctctcttaatatatttttaactcccaaataaggagaaaaaaatttctctcattttcctccttttccttcctctcacttccccttaaatctctttctttctcttcccctcctaactctcaaacaaagcctaagtctccgtccccgatcctcgtcatgggcaatctttttccactgtcactatgttcgttcaccctggtcctcgtagtctgctccaaaattttaaaaaaaatattaattttaaattttgatacaagtaaattttaaaaaaaaaacttcaaatgtctcaccaacaatttaaaacattaattttaaattctaatataagtaaaatataaaatcaacctttaatattttaatatttagaatataaaataaaaattaatataagaataattatgtaatttttttggaatagggatcctgcatgacggggttggttggataattaatataaacaacaataattatttttaaacataattgatttattagcttagttggttggaatatcgtattaataacatggaggttgtaagttcaagagttgcatgtgttattatttaaaaatatatattttaactttttttaaaagaaaaacttacttacgaatcgatgaatccgtaagaaccttaacacaaggatacttttggcatttaaaatttttgaatgatgtattagattttgggttggtgtataaagactatcccttatatatatgatacattattaaaagtgataatatatggattattttcaaaatttatatttgacccaaaattttatattaaattttactcataataaattgatcttataataaaaatatttaaacattaaacatataaattcaaaatcaattttattgcccaaatacagacaatctaatccattctactcaaccgtgaatgcttgttttgttttttctttatcatgtatggtagcacaagtttggactgcaggaaaggacagaccggcatgcatttcgagaaaacgaatttaggatgggtttagtagaaaggaaagaagaagaaaaagtaataaaggtctaaaattcatactaatttactaatttattttttttcattttctctactaaatccacccttaaaagaccgggcagagtgatttaatgcagttggcaattgccacggactcgtagtatataacggaacggaccaatattattacttcgatccccgttttggtttgggttatttgagtgcagaggagagtgaatttgtgatgttccgctactacttatactagttgatatcaattatgaaaccgtgttggtcttcttccagttccagtccatctagtcttggcatggcatgagtctcagcgtttcaatcctgacctcatcttcgcgtgttgtggcttaacgtgcgcaggaaatggaggaggagcagcacacttttgtgtccaaagcgagaaccgcctttcattccgccgcggccaaagcggagcgcgttctcttggatttcaaatccgatcgaggttctcctcgcgccacatcaatcactatctctctatttttggttttcctttttctccttatattccgaacggatgtgcattttttttgtttttttttcttctccctttctcttttagggagattcaaacaaaaaataaatttataaaataaaataaaaataattattattattattattgttttcggaattagcattgactcaatttgttgaccgtgaagaagatcacgataagcagtcgtcgcccaacaccttcactggccaacaaccagaagctgaatctcctcacaccgacgaaaacgactccaaggtaatggcaattattgatttggaagaggacacattgaatttaactatttcaatcctaccgaggttcgatttgtttttgttttgttttgttgcatttttgtttttgtttttattcccaacgtatatgcacttccgggagctgtatttgattatcaaacaaaagtatatttgtttcgtgagtttctaatttgacgttaataagggaagggaaatttagatcagggtgttgaaattcattgtttggtttcttattggattcgttccctcaatgacttcctcaaaaaaaaaaaaaatcacaattaattgtgaaaatatttgcaggagtcctgcaaagtgaatagttataatttcgaaatgagtcttggcttaaagatgatcgaaaactgtttatatgtttttgtttgcgtttatgtctaggtatttattacgtgacatttgtcctgtaattacttacacaattggtctttgtaatgggatggtgcagcttcatagtgaatcgaagcatataaagtggaggcctccacatttaggaataaagcaggattggcaagataaaataaagaacatccggagagggagaaaagaagttgaagatacagataaagttgggaatgcaagcatggccattccattttatgatgataatttgtacctcctgaatgtaaagaatgatctcgaggccaaggtaagaaaatctgaaacattttaactcaaggattcatcttccaactgtgtgcgtatgattgaagtctctaaaccaggaagttaagtgaggaggatgttagcaaaagctgataatgtatgctgactatgagcattttgttttcaaaatagtctgtcagattgtgtcatcatcctttgtctagtaagttagcaatgcttggtatgcttgtgataaattggtaatgcatgcttattaggtatctcatggtgtccctctttccagtaaaatctttgaagatacaattgagatttcttattgatttgcctatcaattatataaatgagtatcttattgatttgccaattcaattacacatatgggttgctttaatgatgtatgagtaaaaactttgattcaggcttcagaagcaattccctcagttgaaggcctaactgctgcaactaaagaccccattcctccatcatctgtgctaaagcaattggctatagctgttgagtaagttgtaattgttttgcatatatttttgcattctgttgtcccgttttcctgccgctttttgtgaactactgaaaggttctactcaatgatgttgcattctatttctctggttgcaaagttccccttctctatttggcacagcacatatttgtcaaatgcaagtttttatagttcaacaacataagagtcttgttctatcattcagaaagattgctgctcaacaatatatctagcctcttccttaaattttttttacctcttgactagggctggaagtaaagcaaagtcaatgaaagattttatagcttcatcaggaggatcttcacctgctagagagagggcaggcttaagtctcttggcagttaaggctttagtgctacgtgaaaaggaggacaaacttacatctgagtttactagcaataagaaagttgtgcaattaattaattctctgtttgatccaggtatgtgaattgtaggtggcttgctgataatgtaattatgttaaagaacgttttaatgcttgtcctcattttccttaacccattatctgttatgatctttcactttcgttgtaatatttgcaagatattcgcagaaggagatttccttagaagaaagatcgactcgaatctagaggaaagtgctatgacatctttgccaagagatattcatggtgcgcctcccgaaagccttgttgttaagctagctgaaatccttggaaactacaagactcttcgaaaaatggctcttttctggtgtggggttgttgctgaagtatgtttaacttcaaaagaacttatagttctgatatcataatcatacatcttattacttacccagaactctagatttaatttacattattgatcaatttttccattatatataaactattatctgaagtaactgtcagtttaagtgattatgatcttagtaatagagtgcatcatcatcattgatatcttcatcttagatcacgtgatttggccaaataaatatgcaagataacttgatgatgccatgttgataaatgtcaaattttgtttcctacttgttttgatttttaatagttattttaaaggtttgagaacctcattttgtttgagcagttgggtagtgaattttttttccttgttttatgctgcttcttttttcttttctttttttaaattctggtctattaaagtttgcatccaattttatccttcccttcccctttgcaaaataaaatttgtggaaaaggaagcaaattattcatatgctgtgttattggaaactttgaaggctttcaaaccaaaacaacagaatccctcgtgcactgtaaagttgtttgcctttcttttcctcctcaaatctgtttgtctataaaagaaaaaaaaaaatcatatacaaacttcttctggtttaggatctgtaacttgaacttaactagaatcactaatcctacttttccttaattaccagctgaagaagaatattttaaacttgattagttattttactgatacagctaaggaaactttggtttgaggaacaatacttaccaggagtcccccagaatgagattcctgatctgaagtcatgtcttctatatcaacaatttcaagtaattaattgctgcatctctcggaaaaggttccgtattattgccactgaatctttagactctatgatgatgcaagctaattcagacataaaagaatcgactgattgtagtgccagagctcctgcaagccctgttctatatgctagattgaatagtggggagcttgttcttcgaattggtgcagatcatcctgctggagatatgacattgttggaaactggcgagcctgtgtattctccaatcactcaggtttgataaatatattttttttctatataatcactatttaaaattactcttatacttgagaactttgggaccatttcatgtaggaaggacctttgcttacagaagatctaatcagggaaacagaggagtttgtgctgcggacagggaggtctgtatgctaactgagattcatccatgatgcaatctgttatcttaaatctaaatggactttctgttttccctatatatagcgtgtgaatcccaattgactctttcatataatgaacttctttattaaaataatcaaggtcatcttgcttcttgggctcttcattgcttgttagatgtgttcctgtatgccttttttaattgtttcgcatgatctaaacctatgattatgacctattgactcacatctagactatgaactcccacgaccagggtctgagtctggattctgaacctatgacctatgtctttggtctttttttttttttttactaatttctagaatttgcattgatgaactagttgatcaacaaacattcacagaatgctattttgtaatacatttatgatcatatctgtttcttatgtaaataatttgtaaatgctagctttctttaattacagatgtgcatcaattatgtaatagcttaaagttatcatcatttaggcattttcttattacaaagttacctttcatggtcagtgttggtgctgggtgctctcaactgctctcagatatgcaggctttcaaggtaaggagctcccttgaagggaacttttcttactgatattgtgaatgcttcttactatgttgaatgtgcctaatgttctgtctgagttagttttgtttgttatcatattttaggctgcaaatcctggatgtattttggaggattttgtaagatggcactctcctcctgattggacagataatgaagcaagtacagaggatagtgatgtttttgatagtggtgaggcattgtctgccagaggtcagctaagtcggcgaatgcaaaaagaaggtgtactttcagtcttttccatcatagattgatgtacttaaattctcctgcaaggctattttgtggtatttttctacgtaaatggaccatcaacatctgataaaattgtggatttactttgcttgaaacaattattcactgtaacttgtcatcgattgtagtaaacttttgctctatgcttataaattttaccatcatttatgtgttctttatggctttgatttccaaagaggttgtgatttggtaagttgtgaggaagatatgcatggaactactgaactacactatgtatgatgggaattgtttattgcagtctaatgtaggaacttttgtggcaaactgatcagttttgggtccagaatgtctaaatgtagagtttgaataattttgaatgttgaattaataatttcattgtcagtcaattgatatcagcatagatattcagatttcatattcctaattgccttgggcaaaccatggaattgaaagtgttgaaaccctattcctcaatctttgtagcatctatgtaagatatattacctaaattggatatcatatcacatctatggtaaagcatatggagataagtaaatcttgagtactgtcttactttattataagttataataagttataacacacaaaatctgcaagaaatacgggaactgtcgagcatttactttcttctgctttcatattattaaacatatctgatttgtaggtaatttatggcgtgaattgtgggaaacatccaaaccagtacctgctgttaagcaggcacctcagtttgatgaggatttggcagtgtaagttggtgatgaagattttttgcattaatttatatatttcaaccctaaagccatcccttgaatcccttgttgcattcatttatagggagggcatcctcaatgcatttgaagacatccatccatatgatctttttggacagctgtttgtttctttagtaagttctttattttatcttttatcacattgattaattttgttgtgtatagacagttgtcatttgtcattacataatggatctctgaagcattaatattataactcataagtgatgtatattaattaattttttatttgaaaattgtattttcttattttttggagtttggtggctgaatctaaagcagattgtagaatatatagtaatagacttgaatcatgaagatgaaggtaccaatcaagaactaaactattttcctgtaatgcatatcataggagaaaaatgtattgacatctaggctctaggcattttttgcgagtttagaattattagattggcatgccggttgggcatgtccacacatcccttaacaaaacctgcctagagctctagtataaggcaacttgttatctatgctggtggttgaaagaattttatacgaacatataaggcaattggtcgcctccacatgtccattcccaaaatctccctagagctctaatatacaatgcagcaacatgttacgtatgctggatttcaaaggactctaggtagcatagggttattctttaacacatgcacacttgcagtttcacatgctggatttcaggactgtaggcagcaacatgttatgtgtgtgtatggtagagaagggcatttgtagacaataaccttatggattatggatcatgaagggcatttttatctgttaagggcattcccattaatccataatcagtatacagttaaaaatgaaatgagcattgatagtagaccaggaagagtttaaaactgcataatatgctttttatgaaatttccaatagcattaagtgcataatttatccaaaatatctgcccttaactgataaaaatgcccttcattatccataatctgtatcaatgttaattatttaaaaaatatttataacacttgtaaagcatttgttagtctaaaagtaattcaatttgtgtgttttgagctggctccaaccaccaataaagcatttgttagtataaattcttcaacttttgtgttttaacctggctcaaactggagtattcaaatcttcaatgtaatgtctggttatgggtgtcctagatcaaaaattttggtcttgagaaagggaagtaaaaaaatggaaactgtgcaaacatacttatcatctgcctgtataaaggagatgaaatgtattacttttaatatttttctgttgaagaaggggggataaggcttttgttgttgtaaggatgggggatgttcttcctgttacataggactaatagtaatatcctgtgtcattcaagaaaattgatagccttcactggaggatgtgtactgtcaactaaatacttttttaaacatctttgtccttttttcctaataaaaaatgtaaaacaagcatttagtaaaactcctttccatacagacttcagtggcattgctgttaatttttgtgaagattaaagcatttgctcttaccaatttttattgaaaagaaatataattattcttaactttatattatttcagaatttttaaattacataaagtattttgttccaaaatgttgcttaattgataaatgatcctattatataatcctgtaattttgtaaagtttcttgataaaaactcaacctgttccttcatcttcgtataagttgactcgatttgattgatatgtattgatgcttataccatttctatacctttctaatcataacctttggttttaattatatagcttggtttaggatttgcaattgccgaacctatgctgtctagtaacagtgacttctcgaagttattctatgactgcaaggagtacataactaatgcttgtcaaaacaacaaattgaatgagaaagttgatggtctcgtccaggtgggtactcctagactaagtgacttatgaagttatatagcatctccctgaatccttgtgaagcctctctattgattaataccatgaaatacatggtcaatatgacatgtaatccagtggagaaatttattgctttatcctcgtatttgaacagtcattcactgtataaataaactcacaaagcagagtcctgaagaaaaaggaacattccaagactatcacaatgcgtgaaatttgtaacttttacctagcctaccttccagaactattcagtttgctgttttcttttttaaaaaaataaaaaaaacatacaagctcgttgtgcaagataaccctacttcttaagcatggggatgaaaaatcattcccctggaaatgtaaattgataataaaactcttggttgttgatttatatctgcaactaattgttaataacatcattcaatagagaatttaatgttcgtattcctgtgtaggtatatgaaacagtggagaaaatgttattgaatcccgaagaagctctaaaaatgattaagcagacagaggaagcaactacggttactggtgaaccaaggagcccatttaggaggcttagccttatctttggaggcaaagataaactattgaggaagtctgtctcaaaagatcagacaaacgacgaagaaaagtcaggtcggcaatcattctctagtttctttgacagcaagtcatctttgtttggaaagaagcctcccaagtctggatccccatctccttctgagaaatcttctatcgatgctggttgggcagttgtttagacaaatttcatcttccactgtgtttattgaggataagcaatgtttttgggttcctcctccccctgcagataactgtaaattttctctattcttttgccaaatacttagtggttgtattctgtagaaattttaattaatacttcattcttttttatttgagggaattgaaaatatagctttcgggcctttagtaaacattttatgtgttcactctgtgccaatacttgctatctgctcgggtgttggagatcctttgagatactcctcaagcttgcaactctgtaggaattcggtcatggttgacattaagttctcggtaaaaaataataattataataattaaaaaaaaaagacattaaaaaatatatcctaatagatatataatagtaatgcttgtaattataaaaaaaattatagtaatgcttgcttttgggtagtttagtctctatctaacagaatttgatctattaatataaaagtataacacagtgaatttatgtttgagaaattgtatttggacatgaatattgttggaaaaagttaggaagggaagagagataataggggggggggggggggggatattgtcataacaaatgtttcatgaatcatacaactctttacgttaatggtatgatcatgatgcacttgcaagtatttctatactaacattaacataaacataatcattgatggcaaatttctttagtacaaataacttgtattcttaaatatcaaacaataatcatattaatcctatgttaaataaagactgtactcttaagaggtttactaacatttttttgggggtagtagtaaccccagtaaatcaagggcaggaacaatttggtttcatgagattgtaatcgctaccaagtctagaatacctaatattaatgagcaaaagaaatctcacttggatgtttttattataatctaaatgcgaactaaagatacaaaagacacgtacagtagtgcttcaaccatcatgagctcagttctcacatttacgtaatcctgtttcttccttcgtgacctcccttgactatctattcatcttctattgcatttacatcgtcaaccttctgctcttcgtttgatggcttatcatatccgaaagagttggtaaggaaacctggcacgacaaaatttgctatgaagtatgccgatagaagcacagcactgcaatatataaagaaatctttagttaacttctagacttaaaagatcacactaactccattttggagtaaaaggttgttataagcctaagcctagtgtcaaattcaattataataatcatgaactatcaaataaataggaggaatgctcgcaatacatttttttttagtataccctcttttctaactcccaaatttattgaataatttttttagacatggtaatattagtaagtaacttttctccaagcaatgaaaaagggaaagaaagagattgaaccttattggaagcaaggtggacaagtcaccggattgggctggggcaacaaccagtaaatgtggaagtgccttggtacttagtggacttgctgaaggtaagtgctggccacgtggaggttggtgagtagtaagccaaaatagtttggtagtgtggctcatatgatgtaactgcggtttgagttttgcatgcaaaggaaaaggaagcagtgaaggttggaggtggaggcacctcatattgttcatgtgtgtcactgtgttgtgcttgggatattgggatatgcttatgtttgggagtgagtggatggatattttagtaaacatgccatcctttatgtagggtcccatttttgttcatatgttctagacaggtttatataagatctagtttatcattatttcgagcctattaaaaaatgaacgaataagcgtatagttatactgttatagtggcacgtagccaaaaaatcctaaatcattaagctggatgattatctaagatggatgattatttttgtatttttatttatttatgacttaagtttgaataaaccaatattatgttttttttttttaatattatgtgcatatttatgtttgaattatttaataatgaattttaatataattatagtaaatattttaattaaatttttattgattttattattattaaccttatatattatatataagtaaagtgtatatcacaaatgtaaatatgagtatataagtatcatgcaggtataaaaatgatgattaaaattgttacctggagcaatatgagaccggatatagatattatatctaaataagattatgtgtatagttttatgggaacctatctaaatcatagtaattgtcatcctagtttggtgtagttttgaaaatatttacatagcatgttgttttgtcacataggacgtcacattcttttacacaagttatatttataactgattttttacattgattatatatattttttgcattagttttaaatataactgattacatcaattatagatataatcatgaaaaagtatgacaaccaaacaggaggtgtcactcgctgtatctcctcttgctacaagataaaaaaaacaagtataaagtactactactcagaatacttccacaccctacgtaacaacaacaaaaacaactggtgctacgtaaattattttcaaacttgtattatgaattgtacaatcaacaatccacttatgctaaataattaccatataacacagttttttacgaccgagtccaaattgcactcaaacttaaaatctctcttttcttcctttctctcatttttgaatccgcgcaattccaattcacctcttcactccttcatcttttcgttctcgttctctgttcttccttttcagtttctagggcttattattattcgtttcgctttccgccaagtttctcgcgccctaacagtttttccccgaaacctcgcaccgacgcccgagaaactcgccaatcgatggccgcagaggaggtggctcctctcggcggcagcggcgattcctcgtcggcagcggcgagggctccgtcttcgttcgtgaagaaaggcgaccggaaaatgttcacggtggagctccgcccgggagagaccaccatagtgtcgtggaagaagctcatgaaggacgccagcaaggtcaacaatggatccgcttccgcaccggagcatcgcgctcccaatgcgaaccctgcgctcgtgtccagaatcgctccggtgagcctctttttaggttccaaattgttgtttcgagtaatagtgtgtttctgaaatttctgtttacgtacattgtgattcggtaagtaggttgcaatgtgtgagagggttactgtggtgtatggatgatattttgaattgtaatttgcaaaggtggtttttgactgagccgtgactgtgttttctttttttttttttccggactgaaataagggttaggaatgaggatagtgttattttttagaattacgttctgctaaaatgttaatgattgacctggcatgttgttaactgggaagtgcccgggtgtttcttgtcggtttttgacaacggtttgtgctccgtggcagtgatcttacgtgaaattatttgaaaaggttttgtcgtggcaaagttgaattgtttgtggaattacttgtatttgacttgaaatttattaggtttatttaggttgaatgcgttatgcttattgacttaatttggattcgtgttatgccacgatgtttcttgttggttttcaacaatggtttgtgctgcgtggcgctgctcttatggataatcatttaatagggttttgtcgtgccaaagtcgaaatgctcgcggaagtacttgtatttgacttcatatttattaggttgaatgcgttatgcctattgatataatgtctgtctgtttgtatttgtgttttggccagtgttatcaatggcagatggcagaagtctgaaattccgccataaacataccattgtgccttatggcgggcctttcttcacaaattgcctatggtggttggtaaaaaatctaccttgccattctgccttggctgctagttaacaacactggttttggcatggcataattgtgtcagcgctaaaacaacactggttttggcatggcataatcgagccttgaattgactatatctggttttatgctacagtataattatttgtcatctggataccagcaggaattagcatattgtctttcgaaatagtatgtgactatgtgattttgttttcactattttaataacacttgtcacttttagggacaacctaaggagattgaagaacaggatgcacctcagacaaaccgtttcagtgctgtaatagagaagattgaacgcctttacatggtatgggtgtgttgcttcctgagattgttactcaatggtctgtacaaaaatgaattggtttctactataaattcatatcatagatgcatatgtaagtattttattaaatttttcgagctattttccatgttgggaataatgggactctgaatcatttttagggtaaggacagcagtgatgaggaggatgcacctgatgttcctgatgatcagtatgatacagaagactctttcattgatgatgctgaattggttggtatctttttataccatattaatttgtcatgactcatgacattatgaccatttgacctttgattaatgatgacaggaattgtattgtcctatattgttgccgtttcaccttgcatattttttatgtagttctactgttctttctgcagaatgagtattttgaggttgataattctgcaatcaaacatgatggattctttgtaaatagggggaaattggaacgcatgtaagtgttttttgtttgaatattttcggagtatggcaatttcttatctttgtgagggctagcctttgttcaacactaaggctgctgccttttggcctggaggtcaccagtttgaatcctggaaatagcctcttcacttgtggggccaagtctgtgtgcatcttccttcctcaaatctcatttggtgggagtaggggtgttcaaaaactggtcagggaaaaaaaccaaaccaaaccgattccgaatttgaaaccaaattggtttaaatggtttcaattttgaaaccaaatttgagaagtgatttttaaaacgagttcagaaccaaattggttttaaaaaactggttcagaaccgaactagtttcaaaaactagttccaggactgaattggttttgaaccaattgtaaactggctttaaaaccagcttggttcgaaccaaacttatttgaaaaaaaaaacaattgagttttatttaaccaaactggtttggttaaaaaaccagtgcagttcggaaacagtttggttcgaaccagtttatatgcccacccctaggtgggagcctcatgcactaggttgtgctctttatgtctatctcttttctttgtaaaccacttaattttggaagcctttgcactttcctctttttcagttgatggatataatactacattttcagtggaatatatatgcttgtgttgttatatgaacatgtaatgagatcatgtatcattcactgtcatagtttgagtagtgacaaagactaatattagtgttcctgtaacttgttaattttatgcttgaaatgttggtcttgtttcatttctgattgttggtctattgcactattgttctaaactatgaatttacttttctgtacctatcactttgtttgacttaaacttttcatcagttatagcttaaggcctttattagtatttgatgttgtgaagttctttcttcctgttcctgataacattttttcttggtttatgattgaatattctttcatgtgacacctgtttacacatgttgtgccaacattttgaatctattaaattgtagtttggagtagataattttttcacacaaattcctgattttattgattttctgtttcttctttctatattaccagaaatgaacctccagtattgcctatccagcaagcaaagaaaagacgccgaaaagatataccgaagaatcctggagaaaatattgatagtcatgtatcaaataaacatgtaaaagttggcaagactgctgctggaaagactgcaccattacctgtgaaaaatacaattagttcctcccataatttgggtgtacccggtgaacattatgaagacatgaaatttcggagtgagttagatgtgtctggaattagtttgaacaggaaaactgctgacactagaccaacatcagatcctcctgtttgttcgaaagtatcaaatgatgatgctcctgctgctgcagaaggtgctgaaaaacagaagaccaaagtacttcaatctaagaacacatgtgataaatataaagatggaagtggcttgcttgatacttctcatcagaagtaccatgaaaaaagtggatctgcacattccaaatcccatcctggaaaaacctcaaatagtgttgacaatctagaaaagactggtcggtcgaaagataaaaatggcatcaatgaactgccagatcttaacttgtccgtgggaaaatctgctatacaaacaccagtaagtttacgtagctgcttttctgttgtctttattttatttctatgttctatacggtccctttttagtacttaccctctttgtttcccccctccttctttcacccttcttttattttatcttatttttcttttcgtttgtcttatttcccctttatcttctcctcccccttccttttttttttttttaacttcctcgtatctatcattgggttcatctaccaccgaccccaattaacttgggttaaaggtgctgttgatgttgaagaaggctcgctgctgcacttatatcaattcattcttgctattcagctttaaagtaaaggattctccattctaaaccatagctaccatatgaagcatggaactgcccaccaaataagcacttctagtagatcaacttccattgtgattaacaggttacattgaagcatgacatgcagtgtgccaggaaaagtgtgtgataagaaccttgggaaaatcatattacaaaaactagccgttgtagttagagagctcaaagtcttataaacacaaaaccagaatcccatacttccaacatgagactcaagtctcataccttgcaattggatcctatcatctcaccatgcttggcaaccccgatgcccattcaggttggctatgcactagttctttgactagtcccaagcaaatactgcaatgttgtcatcaccatccacatcgctcgtttgcaattaagagagacgttgaaaagctttaatgcgaattgataagaatcctaagagaaatacaccaccaaagctaactattgtagtgggagagccaagatttcttactttgtttttgggtgggagtgggtgttgtatctgcaccctaaattgggctactctccaacccaagcagtcttacaattgaggaggttttcttttgcccattatttttatttttactataaattattctataataaaaactaaagtacaccaaggtttcttactttgtttttgggtgggagtgggtgttgtatttgcaccctaaaccgggctactctccaacccaagcagtcctacaattgtggaggttttcttttgccttttatttttatttttataattaatcatatattatactataaattattctataataaaaactaaaaaactaacataccccagtgcccaaaggctccttgctatgtgaaggtaggggagagggtcattatacgcaatcttattcttgtatatggaaagaggttgttttcgaattcgaatccatgaccaactggtcaccaatgcacaactttaccattgtgctagggctcaccttgataaagtattctataatatttaaaaactatagaaaaattaatgcataatatatcatataatagagacaaatgtataatgcatattatatattactaccttcatccctaaatataagacttttttaactaattcacatctttgaagaaaatttgttaatttggttagcaacattaaatttgtttagcaatttgtattattttttcaaaattacccttaaaattatgttaactcatcatctctctttccacttaattactttttacctaattaattaatgtgtcctagtcttctccaatccttgtaagagaaagaataaatttatcttattaatttattgcatttattgtaaagcaattaagggtattgtggtataaaaaatgtaaaagacaacttgaaaaatgtctcatttaggggcagaggtagtgtatatattatagattattataataataataatataaatatatataaataaaatatatgtaaataaaaatgtaataattaaatattataatataatagaaagaataaaaaatattttatatatacatatattaaaaatagcagtcatcccactattgtttttgggagtgatcccgtgactccatccactatggactattattgtgggattaagtctcataccttgtgatcggatcttaacagtgtagcatattgcttcaatttactccatttacttgttaccttggctgttgcgggtcatcctttttcattcaaaataatttctatttaagggatattggtatacatggttggtttttctttaagattttggcaaactatactatccatttagcgtgcacttggtgagataacatgttcttattactatgacttctgacaacaaaagttgtgaaagtggactgttatgtgtttaacatatactgtgttgatcaagatcttgtttgaagcttatgcagaaatctgaaaatgtgctcaagaaagatggttctattgctaggcctaaaacgacaacacttgagaaagctattcgagagttggagaagatagttgcagaatgtaagtttggaaaatgttttgaagctcacattataggcaatgtgggaagtttgttgctaatgctaagtttttattttaaatattattacagcaaggccaccaactatggaaaaccaggaggctgattccacacctcagggtgtcaaacggagattgcctagagaaataaagctgaaacttgctaaagttgctagattagcggtattggcaaattttgttttcttgttatgctaaatgcttctagatatatgcacaattttgtattatttttttctcaaaattcttctcagtttgaacattgtattatcatattgtaatattgactatatgtttttgtcgcagcaggcaagccaagggaaagtatcaaaggagttacttaaccgtcttatgagtattcttgggcatctgattcagctcagaacactaaaggtatttaagcttgataaacataacagataatcctttagtatgtatttttcagtttccggttataatccccaatgcttagcaggagctatatagcactaggctgcctttttgttgttgaacccaaaagttatacaaaatttaaaaattgaaactaattattgcatctctcaaatcacctatctttctgtccagtccactatcctgaacttttgtacaatttgtagtttgtttagtgattaggttatgatttaacaataccatattctaggctttgaatacattcgtgacctaatcacattgtggtttgactgagtgacttacttttgtgaccttcttaaagattgattctcttttcttccttttttttttcctttaccctttttatggtgatttcaatgtcatatgtctgagggctcaagctagggtggacaatcctcataggtctcccacggtggtagatgattttttcaccattagatttattacttctaaaataaagcattcaattttttcttcttttttcccaatctgtccctgcccccttctctctcactccatcttgttgcttcaccgctgctgcgatgacacaagccactgtcgacatctctaccataaaccgccctaggatggcagaatgtctactgcaaccaccataaactaccgttacaaaccacgaccgaaaacaattacctaaaaccaaaacaaatcacaacccaccataaacaataaagaaaaccagtgtcaatggccttcgccaagtccaccagcactgactcaggcttccccacgcacactaccagattgaagctgtgtgcctagagtctctggcgcaggtcagagacggactcaaccagggctgtgtggcagcgttggaggcagactcagcgtagttagcgtggttgaagcagtagacggggaggaaggtagggcttgttgttggtagtaatgaggcagttgttgcgaaaccagacgaggacagcgcaacagcattggaggcttcgcattgcggtggtggtgggagcctagggagagatggtcatggagaggagagcgataacagggcagaggggatcttgggttggatgaagggggaactgatgggaaaagtgaggctactgcaaatggagattttgcagtggaaaatggcgagggtgtcaagggcaaaccaggaaagataattatcaattataaaaaagaaaaagaaaaatgtagacctttgatttaaaagataataaatccaacggtgaaaaaatcatctcccaccgtgggagacctatgagggttgcccaccctagcctaagccatgtctgagtctatgaaattcttatttttaagtgattgtttgcccacttccattttaataaaaactggttttccttcaggaatgaaggacctgtttgctttagactttggtgactccacagtgacagatggccttcctgaattgattctaagtgcaagatcagtatagattattttgggagaaatactagcttatttcctaaaaactctctcatgaagcaggcaaaaataagtaatgatccttcaaataaattgaaccaaacatgcactaattgtaattgatcaagtttctcaagttcacatttttatatagaaatagatttaggaaaagtaaagctttgttgccttggtgagtagaacttgcgtatgttctatacccacgctctttgtttataatcatggattagggtagaaagaatcaatcatggatacgaaaaatcaatctaaatccctaatttgtggtaatggatagactctttacataataaatgtttttcttctaacactaacagtagaagctggtgatttcccaaacaaaaacaactctattcctatcactacaaaattaattttatgtcaagtggactctaattatatttcagaagttattcttcagtataaaaatcaaacaaactcaaccatgaactccgttcttttacaatccaattcaaaaaaaggtaatttcccacctattatttattgtttatgctgtcaatgaatttttgcaactatttttctctttgtttataatttatatttatatttatcgttacataggtaattttaattaccatttatgcttgaattgaaacttatcttctcattcaatgtcttcctgctacagagtaacttaaaaaatatgatcagtatgggtttgtctgcgaagcaggagaaagatgttaggtttcaacagataaagaaagaatttattgagatgattaagatgcaggccccaactatggaatccaaggtttattatagttacattttctatttcattccatatcaaaatgaaatattcagtactttttgcttgttttagctggttcatgtagcttctttttgattccccctactatagttataattcatagtatacttattttcactctttcttatcgatgcttctttatatcgattcaatgcaattttgagttttatatgcaaatccttattttggcatgtttacttatggataacttttacctggaaagggatttccttagttgtagttacgaaactcaatctagttttgttgatatatttcctgatgcttgcgttgtatcttgattgtaattttacaggaaataactgtaatttcgattgattaatgaagattttggttatttaatatgggatgctttttcatgttttcctgcatttcagctacagcagcaagctggagcatctggggaacaagaattacgtcctgatgggaaaccaataactaaaaggaattttagtgtggacactgcattggaagacaagatttgtgatctctatgacctttttgttgatgtacagaagtttgaaccttaagtatttattttatagatcctgtgcggtttgaagtttgttcttaatgaatcttatttgcaattgttccaggggttagatgaaaatgctggtccgcaaatcagaaagttgtatgctgaggtggttcaaattttctatgccttcctctcgatatttgtttttaaatttcagactttcagtaccttcttcctttgggtttgattttattttcttttctatatctcctagtttaagttaaaattactaaattagtactatctaaaatctcttctatcatttcttttcaataccatagttatcaatagtgctcaattgcggtgcaattgcagaggtgcagagcagaatgtcattcggatgtgacaaaactgccataggtggggtgtttttgcttcactgctgttgtagcctcttttgctgagaagccggtgaaaatccttttctgcctttaaagtaaaaagcatttttgagggttctttaagtgtaaaattgacttccctccattttcagaaaacgtatataaccctaaccctcaattttcctacgtttcctcttcttttctgtggttgataacccctttcttctctctactgtctttgttctgctgcacaaccaaacctgtggagcctcccatctatggcgatttttacagcaacacccatctctgttctcatctctattctctgacttaatagatatttttcttccttcatttttgcttttatttaattgtatgtttttctgaagacctatgattttttattgatagttgggaataagccaagaaatattaattaaatatttgtttagcatatgtaattatgtacataatgatggatcatatatctgtataataatctttaaaatagcaatcatgctattcactatccagctataacttgagatttggctgctaagcattgctatctaggattgataactattttgttgaatacattgaaaagaaaaggattctcaattattttttcacacatgtaaatttttttattgcaattttttccttcttttgagtcctcatgaatgattctcttatttcagaagcttgtgttactttttgcgtgtgactatgtgtattgcatatacattgcagtttctggtgtctaaattaatatgtttgctttttctaaacatattttttctcactttcaagtgcattgtcctcttcagcttgcggaattatggccaaatggttacatggacaaccatgggatcaagcgtgcaatttgcaggtcaaaagagaggcgcagagcactgtacagcagacataaggtatgcctttgcaataaataatagcatataacgatggtgtagtaatattctaaaatctctattaaaacaaagaagcctttacagtttacatgttctcagttttgaaaatttaagaggagtttcacgatagtaatttgtggtctagcctgcaaatacctatgtggcatgactaagttggaaactaaacaggagtcttttaatttttctcttcatccttaccttaattatggctttaaatagataactatgaattatgaatcagaagaattggagaatttgctttctgttttttgtatgtacagatgacaatcaggattttatatttgtgagaaggcttaaatatgtttttgattttatatatccctatttcaatttactacctaaatatatatttttatttattttactatctgacattttcaaacttttgcttttggtacctgtcgttagtctcggtcccttgagtgatgatatggcaaattaacagagtatcacatcattgattaagtggtgatatgataggctaacaaagtgtcacgttatcacctaatggacttagattaaaggtaggtaccaaaagtaaaattttgaaactatcaggtagtaaaataataataaaaatatttaggtagtaaactgaaaaagaagtatattacaggtatgaaaaacatatttaagtcttatgagaataatgatttttgttttctatctcactggttacttattgttaggatcaggagaaaatgaagaggaaaaacttattggcacctcgaccaaaggagaatgttcaatttgatcctagtccaattacttcccaacagcccatgcgagcaagattagctgcagactctagttgtcatactcatgcttcagtaaacaatacagtttctaatgcagtcaccgctgcaccggttcacaatccttcggtgaatggtcctaaacaagaaaaagcaaagggaagttcaagtggttctttggatcacgtcaagggtgcagacggtgttttaataaagaaggtaaagagaaagccggaacagggtttggaaggaactcattttcgccctgagaagatggcagcttctctgcaaggagaagaaaagcgaagatccctaaagcagtctgcaggtgttccccccaaatcaaaccttcagccaacttctttacctggactggagcagtcaagctaacatgaaatcaactaggatgtttactcaacagaatgtattttacagttttttacccctttttttttttggctcaattctcctctcccaaatcaattcatatactacttattattacgatttttgtatataggtagatttgttggttgttaagtcatcgcatatttcttgagaaatgaagtcataggcacgtaggttcagggtccaagagactatacccaaagcacttatctcacgaacaaacatgtccccccaaagtcaatgagtatttctttctttctactattttcggtcaaaagaggctatcgctccttggctcactgttgatttgcataattggtcatcgcgtttggttgaaaagctagtggtgcgaagttatcgtgcattggattatgacagaacatctctaagtcagaatccgggctagaagtgacgcgtgagctcgttgtccgtttgccgaccagtagtagggggcctggaccccccaaaggcacgtattgttggtgagcttcgtgggatggattagtcctacgagatgtcttgaagctcaattctcatcgagcggcaaaaatttctttcttgactatattctaatgaaattctataattactttattttttattataaatagaaacttgttccaaatattaacaatattattggcatatcgagtctggccttaccatacttctcgtagatagtggtgcttctgcagcaagcttgaaattttgatgaagcaaacacaattaatcttaaattattagtgtttcataaaaaaatgtcatcaaattagtgatccaaatatctaaaatatcaccatggtcattatagaggattaaagaagtgaaaaaggaaatctaaagtttaatttagtaacagattaaatctttaaaagaaattttaaaatattaacatttttgtttttatggatgattgaagtggtgataatataatttggaagggactaatttaatgactaatgactaattaaatatttggggattaatttagttacaattttttttgggtaactaaatttgtagaaaaaggtttttggaaaatataattcagttaagatttttgaaagattataattattatagatattataatgatgatgtctatttgtcttcgtattttttagactagtatattctttaaataacattatacactatcattattatattttaaatgcatatgaaagaactaacccattaattacatataaaattcgatgacggtgcatttttatttaatctccatcttttatattttattttattatctaaaaaatatagagatactaagtgcctcttttttactctttaggtgtattggattaagattttcaaagattattctaatataaaaatcttgtaaaatttaaaagattaggtaggaatgtcatcatttaatagattttttaaaagacttgtaataaaaaaattgtagtttgaatttttatttatataataagaatttaaaataattttttatctaaaaaaatgactttatatatttataaaatttaaaaggattacatgagtttttagaaaatatttaaaattagaaaaatcaataaaaaaaatactaagaaatgataaattttgaagaaatgtaaaatccatacttttttcaaataaattaaatttaaattagataaatacattgtaaagtaattatttgaaataataatatattactctgacaatgttatccaactttgaggcactttcatatgctaaattgtgatttaatcttaatttatgccttctctttgtggataaattctttaaaaattgtttttttcatggtaatcatttttcttttttaaaattcattgattctagtttcaagtcttcttatactagtcctttatgtattaacatattttcctacttgctctttggtttgaacaataggttcaaaattatgatcgtcattatttgttaatgttgaacatgaagatttttctattggttcaattggaaactcattagaacaataacattctttgtgaacaaagttacaaatgtatatatattgtcttcaacgaagagagagaatgaagtgtgaagaaagaaagaaaagtctagcaactgataagaaaaataagaaataaagtctacaattttttcaagagttgaatgagattgtttgatgaatgcagtatttatatatctactaaaaaatcatatgaaattcattctaaaaattaatatatcaaaatttgtatatttttgaatatcaaaagacttttttgatttttggtaattttaaaataaaataagtagttttgtgatttttggtgtgtttgtttaaactatttttttaatatgcaagtcgttcccttttaaaaaatcacattttttaaaagcacttcttaatttaaaacaaatgagccttacattaatcttatcaaaattaattgtgattaactttaaggtttaattgtaatttttattctcaacttttatattttggcaaattttgcctctaataatattttggtgcattttactctcaactttttaaatatttcaattttgcttccgttccaagtttcactaacatttttttggccatttttaactatcactgaacacacctatttaaaataagtatctttaacatagtaaattagtaatgactaaaaaacaccattttattattattaagtccaccatatatcaaagaaagacaaaaaatcagagtctaatatatataacttattggtgctaaaagactaccttacaatgatatactaaataaaaaggtcgggcaaaagaagtttcaagtcgaatatcagttgacataagtgataatggtttgcgttattaaccaagtgatctaggtttgaatcttggttggtccttaggtatagaataaatattgttgggaggagaatattcatcttgtgtgcgctcatggttcccgataaaagttagtctttgttttcgatgagaactaattcgtaccaacactatggtcaacaacaaaaaaaagttgaacaacaattactatttattggcacaaatgatacctaccaaatcctaagaacaatagggatggagacaacggtgaggccactatggatatccaaggttactttgtgactctacatagtgccaaaactattacagggaacgatcatggatagatgagaaactggttttgcctggcaacaaattgattttcaggtgatgaaacgaatatctagacttaattttcgatcaaattcttctagcatagctctcacccataattcatttcatctatatttttgtgttctactccttaagcaatgttatagatatataacttcaattttttctaaagtgagttggagcctttattcctccaaaaatttatcaaatgatctcataagatgaatagcttctagcttcttccattttctccaatcgtttgctctctattgagaagttagatgttcaaactgtgacatcctagatgctaacaagggtgaggaatgatcatcgatgcacaagagatgtgtcacaaacaaggagcgactcctagcaagtagggatgttcatcaaccgatccaaaccgatgcaaaccgcggtgaccgaaccgaaaaatcgataaccgaaataaccgaaaatcgaaaaatcgaaaaccgaaaaaaatcgaaaattttcactggattggatcggttttcggtttggttggtgaaaatcgatccaattataaaccttaccttaccctttacctacttgggcttattcctcatcatagcccaaaaaccaaaaatccaatacattgctccttattttgtccaatgaacatgtttgtccaatgaaaattagaaaatggtgtttgtttttgtccaataaatttgtttgtttttgctagatactccttagtttgataaaaataagtctcataagttttattttagactttttaaaaaatcaaaaaccaatccaatccaaaccgaaaaaaattggatcggatttgaaaaaaatttcaaaccgaatggatgatcaaatgacaaaatcgaagggattggatcagatgattttttgcttcaaaaccgatccaatccagacctcgaacacccctactagcaggcttccagcgggagggatatatgaatgaattacccggatgagagatattcggaagttgtgtaggtctgagactgtccaattaaggatgacttaaagaaattaattactattacctatacaaataaaatacatatatttttaatagattataacttaaaaatttcataattaagtgtgtctgatttataataattataaaataaatgataaagacattctttgatgataagtttattgattattagttttttggttttggatatattcgaaacaatccgctaatggatttttcaatccaagaagtcagatgcattagttttatttttaaaattatgattaaaatgaaatttaactttgtataactcatttttttatctacataagtactctgacaaataactagaacattccatgattgattggaaatataaaaaaatacaaagtttaaataaaaaaatgaagaaaggtttgatttatttaattagcaacagattattttatcagtaaaaagatatgaattaaaatacaaagattcagacgttggaaactactaatttcgaaaatatcataaattgatttgattgataaaaatgcattttaacaattaaattagagaaatctaaatattaatcaagaaaatataatataatattatttttttccaaaggtgaggaagaaaaattataatatttaaaatttgaaacacgcgatatttgacctggaaaatagtattttcaagacagtaacgaaaagatagggaaattagacataagaaattcaattatagagagcgaatataatactattgttcttcagaactctgtaggcggcgatctcctttgtctccgttccatcgtcaaccctacccttccatctgcgtttggcgttcaggttcgtctctgtttcccgagaaattagcttttctattttttttcgcagcgcaatttcgcaaatctgcgtctagaacggttgaatcgggaaaatacatcgcaataggtgtattgttgttgttgttaatattcttgtttagaaacgtaatgaatccgagacgttatctatgcaagcattttccgttcagtctgattttttttttttttatggttttgttggttgaatttgttatttgtcaaattaggtttgaagtccgaaggacgaagaagagatttctgactgcgtaatcatgtttggtgtcgtaaggcgaagggttgcttctggcagcccgtttccttgggtgagagctcggtcttttctaaacgcttatgaatcatgatgaattttcaatttaaatgtgtttgtgttaatccacagattgaagtttaagtttaagtcatgtttgatgcctgttctgcatttgtttcagttgcttggtcagtcagttcagaagattcggtctggcccatcagtttctgctagagcttcttccattgcggaaaaagaggtgtttgtctttattttctgcatatactctgttgatatgttttttcttcttataacttataagaaactgatggttatcggttctcaactgttaacactgatggttactcaaatattatgtttaggagatagggtgatgttgttagtatatgcaaataaggtagtgctcacttttagtccttcaaaataaaattgttcgttttgtcgctcatttgtggaaatgtcacatgtggttcctatttccataaacaagggaccgccaaaatgagactattttattttgagtgtgtaagagcgaattatatttatagaaactaaaacatattaaccctttgggatatgtgttaaatgtactacctggacaaatagaatgtgaaaatattgggtcgagtccttggtggcaaattcctaatcttgcttaattgttgtaattgtttttgataaaatttctttcataacctgaaaagactctgatgctcatctggtttgtccttggtggcaagttcctaatctggtgcatttcattttctaactttttcttttttgacgttgaaactatttcctacatctatggcttctggatttttcaacagtttgaaaagtaattggtcatcgtcatttctgtttatgaccttttttctcttgtgtgttgtttgaatcttgttcaaaatgtggtcggattaacatatggttgttcaaattcaatgtgatagagtaagtttactttttttttttttactcaattatatcagcaaagtatggcaattgctaatggatatatagactgcctgctttgtgtacagactacacaatgtaaatttcttgggacaatcttattatctatttttattttttttgcactctcttctctaaaaaatatttcttgtaagtaataattagcacacatgattttttcacttatcgttctgtgatactgtatcctacatacaggtgatgacctcattatttttttcccactgttacttatggtctttgttatagagggttagattttggaatttatatgttatttgtatcctttgaagtttcttacaactattgttttattgtgtttaacagattgcatttccttcaggcggatgtggatttgtccaaaacttcagtcatataacacttggtaattttgggtacattttattttaaatattttagatgctgttgacttaattacttgaatgatttatgcaattttgcaatttaaatcataaattttgttgttgttgcaggaagctggattaattcaaagcctatgaggttcgtggcaccatttaatagtcctaagcattgctttaggattctctttaatttatgtaaaaaagttcggctcagaaataggatagattgtaagggtgctcttggtttagaattttggtgtctttaatcttttccttgaaaataacaaatacaattgaaaacatgttttagttatacaaaagcttaaaattagctggagtctggaaacttaagatcaagctctccaacaaggctttcaaatgttagaattaggtttggaagcttcaacaacaatcttattgtttaaatatagttagaagttagaacaaaaataaagtaatgcagaaatgtttactgacttcaggaggaaaaaatggattggtaataaaaaatatagtaagaaaatgagaatatgaaattgttttcaaatccttagccaatcaaatgattcgaatccttaattttagtcatgacaaatttggttgtactaatatttccttgcctttttcagtattatttagctgcaaattttactctttttcttgtatgttgctaatgctagcttatgcacataaacattcctatcatgtggtcatcttcttagaaaaaaccaagtatttaaatttattggtgttattaagggaattgaatgtcccgagatgcaagtttgaaatgatttttattttccaagaaaaaaagaagtagacactaatgcattttctgtattcttctatagttttatttgtactcgatcaaattctgttgatgatattttcacatggagtttcgggggtgcaataatgacaaatcattaattaataatcggatggaatggaaaatagttacaatttcttatccacagtgatgctgttctgatattgccttattgctttgtagggtggtcattcatccagaggcaaccgttcgaacaagggggcgtctattttcttcagaaagtggtgagctattgatgtgacactattgccttattgccctattgatgcgtctattaatgtaccattcatttttctggcatttacattgtttaattaacctgttttattttggcttttgattgttaatatttttaagattgctaatgtaatttatatttgtgataaaggagatacggttgatgttgtggttcctcctttggctgaatctatctctgatggaactctggcacaatttttgaagagtatgttatcctgtatatttttttcgtcatctatttgaattgttaatttatgaattattggtgactgattgtcgtgttttgatttgttatatgggagcaggacctggtgacagggttaatgctgacgagccaattgctcaaattgaaacagataaggtgctatgtcaaagcaacatgcaaatttttgtgaaggattttgatggttataaacatttaattttcttgatttccaaatagttaatgctgtattttgtttttattccttaattaggtgacaattgatgtttcaagtcctgagtcaggcgtgattctaaaggtacagtttcatagatttaaattgtttttactctcctcaaccaccctgaaatgaagaaattgttactctcttctttcttgtttctcttttattaaatttggcttgtgtgatctatttaatgatttgcagcttctagccaacgaaggtgatactgttgagccaggtaacaagatagcaatcatttcaaggtctgctgatgcaactcacgttgccccatctgagactacatctgagaaagctgctcctcagccaacccaaaaggttagcgaggagaagaaagctcccaaagttgaaactgctcctgctaaagagaagcccaaagcatctcctgccattctgaagtctcccaccgagccccagcttcctcctaaagaaagagaaagacgagtgaggcattttgatttttggtcctacctgaattatatttagcaaccatgaaagttgttttaatgtcttccattgttatcaaaggttcctatgacaaggcttcggaaacgagttgctacacggctgaaagattcccaaaacacgtttgctatgctgacaaccttcaatgaagttgatatgtaagttttgttgattgtcaaattgtagcatatgattttaatattgctcaaactgtttttttaccccatgtgtgtataaaaatgcactattacattatttggtgatggttctaatggaacacagttgtctaaatttaatgaagtcctcaacccatggtctgtcctctacagctatgatacattggagagtcattacatttctgttaatttttcttggtctttgtcagatcaacaaacctgttacgtattctctcaatttctacttgtcttagttggtgtacatttcttatttttttgtttagaagaagatagggaaacgattgacttatatgtattggggttgaagcatttttcccttcttgcatttatgcttagctttttgctcatctatgtaattttacattatgccactgagtagtttctatgcgataacacccagtatcgtgggatattctgttgattaaatgagggggagggggagggggagggggaggaatgtaattcagttattatgtagacttaatcaaaaagagtgattccatgtgtttaattgtcaattcttgatgttgtgtttcctgtcatatccttatatagtggattactattatcattctcttccttattgctctgctcttaatgataggactaatttgatgaagctccgttctgattataaggatgcttttgttgaaaagcatggagtcaaattggggcttatgtctggctttgtcaaagtatgttttctaattactgaagtatagactagctgggttttccctttttgatttcctcatacactttttatggtctccatgttaggctgctgttaatgcactccaacatcagccgattgtcaatgctgtcattgatggtgatgatattatatacagagattatatagatatcagcatagctgttggtactccgaaggtttttatcagccacctttatcttttctcatttactttgtttacgttgagaaatcaatcaatcattatactgtcttgatgaaacttagccatctctgtgatcaacttatgtcaactattgtcatggctatggagctaatttactagtgatctagtatatagtctaattttgcaattttttgcatggccatgaaaattatcaacatgcatgttgtatttgaacaaatattgaccctcaatcgccattccagggccttgttgtaccggttatccgcaatgctgataccatgaactttgctgatatagaaaagcagattaatgcttttgcaaagaaggcaaatgatggaactttatcaattgatgagatggctggaggcactcttacaatatccaatggtggtgtttatggaagccttttgagcacccctattatcaaccctcctcaggtttggaagttatactaagataaatatcattatatttttttctttaatttgtaagacattcttcgatatgttttgaagttgtttctgtatgtatatgattgtacataatcattgattgctttccttctatcttggtaggttcaggcattgtttatcatttaatgaaatggtcattatttttgtcaccagtaactcttcaatatgcaatttgttttcacagaaggatcagtttaattctaaatatcaagccaaatattctgatctattcccttactagttaaatatgtataattgttttttttaatgatgctaattattgtgaacaataaaatatgaaattaattatttagaaagaaaactcatgcagttattgtttttggcagtctgcaatcttgggtatgcattccatagtgagccgtccaactgttgttggaggaaatattgtcccaagaccattgatgtacgtggctctaacatatgaccacagaattattgatggaagagaggcagtgttctttctgcgacgcatcaaagatattgtggaggatcctcgcaggcttctgctcgacatatgaactgaacctctaattttaaatggagtaaattaaacctcaaaattcaaataccataatgggttctcttttgtttaggttttgaattgcggctgcccgtaatttataatctgtaatgagcaaactctttaggatcatatcccaatttcccttcgatattaattcagcatggttgtgttttttctacccactattcctctcatttaatatgaagagggtcacagtttttggctccaaaattgtatgaaacgactatgaactatactgtagggattgcccctggagtaataagacgatttcttttcatggcactttattcttacactattttttagcggatgaaaattttcagatacatatcatcatagggtccaagaaagcggggatgatataatattggcaataatacactgccgtaattaaattccttctagaattcccgggtttttatatacgccacatcgaatgtagcctctataagttaataattctcatgtgaaaaaatgcttttatttatttatttttgttaattaagagcttaatccaaaaaaatatgcatagaattcaacatgcaaattagtttgtttgctgggaacatgaaaaatggttgacgagagatgcatggtgataaatatatgaagagtggtttcattctatcattctaaataataattgtatatcaattattgttagttgtcttctcaacattgccaagcttcaacatacgtcctttgtattgctcaggtactaaaactagtatatattgcatataatatgcttgtgtaaattgcaaaaaaatcagggtaaaaagtcttggatgatcaaggcaaggttttatattctcaagaaaaagtgaaaagagaggtaattgataattgaattgggaaggtagagatcactcaagcttgcaggccatattcagttttattctcatcaaacgtgttgggactgattcctcttgttcaaagttattctgtgcctgctgcggtcttggaacggaaagcatggcataattcttcgcctaacctcacaagtctccaaaagcagcttataaacacatggtactcagtcaaaataaagagtttatttttcatccaggctctcatcttacctccaccacagaaatcaacatttaagaagttctacaaagatgatacaacttttattcatacttttgatgatccaaatagcattcatcttaatattatcttttgcaaatccaatacgaaaattggtgatcatggggctagacctcttgaagcaggggaggggcaccttagtcacaaaaactgtagcagcaactatgtgtgtggtcttgagctccaccgtgtatactataatcaaaatccaaaagcgttccaaggatgctggcatagttaatccaactgatgaggtgttgatggcacatcgtctcttggaagcagctttcttgggtaattactcaaaaaatacattccttgtttgcttacaaagttacaatatctgcaggactattttgttacacacaacagaaagcgaacttacttaccccacgtgtactagtgtaagcatctgtttagtttcataacttctctgaaaggtgacaagaaggttgaaatcatcaaaatttcactatgaagtttacaaataaatgtttctctaggcttgactcgtggcaaacagaattgagaaatgcccaccaataaaattctctattaattatttgaagaggctatatttatagttttgaatatgtgctaactaaaagtagctttagcatattttgacattttttttatcggcaaatgtcagttactaataattaattttttattagttaagagattcaaacctacgatctcttccccttttccttttcctttcaccaccaaaccaaccttataatccggttttgttagcatattttgccattactcatgcttggacaatgcatttaattgagaaatgaattctatcaagtatcaatgaatatagatttctctttagcacttctgatatactattatgtgcagaacatgagttttaaatcctataaaatggtaattattgggcaggattctctctgttccttggattggtgatcgacagacaacattactatattagagagattaatttactgaggaagaacctggaaacagctaaaaaaacgaaatcacaaagactccttaaagagaatagtggaaactgagaagtcccaaggtcaagctcaagtaagcggaaagtaagacacagttagcacataaccaatgtcctgaaaaggaaaaaatctgaaggaggagaactgtcttaaaacatgaagatgttgcatgtcctttgtatgaatgtgcaacgctcagaattgaattgaactgaatatacatacataattgttctaattgtgtctgtagttcatataaatgatttattttatttttatgtaacaattactgaatataaataatttcaaatttgaagatgtgcgagcattcatgaattacaaaaccataactggtagacattggcatatcatgtttgttataaatgacctcagagaggacatcatatgtaagaatttgtcatttttatattacatatttaaatgatcgatataagtactttaaaatgtcttaatctaataatactattgaggcaaatgctaaccagtgctcttagattatgttgtccatgaccttttttacgcactcgtatggtctccacaataaatacttctccttttagttccttcaaccactgtcagccaacaaaaaccaggaagttactcggtataatgttctttctcatataaaattaacatgttttgctactaacaaagaaagtatcaaaccaacatcatatgtaactgcaacatcatataattcataccaacatcagcttgacacaaacagttgcacatgaaaaccctaataaaggcttaaatacttattttagaatgacaaagatacgaacttcaaagcaggggagaggtaaccaagagaccccatccacaatctattacaacaatacttaatccatttcaggttggtaatctattggctgtggtgactttgctggaggcacgggaggaaacaatggtgatggtgatactgatactggtggtgatggtgacaccggcggtgatggcgacactggcgttggcgttggcgttggcactgcttgctcaaaggcacacaatccaaatacacataacctcccaagggggcatgctcttccacacctaccacagttgaaaatgttcacatttgtgtttaagcacaaacggttgcagcattgacgattcaacgtgcacctaaccccacaaagcccacaattttctctgtctgtagtcacatccacacaacggtctccacagcatatagaccttggtggaaactctcctctgctacatatcagtggtcttcccctgcatccaatgatttggttctcatctttctccatcaatgatgttgatgaagatgaggcatcagtgccattctcatggacttcttttggtgttggatttccctctatcttgatcagcaacagcaccaccaccaatgttacaagagctgaagattgtgctcttagactcatcttgaggaagtggcttgaagggtagcattttggaaccatatatatatacatccatacatacatatatgtatatatatacatacatacatacatgtttatgtgaaagtaaattgcttttcttacaagccaaaggggcatgtttttcttgcatgaataacaaccatggtcttgatctcgtgttatgggcggtggacgttgtctatatatgtgttcgagttacatatacactagaaggaatattttgtcagctagctctgtgctttttgcataatgagttgagaggcttaacatttgtatgttgatcctcaaaacaaggttgcgtgatttaggattgtaaaacatgatgatgaatgcaaaaccatgaaatgaactgttacgttattgaagggaactgattcacatgaaaattgaaatgcctttctgaaaagattgtaactacctcatgaatctccgtatgttatttgtgatttattagcattgaaaaacatgtgcattgcacgatttaaaaataaataaaaagcaagaaagaataccaaataagaaagcaaagtgaataaaataaagctatccagacgacatgtgacgacgatcggacagttttaataatactattgacgagtctcaagatttcgagtgcatttggtttaatattagattaaacagacacacattcccatgcacattttgtgaaaagtaaaaattcaaaacttttaattcaacggccgtttgagacattccaacgtgaaaccaaccacgcacttcaagcttatttttataatattattgacgcacctcaggacttcaagcttactcaattctgtttgtagtccattgtaacaccttatgtgctcagctgaatgttgatacttattaattttatcttattttatgattatgaaatcttaagaggaaaaaaaatagttttaaactttaagctttagaaagcttaaaaggaaacaattaaaagaattgcccaaattccctatgacatcagttaaatatgtaaaaaggaaataatataaatagatcatataggatataaggtattctctctaattttaaatacccatttgtatcctttatgtactgacttagaacgctagtctttacaagtacatcaccagaatttgctttgtgcgtgttgaagatattctgtccgaatactcaagatgcaagaaccggtgctgaatactactaaattgacgatgcaatgggtaattaagcctaaattaaaatacttcagtgtttttttgaggaagatacataccaaatcattaattgctacattatacatcattaattactgaaagcgtttgagtggcagatgtccctacatgagatgagtatgtgccctgtcccaaaacgcaaccaacttaacatgaattaaaaattaaaaattaaaaattaaaaattaaaaattaaaaagttctgcactgtctaaggactatgctcaacttgaagcatgtaatgatttcttttttataagcgacaacatacaataactaaatgacagaatctaaaacaacatagcactttgacagcatcatgcaatcaatttgaagaccaactcattaaacaatctattgatagcctctatgatttacaacattaatccatttcttgtactacaacacattcttaatcatattaaactattaacaaccaattctaacaaaatctgaaacaatcaacaattcataatcaattctatcaaaatctaaaaacgatcaagcactaatgcacagccaagaggcattgaaaaaacagcaataaaaataaaataaagattctcgccaaattcttaacccataacataaaacattcactacaaagggaaaccagaaatacagcaagtgaagatttcatccttaagaactactacaaggacaaacagattactgaatttattatttctcacagtcaagtcaagcattatgatacatcatacctctaaacaccaacaacagtactcaggtgagcagttattacatcgtactttcacatgaacgcgtcataaaggcagataaaagcaaatacatacaacacacgaccttaaggctcaagcacagcacactactatgtgacttaaacggtgacacaattcagcaattattcttaaagcactgcggatttgctgaatttgctcataatgttagagccttgttactgtagaaccacacattcacaacccaccaccacagtagggtgttcgcttgtgctgactgcatcagcttctttgacactttgaacattgacatcctccaattcaccacagccaatggcttcaaaaataagatcattgacttcttgaaatctctcttgagagagggacacctctgcaagaagcctccaagcattgccttcagatgcctcatcataatccttcttcctctttagaaccatgtgcccactaatttcccacacagcaggattcacttgggtgtcaagaagctcagcatccacttctccaagagcttgtttctctgcataacactgttcatccatttggtaaatacccccacacaactaatgaaaatagattaggcaaattcacttgcttcaagaattagtttacctgtggtaacagatagacttgctttccacagtcagagataagaacattgaaaggtatgttgttgttctgaagacatatacaggcatctgaaacaacatttgataaatcttccagcgtatcaccaccctcgaagacaagacctctaactggataattcaacagttcagatatcttcaccccaccatttaaacttgcaattttcttagtgggggccttctcaattgggaagggcagagccaaataataagcctgcatatatattcatgccaaaatcaccaaaatgcaatcagatttgtagaattaaacagcggaatcatcaacacgaactattaagtggtatagttgatcagcttccagtacctggaagtgaagatggttaatggttgcaaaagcacccaagctgttgtaacccaatcgaaaatatggattatcagcttccactgccatgtgaagtgcaaggaggaagctctcacggtcaatcctttggggcaaacactcgaaaatgtgcggaatcagcaaaacatgtccatactcgataggactgacctgttaagaaaatcgataaacaaacaaacatcatcatcagttattacataaaacgcctaacaatgaacccacaagaacaaaagctagtgtctatacattgatggcaacaaagctgggagaattgtcaacatcaactggagcatttggaaagaactggacttgtccatcctcgctagcttcaaattggaagaggacctcttcttgcccaactttggtaaagttgaatttgttttcatcaaagggttgaaggaccttgtcaactcggaactcagttggtctcttcttgaggtgacgaccctcattaagctgggcaacgaaaccatattcaccaggaatcacctacaacagaatcaccacaaaacacatcaaactcagaaatcataccatccatatatctatgcataggaagacaaaaacaaaacaaaacagaccttggtttcacaggcggtaacatcatagcggaaaagtcctttctgcatgcgatcttcccactgccatgaaagggtaaaaaaaaaaattagaaactttaacacaaagggtaacaagaaaagatggtgttaacccttctccatgagcaaaattccatatctacctctccaagaagaagtgagtcgaggaatgtgaggggaggctctccggcgcatgcatgcagggccaaatcctttccattagccttcttgaaagcatacaaaggaagctttgcatctgttaacaaagcaaaaaacacaaataactaaaaaaaaaaagagccatgtataatggatccaactcaactttagagagttattgatgacaaaaaaaaccgtgaatgttacatgcacatgcatatatgagttggagaaagaaaaaaagaaagaagtacctggaatgcaacaagctttaaggcaattccgaccacaacctccgacaggacgaggagattctgcagcgtcgtctttttggtagttggaaacgacagtgggaaccctcttgagtctgagcatcattttgtgaacgaaagtagaagaagaagaagaagaaacggcgatcttaactagtcacaaagtctgttgtttttttttttttttttacttatttaagagtatgtaggctaaaagtaataaaaagagtgaagaaactagaagacaccgccaccagcgaggaagagcaagtctgaagggctaccaccttcagaaggcaaagcaccacgcccaccgtgcggcgaagggttggcggaagttacgcaactacccgtcctccgtcgtacagttgggacatgaatgagggagcgagagactcttagaatagccgtgatgtctgcaacgcttcaacccggggattcaacccaacaaaaataatgaataatcttgttttgcttctgtttttggcggaggagtcgttgttgagagaaccaacatgcagaaaagagtaactaactaaactagctctgctttggtggatgtggtgtgagaggatgaggtgcctttgtttcttgttttatagataagagaagagagatgtggtttaaatgtggccgtgaataatgcgtacggagtgaaatgaatgaatggaaagaaaaaaaattgccttggtggaaaaataaacagagtccgatagaagagacaataattgaaagagagaggtggcttcacttttttgttcgcctcgctagacgctagtggaccagtggaccactgtgctgtgctgtgggcgtaaccaatgggcgatagattaggtatttaggtatttaggtatttaggttaggcccgtttcaaggaatcttggactccagaatcttctctcggtatattcattccactcatattttacacttaatcaaatgtataagtatgattaatcttctgttacaaatagttaataataaataaatgtagataagtgatttataatcttatattatataatactttatcttacaagtgattaagaatgttattcgttttagattgctgcacatgattaattacatgttcaaatatggctattttttcttctcatcataagtagttaagagtgaagattattaagttattaaaatatctaatcatgattaagtttctctaacaagtagttaatagaggatgccttgtacgatggactagtaagcaatgtggtttatgctggtggcggacataagaatttcattgaagggacgaacataaaaaaaattatatcataaataaaagtattttaaagataatataaatctaatatacaaaaagaggcaaatcacaattcacaaattacatatagacaaattgcaaataagatggggttgatgaacaagcaaacaaagtctaatgagtcttaataaaaaattcagaatttaaaatcaaactcaaaacaataatatggagataaaagataaagaagacacaattagttttagcgtagaaaacccaattgaataaaaaatacgatgtccaaattggataatcaatccaatggacaactccactatgataataaataagtatctttaaatcctgatagagagttaagaatcagacttgtaaaatgcttctatatgatctcataacaattctctcaatgagataaacataaactctctgaagttctaatattatttagaatggaatgcatactataaacacaaaaatatgtttctatttatactaatttaagtatatgattttaaccaatttttgaatgcaatcctacaaatattctatcatattatgcaatgcaactttaaagatattttatattatgcaatacaatcttaaaaatattttatcctatttttgaatacaatattaaaaaatattttatcttattatgtaatataatcttaaagatttctattatattatgcaatataatctcaaaaatatttttttctattttttaatgtaatattaaaaaatattgtatcatatgatattatacaatacaacctttttttattgtcaaattatttttttaatttttaatatatatatatatataataaaatttatattaataaaattttaggaagacggtgacccaccttagcccctcatccatgctggactagtttttatagtggtatgtaattacaatttaatccttgtgacttaattctatcccttttgcttttttattcatccctcatcattggtctcttctattctcaccatctgcaacctcaaggaaggactcactggtctcaccatcggaatcactatcgttgtcagtctcatcttcctccacgaaaacgacatcaaaacacttttgagagtccagatttgggggaggtggaaagaacgactgaagagggagagagggtaacatgtttgcgaaaatgacctagttttctttactagtttttctcactatttttggatgtcataatgctttgagtgataatgatatcttcatatttgttaaattacggtgttgatgctcgtctctagtttttaatgtcgttatgtcaatggtttgaactctcacttttagatggttatggatctacaagtttctctcagtcctttagatgatggcgaatgcagcaaattgaagagagggaaagaagaagggaaaataaaacaaggtagtgatgacgtcgacaataacgacgcacagcgaacgagagaggaaaaggaccaaggaacaagaaaaaaggatggtgtgataaaagacaatataaaatataaattgataaaaaaatacttcattttaaccgtttaatattttattaataaatattattgaaaaattatttgtcaaccttaaaccacctaactcacttgatcaccttagacattgtggttaatagagccataagttattaaaatgtttgatagtggttgattttttaccttgtatgttaataaaaaaaatttatgcatacaatattggtaccaagtattcataagaatcaaatatgaagtcttatattcaaagggagaaaatttaatactattagaatcaataacttattagtttataaaaaattaatgataattatataacataattatgcataagtaatgatacttaaacacccattaatatctcttattttatttttatctttctctttttattacatcataaaatctataatacctatttttacctttctttcactaattgtcaaattttactcaaattatatatattcatatttatttactttaaactatttataaaacaaaattaatcatatttatgcatataattaaccaagtttttgggttgaacgctagacgtctaaaaaccatatgtacgttcatcattattcatcttttctccaccagtcgtacgttaatcattattcattttttctccaccggtaccccgttaaattttcttccttgatggggtatttttattagaatataatggttgacctgtttgtttaagtttttttaaagtattttttaataaaaaatcacttttttttttaagtttaagcaaactatctatatgtatttttttatgtaattttttgacaccttaataattaataaattaaaagttattgtcatgagttttaacataattcttcaatcggtaaatttattatatattatatttgtgattgaaaggcataaattttttatggtataaatgatatttaatatttttattttacaccgaattaatctttcttccacttccattgtcggcctatataatttgttttctcttttaactaatgaacggttgacattacataaatggtcatacttcattaaaaataaatttatagactacttcttaaattaagttgtcatcatgagtcaagttgaccgatttataaattactataaattaataaatattatatctaaaatacaattattaaaaaattcttctacatttatataagattaaaaatatttttcattagatcctttttcttttcattggatcgtagcttagatttatgccaaagtttgagacgaaaaggaaataatatctttatctgaatacctaaaaaattaatattttaaatttcatgaatgatatcatgtaattattttttatatattctttgtcttttatattaattagattttttatttgtatattttttattttctcactttacaataaatgattaaatatataatgcaaaatttaatattttattaatattgtaaaatcacaatcaaaatggaaaaaattgttaaaatatcaaataaaataggatgaagggagtatagatgtgtcaatcaaccattagtattgatttagatagataggattaagagaaatactaataatacatttttttgaatataatattttttattagttgaaattttaaattttcaaaaaatcctttttaacttatttttattaattaaaatttatttaaattacaaaatcataattatttttcattaaataaagaatatgataaatttcatttaataacaaaaatactgcatttaagagaatatattcgaacaatgttagtagcatttctcttatctagattcataattagccaccgctgaagtaagatttgggatgctaaaaaaactttctttttgtttgaaaaattagaagtactagtaagataacaatccaccgatcgaagtgtttaccaatcccaattatgctgggaaacaattctctttttacgtcaatatttttctatgaaatattgccaagggtttttttaatcaatgtttgcttttttgaaactagtcaaggaaaatttatttaaaaatatattaaaagttatacaaaaatgtatctgtaaatgatagaaaaatgtagttttatgtattataataatcataaaaaatcctcttttactttctcaagtaacttgttagcacatttacctattggctgaagcagtaccacatgaactttcgcaacaagtaacttatttatccccatgagcctgccaatcacgtattcacggcttcacgcatgacgtaactcattctcgcggatttaaaatttatactgaaaaacgtggaaatcttgctttcccgtggacgaaaagactaaaataagtactataactatataatataaatggtaaatagtttttttttttcatgagtatgtagagtatggataaatttatctctaaaaaataaaaataaaattttagtttttgaaagtaaaaaaaatgataaatttattcattcgttaatttttgtccgttaccatgaaagagcctaattgacacatttaagagacgaatttatctgcactttacatattcaggaacgaaaatgattatttatttaaaatataatttaatctttatctttcttttttttcaatcgtcgcaaacataacattacaataaacacttaaaaaataagaaagaaaacatatattagaacaaacataataataaacataatattaattaataaatataatctgtctcagaaatttttattatgacaggtaataacaaaaacaagttaggtctcattatcataatttttttttgaatttcatattttgtgtaaggtactattatattagaaattttataataatagataaactatgcttattaatatgtttgttctaatttatacttgtttttctatttttttaagtatttattgtaatattatgcttgtaacaattaaagagggaaaaataaaaattaaattatattttgggtaagtagtcattttcgtctttgaatgtgtaaagagctaacaaaattcacccattaatttgtctctgaatatgccacatagactctttcattaacgtgttaacagatgaatgaatttgtgacatttttttatttttgataactaaaatttaaatttgaattttcatttttagatatgaatttataacactttatatattaagggacaaaatatctatttaccctaatataaaaatggttaatatgatttaccgtgtacgtgaagttccctcaagctcacaacgatcatgttgactttgttaggtttttccccctctaactttgtttataaattactttcaacgattttttatgcttttatttttatgtttttcgtaaataaacatttcaaactttaatgttatcccaaatatttcacaaacttcagttatcgttcatttgtgtttttcttgaacttttattaattttcctggccatatatccatttgaatatgagaattagcataaattaattctaagattaagaaatgattttttttaaataatcacttaaatcaaattgataaataccaccagtaaatagaaaaagttgttcataatttttacatagttctgtactagagtctccatcaaaacctttttcaaccaatccaaaaacatacgtttaacttgagaaagaagaaaagaatgacgcgttaaaataaatacacgtaaatcttctctcacgcacgaatataaattagttttgtatataaaaattataacattttgtggacttgaagaagtcttgctgtgtatatatacatatcttgtctatattgaattttgatgacgaatttgtggcaacctaaaatgcgtatgggaagaagctctgaaatttctctatctctaccaacaaacagaaaattccagtccatgaaacttcgagggtgaattgaatggccaccaaaatatctcttttaattaatttctgctggtcctctctgagcccacaaacacaatcctccaatcctcaacccatgtctccacatgatgcatgtgtgcaccactgaaaagcacaaagctatacactcacgtgagaggacgtttgggtgttgaaaattaataatagaccaaattaattctcctatttatgatgttaaattaaaacagacatgaaatggaagtcaaataagtgtacgagcagaaggtaaaaagttttctcaatgtatatgtaaagaagaaatcacaagacctagtttattaaaatattttcatgtttttcttttgatagtagaatatcttttaatcttatctaataagaatgatttaccatatttctcaattctcaacaatactctactatcttgggtagatgggatatgagatatcaagctctaatacacaaagttttattttatataaatagcaataccaatacataaataacaattatgggaaaaaaatgagttgagctcacttgagtttaactcaacccattaatatttaatttagttcgaaactcgacttgagtttttattagctcgaactcgatttagtttaaactcgtgaataactcgattaagctcgttagttcgaataatatgaataatagtccaaatttttaaatcctatacgttttaaaattttaaattattagtagattttaaataaaataattgtttatttttttaaagaaaaaaattgaacgtattctagttttatagaactataagatataacaataaaaaatcataattacaaccaaaattaatataaataaaactatttcatcatgcatacataaaataatagaaaattcatttaattataaaaatttaatatatatatatatatatgtgtgtgtgtgtgtgtgtgtatgtgcatgtgtgaagtcaattcataaaccaaacgggtaaaattatacgtaactcaagttcaactcatttaatttatgaatcaagtttaacgaactgattatcaactcgaatttcaaattatttttgagttgattcagttcattggtaccactaataacaattaaggacaaatgtattttaaaaaaaaaaaattgataaacttataactctttataacttctcatatccttattatattaataaacttataactctttataacttctcatatctttattatattaataagattacttgaatatgatataacattaaatatggagaaatgtccaaccttttttaaaagtgttagtagggatggtaaaacaaacttatccattgagtgaaaatagtcaacccatttattttggtaggttgaattgcaatgttaagcctcttgacccatttaacatgccttgtctaacacattcagaaataaattttacttaatgtctttttttgggtcttattagaaaataatattttccatcaatctttttttttttttttccttttgaagctttaattcataaatttacattataatttgaatataattcacgtttgaccatattgaatttagccctgctatatgtctcaactttcgtgtttgccaacaatggcaaaatcctagatcacaacttgggtcgattactagctagcctcatattccaatcttgactcactcaagtatcccccatgcacgagccttgtatgtaaaacgatacttaatgttatgtggatcacactctcccataacacgactcttcttattgtagatgcattgttgatgtttatagactacctaacatatcatctctcagcctccatttagtaagagggaaatagacaatttcaaatagtgtgaatttcaaattttttatactctattttaatttaaattaatattttttttcatctccttcactaaacaaaacattagacttctacatatatactagcttaaaatagtaagtgtttgtgaaaataaaatctataaaatatattagttcattatatattataaataaattaactcataaaattgtctcctattttatttccctagtgtgatgtggatttgaatgaatgatgtggggggactagggagggagtacagaagaaggcagaaaaataacgtgcaagattaggcatctatgaagggatcattcttatttcttaagactaagaaacactcttttttgtccgctcccagactcatagggaccaagacaaagacagacactgccctctgtttggaggcttaaccttaacgagtccacttttcttaacttgcaattaatattaaggtacacttcgtgagacatccaactttggaattgagtattcaaaccatagttgttacattcgaattttaatcatcttatctggtgaatacattgaaattacaactagatttcatggtcgtacgatatactgctcgaaagaaaaaatgtaatgctatttttatattattaattatatacaaattattaataatgatatgactttaattttcatatattgtcaatgcaaaataacattaaaaaaatgacaacttttagttatttgatttatctcatttaaattttattattttactatataaaataatttaccctccattaaataattaagggaaaaaactacttatttagtccttatacttgtacaaattttatcttctagatttcacacttaaaaatcctcacttttagtccttgtatatataagcacttttatatcttttttagttcctacttttacggttatacaaaatttaccttttaatggccttattattttttaaaggtagggactaaaaataatccaaaagtgcttgtacacaaactaaaagataaagtttgtgtaattatatggatcaaatgagtagtttttttccttcaaaaaaattaaataaaaaactatatcactatactactcaagagatctctatttaaaaaaatgttaagtattgataagatattcttgtttcttttgttaataagattagcttaaacaaacctcaagtttagtaccaatgaagcatacaaaaggtagaattaaattaaataattatttatttttattggctttggcaagaattagactcaccttatgttaatattatgcttataaataaaaaatgaatatcaaagaaatatataaaaattaagttaagtaaatgttattttaattttattaaaacttgtgaggttattaacattataagtaaaaaaaattatattaatgactattatatttgtatatatacttatatatatatattacttttgtctatataatatgtatttataataaaaaaatattatgtaaaaattactataatcctctttgttatttttttaaaataattataaggattaaaaaaatgtacataaaataaatgaaaagttaataaaaataaaatgaaacaataaactaaaaatattacaaaataaaattagaaaaaaatcaaaattagtattatatatattgattataagggaaatgtcataattaatattactaatttatattagatatattttaattctgaacatgaaattttataactatggtgtttttttttaccaataataactatggtgttaaatgttgaaaagttaaaattaaaatttaccattgttgcttttataattttaaagtcattgttatgacattttccaataactatgatgattaatattgccacattcttatatgcgttccttatcacagttgtcgaggctagatcactgttagcatctcgctatcgtcatttggcattgacattgaccaccactgtcgcaggaattgtaggaaaattggttttttttcttcttctacgtaaaggtgataactcattttctaaataaaaagccaaacaaccgatggatttgagtattaaaattctacgattcagctgaaacgaaaagaaaatcaaaatttatgcgggccatagaattttattcaaacatttgaatgcttagggagatcctaatatcgtcaataccacttattaaataggaatattcttttaaaaaatgtcgtgctaattcgaactctatttaatcttgcttctattaaaaaaaatgtttcaatttttacattattatttacgaactgctaattaaaacgttttctttcattagaaattaaattccttttagaacctaaattctgaaaacgataacctttgaaagatacttgcttcactcatatcctcatcattctctttccaaagaattttttattattattggggtgaccagcaaggagcaagcacgttatcttttatcaaaattttctccctgtatacaaaaagacttataaaagctaaccaacagttccctttataacaagccgaaagacttcaaagacatgtacgaagagaagaaaaagggcagaactttagacttttcactttgcaagagccaaccaacggtttcaataggatgcctatgattgaacaaggccacaacggggtttttagagtgtatatcaataatcctcaaaggcaaaacttaatgcttctggaatttatgttatggacgcataaataacatttagatgcttcaagttggacgtgaatcccaaatgccaaaagctaaatgaaacatacacggaattatgcacaattttgatacttcaattatggattcaactacatatatagtgttatggaacatgaaaaggtaaaacactggcagactttcattaatgagtatgaacaaatagttcaagtaaacttaacattacatctaagtcaaaagcttaaaacattaaattggtggatccttttcatgttatatgttattcaacatgtcaatttatattgaccaataaatatactcacacttgtcactctaacaatcttcatatgaaagtatgtgagtctttttcacattatatgttctccttctcaaatgaaagtctttccatttttttcttgataacatgctcaatccttttctcattttttagcttgtccatgtctctcttatagggtgtattacaagtttcattatcattattgtacacacaaaaagtctcattagttaataaactttagacacttcagctggcttaagaataaatgactctggttaatgtgcatacaacactgttcataatatccttggtctaccctttcatttctaaaatccttgatatcaggatgtttacctttaaaaaaagcctttgaactatccaaccgtacattattaaacctttgttttgacccaccaaaaccatggttaaatagggttaatcgggatttaacttttgggcttcttacgtgtaaaaatggcccaaattttagtcagtccataacaaaaagaggaaagttgggcttttccatgattattagggggtccaaaatcaaaatgtcctaatcctaccctttaattaacagttctctggggtggaatcacataggatcagaaccgtgggacccaccactccgacggcttttaagaacaggaccaagaagagttcaaagagaggttaccttcttcccttaaaatcatatcaacgcccacaaaaaaaagtgaaaaccttattggacgaatatgctttcacaggccttatcacgcaacatccaaataacgtccaaattaatttctctcttgtatggttccctttgtcccttgtttttgttttgtttctcgtctaatcactgtgtaacaagtttaactcctaggctataatctcatcttgtcacagttttgtgccaaagctcaacttaatattttgttcctaatgtggtcattcggataaaatacataatcaactacacgacagagtaaagataggaaaaagaaaatgctccaagtggttgtgttgtgtaactttcatgtgccgacattgataacgcttttaacagttcacaacatcatgcaattggtttgcaagtagtaaatcactaaactagatctatctggctttaatttccatccgaattggattaaatatttcattaacatcattattggtggacaatgtagaatcgaactacttttatcaacgaaagacaaaatattgagtgaatttatttaaattaaaaaacaattttaaaatatgtttttttaagaaatagatacgattttttaaaataaacagaaaattaaattttatttaaataaatacacaaaaaaacagaatgatatctattttattaaaataaaacttatttcaataaataagctcaaacaaacttattcattattacttgtttatgttatccatttaaaataatttttttattaaaataaatacttattttaataaataaatttaattaaactgatccattattacttgattatgttattcgtttaaataaagaagaaagaataattataattaaagggtattacaccacatttaacaaatattgcatcataatggtataaaaatttcactatattcgtatttaaagaataatatatatgtctcatttcacaagtaggattaatcttttaaataatggattaaaaaataactgtgttctctccactaaaataatattgcactgtaatatatatatatatatatatatatatatatatatatattgcctaatgatgtttttattgactataatgtatgagagttttgttggaattttcagcccccacaaatatttttgttgttttgttgactgacactggcaacaactcatacactgatgcaagtgactgcttccactgtttgtctttctctccctcacctctatttatatgtccagaaccccatacacttattcctacgtattacttcctgctacccctaattattcatttattctgtccatctttttttatcatttatttcattcttgcctcttggccactttaacttcctcactcgcattcaccgaagtcatgaacaaattcaacaaatctgaacttctagtgctctttgtccttgctcttctccttgggatcacacccttgttaccttcctctctgagaccaacctacctttacttcatctttaacgttctcatcattgcacttggagctgaagctggtcttctctcagttttttctaagcctttagaagacaaaaagcaacatgtttctgtcacccagaaacctgtaatgcccccagaagtgtatgaacctgaggaaagggtggaagtgggtgcctcagaatatgatgaaaagaagcctaaggttgttgaaaagcctgcttctgatgagaagattgttggtgtcactgaggtgaaaaagtgtccttcaatgccaaatcttttgctcataggaggtggagaaagtgaaggagaagtcatggatgaggagattgaagctgaagatgaggttgggggagttaatgggcaagagctgtttgcaaaagctgaggccttcattgggaacttctacaaccagttaaagatgcagagagagaattcttggctttatcaggaagccttttaggaacgcattagctttttctctctttaataaattatttccagggtgttaaatttagaaacactggttctgagggtctattagtttttaacccactgggtttgtacagattctaatttggaattagaggtcaggtctgtttactaatttcaatctgtattatcatcttctaagttcctgttaaaagaattttactgcatctattttcatgctccaacaattaaaaagttgcatgtcattaaaacatagcattttctattgaaaataaactgtggtgttttttttttcctgcttaaattaatgggagacgactgaagagaataagaccgggggaggctggaaaagtaattggagttcactgttggtaagacatgacatatgtaattatattgtaactggatttctgcatgactatcaataattgactggggtctgcgtatatgattatgatgtatgcttcatatctatcgtgttttataaagtacaagatgcagtatgcagattatgtgatatcaattcatgcatcttgcactcctaaccaaatttttgtataactaatcaaactttgatgctgtttaactcatcaaactttaagtctactttagcctcttaatagcaatggtttgcacaaactataattaagtagttaactagtaattatcagttttattaataattgtttatagtattatgcttaaggaatcaaaagtagaatttttttaatattattaatatattatttttgtaatttttaataaagaattatattagtttaaccattactcatggttagtaaaatcaattataaattactagttttaaagagttcttggaaacgtattctcactaaccatttatgagttgaatgcaactacttacttttaacatgtcaaaatagactagcttttagttaattaagcacaaaattgatctattagagtcaactagtaaaaataaaaaatacataagaatattaattctttagctctatttgagtcggtttccgtttttctcaagtcatgtgataactgatgacgtgaccagcttatgggatatcttattaaaaacagcatgttggatatttttctatgtaattggacgaatttttttcaaaacagtgcagaattcttaaagtgttacttcatgcccaaaataagtgccaggtaatgtttgatagtgccagctgcatataaaaaaagaaagaaagacgacgagtgttcaatttgacaaagatcaagccttattttgattatacatctgtcatgattctgtctaatccatcttatcaacaatatatatacagaaaaatatatgatccaacagttgttaatacccgttgctcaaactaaacagtggacagggtcttaatctaatttggggtatcatgtttctgtccccttaagaattttacaaaagaaaataaaaaattggcacaatgagaaaagcatttttatttgcacgatttttgttaatatttaaggttgctaaatgctaatggcaatgcactcatcctatgcatttactagctgtgtccaattgtcgtccgaaaaagcacaaatatttttcttaacatcaagaacattaattgttagataggtttatagacccctgtctatttcacatgaggtaaacatgttatgagatctctattattttttattatattgtactataaaatatttatcaatattagtaattaataattaatttttgttaataaaatattctctcgtgatcatattttatctatttattataaagtttaaactcaagaccaacacaatgttggtaaagacccatatcattatttatatgatagtgagacataaatttaaaatatactagatgttagagacacagtggacgtgttgtgtatcatcttgttgcataaaacttcttatatatatcaatcaaaggaatctaggtttaccatctcttctgaaatagttagttggttaccttagacgcggccttttagataaataagaatatatctattaacacattatctcttcttttttgtgtgtgcaaagaatcaaagaatagacagccaaatttgtccaatgactggcactgcagcagtattagaatagcactaaatttcaatatcttactgcggcggtattaatatgcagcttaattaagaggttgacaaatacaacactcagcggagtgtggagatatttttacactattagtaatccagaaaaacattaaatttagaaattcaacattttaatactctactttattttttgacaaaaagaaaaaccaaattacaatagtaaaattatattagtgtgcacagatgcacatgtcatttcattgaggttggtgacaaccaaaaccttactaggttgtaagtttctttgccccttaattttaaagcaaataataagttgtaatatttcacaacttttttttttttttttattttacagaaatctttgacacctaataagaatacaaaattttgtctctttatctagctctctaaaaataaaggcattgcgtagacattatattttggtatttcctgtggggtcaatttaccttggaatgttgcttgagaatctctttttttctgtaagacgttatcttttagattttatgttttatcttaataatagggatatggaaataagtttgattttatttattatttaatttttatttgtgtaataatagggaattggaatttgattgcctatggtccaaatacgaactactgcatgctgcaataatttgaatttgaacggttctgatttgtttaaatacatttaaaactatttttaattataaaattaaataacttggatgaatgagatatagtctgtattctccttaaaagaacaaaacaaaaaagaacataggttgtgcgttacaaaactaaagatgaagtattagacgataattcaaatatttgttaactgataatttatgggacaactttttcttttacataaaaatgtttaaatatatttttgatctttgatatatatttaaattttatgtttgatccccaataaatttgtcctttacatttattttctgatatttaaaaagttttgttttagatctctacagtcaattaaatgataatatgttcgttaaatatttgacaacacgatttgtgacggctcaaaaatcatcagtgtttctttcaaaatcacatttaaaacatatctcaaattttttgaagtaaaaataaataaatctcaatttgttataaaaagaatgtcctttccttctccctcctcttccgtgaccacctcctcctctgcgctgccaccttcaaccactcttgtgtcctatgtgtctccaccgacgtcgattcgtaatgggccctcactccgtcaccaccgtgggcttctgccactatagtcgcatgtcccaaatctccagtgttagattcccgcactcaccttcctccaccaagaaccatcaagggatacgcggtctgaacattgtgttggaataaaaatgattcatgctctcacaaatggaattgttttgaagaacgaatggcaacttgccctttcaatttggacagtcatgaattctggcaatgacttcaattgggtgttcaagaaggggttccttgtttgcagcagaattgggattcatagaatggtgtgttgcacgctggcttgatgccaatgaaggggtaagaaccaaatctgtattcatggcacgacacgacgaaactccgacaacgacgcaacaatgaccactcatccttcaactccttcatcatccttcacaatgacagacgaaagttgcggtagatatggattcgtgtggtgcaacatggtagatcttcgacaaggccatgataatgaccgatcccccttcaaccctgtcattgtcctccactacaacagacaaaagttgctctagatctagatttgtgtggttgccaccatgttattgttgttgcaatggtggaagtggttcggcaccgacgccaatggtgaggaccaaattattgttgtttgatttatttattttttactttaattattatggtgattcttaattgtcataaaatttatatttgattttgaaacaaatactagtgatttttgatccgtcacaaatcgcgttatcaaatatttaatggatacgtcatcacttaactgacggcataaatccaaaacaaaacttttcaaataccatggagcaaatgcgaaagaaaaatttgtcaatgatcaaacacaaaattcggatgtatatcatagataaaaaaatatgtttaaacctaatgaaaaatacccatcaattttgacaaactcctgaaaataaagaacattgtcgaaccaatgctcgacctataaaattgtttgtgttgtaagtggaagtggggaaccaaacaacatcataacaaaatgttgtaatgtgatttaattttcttatagtgtgctattcgtcttcttttaataatatgaatcaaattcacccaaatgcaaaagttttccaaaattatactgtaaaattgacgatgcatataactttgaacagttgtaatttctcgtaacaatgtccaattgagacgtattttatgtcaaaatgctcgaaattaagagaagtaattagataaataaagaatagcttgcaattcactaattgaatagataaaatatcagagaacaaaattttttttagggctccgaagattaaatcgcaaatttgaggcacttagagacctcttttgggaaatttttttgggaaagtcttcttcggaacttgttaagggctttttctctcaatttcgagcgcgtggccaccggtttcgcatcaatcggacgtcccagtcaaaagttatgaccttccgaagtttacgaaaacatcgcgccccattttttttgctgccacgtgtcaccacctcctcaaatacgccccatttgggcgtgtttggttgcaccagttttctaaattgtttccaaattacaccatttgccaaaattttttatttaattgtattatttgtaattttttgcccgatttaaatgtttagatttgtttaccattttttttggtaatagaataaaacaatttcaatagtgagattgcatagagtacgttttttaaagattaattatagataatgatgaagtcatcctcatcaattaaaatgcaaatattctttcgttccttcgagctagaaataccatttccgtttgatgtgtggcatttgatggtttattttcaccaatattcttcaactcccttgcatcttcaaagaaaaccaaaatttcatattaatttcattcgttcatggtcccatctcaaaaacattggcagatatgacaaaactaaattccaaagtaaagattaaccttatcttctaaagtctaaacaataaatgaaggtaaaaacttacaactaagatttagatttcgaccttccattcgcatccctgaggtccacactcacatcaagttggcagtatttgaagaaataatagaaaatcaaatgtataagataatcacgtacgatcacagctttttggtgcaaaaagggtgttaggagcccgtatataaaactgcaagctaaactgaataaaataacagaactagatatatggacaaaaaactaaattgaaataaatgaaaaaagacaattctcacatcaaagatttgtctttttcttttctgaattgtggagtacaagaatagaattgataattgaggttcatcatgcattatctaaaatatatataacaatggagaccgagcacaatctaagaactcatatccattcttactcaatgtgtttgcaagcatgagtctaaattaagtaactgcaaaagattcgacttgtgtgcaagcaaaagagacaagtcttgtgtgtgcaagcaaaatccattgaatgatcttgtgtatatttttagcatgcagatcatttgtagcctgctgcacaatgaacaaaacttctgtttttcgatttaacaacatatgaaccattgaatggaagaatctacactaaccagagatgagagatgacttgatgttcggttgagattttggatggaaaaaaattgtgcaggaaatgcgggagtgggagaccatccgaactacatatatattaaccatccacttataacatactactatattgaaagtttattaaaaaattcataatcctaggctagaaattttaatttttttacaacatataaattctaatatttaaattaattaaaataatgatattaacaattgagaataaaaaatcattattaatacatttgttttaaaaaataaattaaaaaactattcctaattttttcaatattttggatttaactgtgcagtcagaattttaaaattctaacccttattacattaaaaaaatactaacattaaaaaaatactaatgtactctttcaattactatatttttaggaaaaagagtatttaggcaccttaaattttatctcttctacaaatagacatattaaattttaattttagcctagttgattcctaaactttatcaagataccatgaacttaaatttcgttttaatcttctttttttgtgttactatttaaacatggatttgtgtatggttggaggcctttgaatgtctcttctaatttttataatccttgagtttaccgaacatcttatttgagtcaaagtgaaaataaaataattaatattatcagaacaatttaagacctacaaatgagaaaacaaataccattagagaaatatcacatatctaaagctaagttaatgaccaaagtttagaggagggggaacatgatcaaattaattaatgattaacatatggacttaacttaggatgattgtggttactaaagtgaattggaggatcaagaaagttcttgaacattcctatgtatgtttcacaatcaattgcttaaaatatgacatatacatagaatagtttctttatattaattaattttaagaaaaggaaaaaaaatccacctcatacctgaatttttgggcattgaaccaggcaaccatagagaaagataagatgccctgtcgaatgaggtttagttgttttaagtatgattcatgtatatatacttgttctctcatggccttagaagccatgtaatattttgaacaacttcaacttctttatttaggttctaaatatttgaaaccttcaatttacattaatatcttagtttacctcgacttgatttgctctcgttaagatatcttattttggaacttgattataattgtctatcaggtatcttagagtcatagaggcacatcccttattttatgtagccattgaactattggtttatttgattaattaagcatatttatttttatataaataattgcctataaggtatttagatttccagcggcatatattcatttattttttattatatgttattgccctactaagccacagatatttcttttaaaaggaattgtattcatgttttttataactaaacaattttttttctttaaaagacgaaaattttgccaccatttttataaacgtttattgtaagtcgtccaaattatgttgagataagtttccaatgattaagtcctaactccgacttggcaggtctttgcagaggtggaacacatgtcaaatgattaagcacatgtaaataaagcaatagatcgaccacaaaataaaagctgggaattcacatgtaattaaagcagtggaccacaaaataaaagtcataatgtcactcgcgttttaagaataaaaactacattgtaaagttccttaaatgtacattgtttctacattaaatagataaagattatccgcctttatactcaagagccattgtgtgcatgtttggattccaaataaaattgattttagtcccaaaaattatggtgaataattaaaaatgaagaaaaaatccaaaattgctttgcttgtgagttgtgacaatggaaaaataagtaagatgtggtgaccgtacctacccaaacacgcattgacatgactagatttgttattgtgtatgtacgggtatattatattttttgaatgtttttaaattttatttttataataaagtaatttatatcaatactttttgaaatttcataaaattattttactatatgaccgttaatatttatttataatatatatatatatatacctatttctgaatattgtattattatccatttgactttttttgaaaaacatatttttatagaatattaattaaatatcaaatttatgtcataaaatatatgaaaaatctatttatttatatatttatattaatattatactgataatatcaaatgttataacaatattgtttgtcaaatatactttattcaataatttataaattattatattcaaagtcaatatatatatatatatattaatatacatttaattttttttgtgtttaagctagttttatgaagtaattttataaaatatcaattgattataaaaaaatatttcgtctttttatagtaatttttactgctgcaattatgtcgtgtctgattttagaaaaaaaatcaaaatatattcaggtaattaaaaaaatgataaatattaaaattcgcctataaaaatgtatgacattgatttttaaaagataaaaatttaaatttaaaattcataaatataaaaaatataaaaaattaattttataaataatgtgacactaaatcaatttttaaatattataatttaatatcaaattaatttaaaaatataatttataataaaattaattcttaaatattaaaatttaataaaaaaataatcttataaatttaagagactaatttatcatatttttttatatattcaaaaattaaattcatatttttatctttcgtcacacttttaaaattataaaaataaaaaaaaaatctggaaggacttataaaaaaccttgttggtgagttgaagtgagagagtgtggtgagagtgagtgttgtgttgtttttgtttggttgtggtgcggagatggaggtgtgtttgctggaggaagtagagaatatcctaaggtacggatttcgaaacaggaagattctagaagaagccctgactcactcctccttcgtggacgctgtctcctacgagcgtcttgagttcgtcggagaccccgttctcagtctcgccatcagcaaccacttgtttctcgcttaccctcatctcgacccggccaactctccctcctccgcgccgccaacatcagcaccgagaagctcgcccgcgtcgccgtccgcaccggcctccaccgctacgtccgccacagcgcccctcccctcgtcgaccaggtcgagcgcttcgtcgacgccgtcaagctcgagaatcaccccgtctctcacggcggttccgtcaaggcccccaaggtcctcgccgacgtcgtcgagtccgtcgccgccgcggtttacgtagacgtcaatttcgaccttcagaaactatggatggtaccgtaccttttatcaattcatcatcacctttatgttagttgtatgttagtttttctttccttccgccctccctttttctttcaccgccaagctattcttatatctcctcgttatcacgtttataacaaatcagataaggttttaagttgcgtgcttgtgctctcgatgaatgaatgtaaattattatttgattatttgataaggttttaaattttgattgcattccgatagaagatacttgtggtctagacaaaatattgggaaaaatccaattcacacgtgggttagagatagtgccaagatagactatataagtcgagaacgaccctcataatttttggggttgaattggatccaaactcacattcaagcccaaaaatgctgggcggcttgtattggggaaaacccaagtcctagctagagattttaccaagatagactatataagtggggaataatcctcaccctatgagctagtttttgggattaaattaggtccaaactcatattctaagacaaaaagaattgtgattgttatttgtggtaaccaattcattatgatgacacctattataaatgatttttagaataagcttttacttttacattgaagttgctgtacgattcaagatgatgaaaatttgatttgtgataataattgtgattgtggcagataatgaggggtgttttggagccaatagtgacaccggatgctttggagaaacagcctcaaccagtgactatgttgtatgagatgtgccaaaagaaggggaagcaggttgatataaaacagtcaagggaaggagatgtaagtgttgctaaggtgtttgttggtggagagtttgttgcctctgcttcctcttctcaaaaggatcatgcaaagcttgaagctgccaagattgccttgcataaactcgcacatttggtgccttccaccgttaagaagtctgccactaacatgaatctcaactttactgctgatgaaaatggtaccttggttgttgaagcacccaaaaataaacttcgtgagatttgtgcggttaaaaaatggcctataccagagtacatgtactgttctttaacatgattttctttcagttcagttgcatgcgtgagtgaaacttttaacattccttgttgactaacttgttgcatcccttcaatggctcacagcattgaaaaggattcaggtccctctcatgaaaagaaatttgtctgcgcagttcagattccaactgctgatggtattcttcaaatgtcaggggatgaaaaatctcgggtgaaggatgcagaaaactctgctgcttccttgatgattcaggccttacagcaatctaattatatgtagaagagaattctgttgtaattttagggtgtcttccatcttctgttgtgattggctattgtttagaccatagcgcagcttggcatatgaaatcaaggtttttttttctttgacaattttttccgatccatatgaaatcaacttttcaaccttcttgtgacatctgtcaatttgtgaagggttgacttttcccatgtattgctttctgatcaagtagagcttcctattctttaattatttaaaatctaaagactcaaatttatgtttagatggagagtgaatctggaccactcattggtacctaagatcctaaaacctcaatctattttctcatttttagttcatgattggctgtgtgtatgttcttggatgttttatattgtgtgtttagttgtgatttgatcaaggaggtttcaatgggttttgattgaggagattcttctattggtcaactgaatgatcgaattggttcttcactcttatcttggtgagttttggacttgtttggattgatgaagagaaatagaatgagataaagtggaatataatggaataaaatttccagtctattggttgcatatattataatagaatggaacaaaattttcattctattatttggaagaaaaaaatgaataattattttactctcatattatctttaatctctaacaatctcctttacccatagatgaagagaagttttttatttttgaaaaaaaaaaaaaaaaaccgtccattcttcataatctcatctatttatctttatttcctgtgtttactggagttgctcaatcactctctcaacatcatctttattctttgattgcttgcaacccatgccaaggtatcaaattttcatattaaatctacgtaatttccatgatatttggtagttgagtgtgtgcgcggcaagttggagaggaatggaaggaagaataagaacgcagcgaaataaaatactgaaaaatatacctgtcatgaatttgaggacaagccacaacgtggagcaaaaccattataatcatgacgttgagagagaaaaatatttaccgtttcattgcatacaccccaatttggtgaggaaggaaaacggctaaaaatgataggattggatggaatgggttccatgactttcctagtctattccattgtttatttttcaatacaaacaatggatcttaatcccattcttccatctactcccaccaattcaaagaagggattaattttctacaccagccatttttctaatatattcagtatgtacagtgtaatatcgattttgtctttctcgtaatccgtaaaataaaaaacttatattaagaccaacagttcaaaagatgaaaaaaagagagttcttaaatgacatccctccccaagttcacatagtatccatttatcttatgccaagaccactctcctcagtggtaatctcattgatcagataaatggtatgctaattgccttacacctcctatgtagcattgtattggaacatgcttcacatgcatacatgttcatcatacatacccaaaaaaaagtagctcagaaaaatgaagcaaataaaaatcaagtttaattcatccaaataaaatattttatcgaaccaaattggtttaaaacaagattagtaaacttacagtttttgacaattcaccgcctatctccatactgcgcaggcacagcggaagaatctctgttgaaataaggaaacttatagctgctgtattatcaacctggtgaaatatcaacagaaaggaaattaaacacatgacaaaactcaagtataaatgtacatgtgacaagcaacaaaaaaaaaaaaaaaaacaatagcttcatcccactaggaaaaaaaaatcaacaatatcttgaagggcataaaatagttcggaaaattttgttccctgatactagcgatgaactaatcctaacaagttgatttgtatgtacctgttacatcatagaaaattattacaggaatcaatttgaaacttaacaaatagttgaaaatctacatgaacattataagattataacaagactaattatttgtggcaactaaaatatttacacatctacctgtgtgccatagatttataataatcaataatcagttattactgttttttaaatgacatattagttgaggttattccagtatttagtattttatggcaaggtttattgtgacaataatttactaattgaaattattctctgttcagcataaatgatgtataaaaaattattcttctcatagtctagtgtattcaataacagaatcagcaaggatgtagcaccttcactaaggtaccgatgactccaagaccggtaagcctcaaatactcaaatggcttggcctcactggttgtattaaggaagggatacagatatagaggtatatgagctgcagatgacaagaaggtaagtgtaaagagtgaacagagtaatatctttttcctttaagtgttagtttcaatgagcaaaaaccatgctgaaacggatatggtaatgtcaaagcaatctccttaattttatattaacaaaagaacaactaatatgcctttcaattgcccaaaagtttctttccatggatgcttatgaaagtatattgacagtaaaaaaaaatataagtatgactgaatgctaagaaagaagaacaagtggtatgacctataaattgaaagggagaaacttcattttctagtaagataaagtagaagtcctatgataagatagagagagagcaagttgcatataaaatttgtctgcatgattctgttttatatgcagaaaactttttagattatgtatggtcttttaatcatcaacatcaacaacacctttaattcaagttaattggagtcgatggtagataaattcaatgataaatacgaaaaaattgaaaaaaaaaggaaggaaaagagaaagaaaaagggtgaaagaagaatgagagaaatgaatgcaaaagaaaatttataaaaattttaaccatctttcatgaaattttatagtttaacaaattatttcttactttttaattgttagcaattggttgcttttacaatattttataacaattttaaataaatgcaaaagaaaaattattagtgagataaaaaaaaggaaaatatagttaggagatgataagatatcaacaatcattttatatttattgaaaatataattaggagatgataagatatcaacaattattttcaaagatactatttatcataaataatattatttagcaaacagaagttcacggtcttcagatgaataagaaaaaatatcattaccatggaggaatatcatccttgtatcaaggtgagatgccacacactgtaaaaaaatccatgcaaaagatatgtcttagtaagaatgcattgaagaaaaggagaaaaagatccgacaaagtatatgtgactggaccatggttctaaattgcacccggaatattgttgttgcagtgttgtccgcaacctgcagtgtgaatttcaatcacacaaaattccgcaacgcatctgctgccacctagccacaacagaaccatattggagcagcaacggaaccttagcaccgttctattccactttttttttttttttaaaaaaaaaatcacaaattcattctgaagaatgaaaattcaaatttttgtttatgaaagtgaaaaaaatataacaaatttatctctccattaattttcatatattatcgttaatattcatggaccaaattgttaacgcactacatattcagggacaaatttatcagctctttacccaaaatataatttaatcttcatattctctcttttttaatcagcaaacataacattacaataaacatttaaaaattaggaaaataagcataagttaaaacagacataataataagtataataaacataatttatttgttactctaaaatatctattataataacattaaataatgacaaaatcaagttaggtctcatctttttggtaagaattaacttaattactatgcatttttgtttggtcttatattttggataaattactgtcacattagaaatttcaaagcaaaaatatgagataataccttacctaaaatatgagactcaaacaaattaaaatgcaatcattaaattaatccttacaaaaaaatgaaactcaactttattttgtcattatctaatgttgttagaatataaattttagatcaacatacaaattatgcttatcaatcaatattacatttattattatgtttattttaacttatacttgttttcctaatttttaagtgtttattataattttatgcttacaataattagaaaagggagaataaaatggatagatttgtcacattttgttcactttcaggaacaaaaatttgaattttcattttacgggaatgaatttatcagcactctacatatttaagaacgaaaatgattatttacccaaaaaaataaaaaataaaaagatttagatttcaatcttctattctattttacatgcccggcgatggctactgcaatttagaaccatggactggactcattttcaaaccaattgatttttagagttaaaaaataatatttggggcaaattgaaatatgttgaacacacgatataaaacttgataggacaaggacatatcaattctcacctgaagaagagcaagagctttgcacactcgagttgattgtgcttgagtcatgtttggagctgaaataacagagtatactgaaactatttcctagaaagaagaaacaaatcctagtgagtggtgggcaacaaaggtcaaagaagcacctcttcattgagaaaaaaaaaactaaaaataaacaaattaggagcatgtttaattctctctttttataataaaaaattacattactcaacaatgaatatatcatctaaaatctattaagttttgaaaattgtttttgaaacaaacaaaaatgcatcaaagtacaaccaaattttcaagactatacataaaactctaggatttgaaacaaacaaggtattcaagaaacaaaatattatttatggggctattcattaataaaaaaatataaaagacaagaaagaataaaaaaagcaaaagaaagctaggagtgacaaaaggaatatgtaataataccagtaaaagtgctgcaatggtaccaaaagatttcgacaataatggagcaagatcctcaaataagtctcgcatctaaaatatataaaatattaaccgtgtgagccttgaaacgacgacgcatgtgatatagcatatggaataatggggcgttgtaaatggggtgttatacagtacttaattggactattaaaacgacgaatgagagcggaaaaacgacggaaggtaagtactaccttggagagctcatggagagagtttgctcggagagaaggattgctgagttcgacaacgaggttttccacattcgccatcctgctgcgatccttgccggtggcagaaggagctccagacgacgcgtcgcttgtggaggcggattcgggtaaattcgtcattcactctctaagaaattgtattattatgtgcattgagtgttatatatatatgtgtgtgtgtgtgtgtgtgtgtgtgtgtgtgtgagtgagtctgtgagtgagtggggtttagttcttgttcttgttcttgtaatgccaacttcctaattactattatctatcatgcaacgaaatggtgcgtagtggaaggagcctgcgacacatgatatgatatgctttgcatgcaaactaaaacgctcgtttctatcaccgtgcgtgtccttcctaattctttcaactttatcattattaattatatggaaaatgtttattagccttctcttatgaaattaaaagtctaaagtttttattgaaaaatttaacaatatatttattcttaccaaaacctggaaatttgaatagacgaattcaacttggttccaaactctgatggtccaagtgtgtagagtggttatagcaacaaataagttgttgttgataagagagacacattgttgagtgttaacgtccagttccgtggacacatgtacatttactataacaaggtgatggacacgtgtatatttattataatatggtaatggacacgtgtacaatgcataataattttactaattttgtgcagtacaatatcctttcataatctatacagtaataaaagaacatttttctgagtacgtgtcaacttttggtgcattctcagcttcggaatccagctggcaggttcacaataaatcttagcttcggatgccacatgtcagcgccacatttcgtctcattttctcagccaattccaaacctctgtagggacatgcgcaccctcagctttgttgagttcaacgagcaaccttcagcaaatccgaaccgcgctccaagatttcaaatttcttcttcatcctccaactctttttccttcatcaatcagacaatttctctctcccacgtctcaaatgctgacatttctggttaatcctcacctactattcttccttcacacggttcgtttctcagttactctcttgtctctatcatccattttcactcacctaaaacaacagttcgtttggaaaaccctaaagcttcaccgatgcaccgtcggtgttcaagggccctgcgttgcgctgctcgattttgacactaaggttttcatgaaggagaagattaaccttgccggacataaattttcatctcacacaacagtgtgttctctttcttctctttctttgcgtttcacttcgcttttgttatgtggggttttttttttcagatggaattgagggtggtggcaagggagagcactaccaccaggtgctactgtggaaaacgaggagagccatggctgctgaagaagagaccacaaggttcatttctaccttttgctttctgccttttccttttcctttttctttttctttttttagaattaagaagagggaacaataatgttgtgttggtagagtaaggtggaaaaaatagggtctttacttccgtcggctatggctccagctggataccagtgaatggtattccctctctcaaactttccaccttttttttcttctttcaattgagtgatgagaaaatgacacattttttgttcccctgactactgggtggattccaagttagacatgcatatatgtttaagacttattttgtaaagatgagtagggagtatgacccctaatgattgtttttttcatacataagtacagtagctctgtattcagcaaggaataggcataaaactaataaaaatcttactaatattacaaacaaaatattagtatttctaagaaataataattaataatgaacaagatcagggaaaagtaaaccaaagaacatgatagtcagtcctttgcagcagatacttgtatgattttttttttatatacattcaaaacaccttgaaactatccattcggctttgacttcccaaactgatgactttgctgtttgcccatcgcagaatatcagcatcaattatttccttcccatgcttattggttggatctattgacaaagattttcactaattttttttgtcatggaataggaatctgtaatttgcttttacattagtagttgtggttaattgtggtttctgctttgctgtgattttttgttccattttttttatattctttgtatgtgtgttgtgtccccttttcactaaagatgctattactcgatttcattcagtgtgcgtagtagtattttatattttttttcctttctgccaggtttattaatgtttgttggaatttggaagtaagctaggtatattgtgtggctcttttttgagatttgaattgatgatgcggtagctttgttgttatatatatatagatatattgggtgccttaaaagtttcttcctttttgcattagtaacttgtggggtttctttgtttctcagatgtgggcagatcttattcaaaaggccaaggacggaggtttggatgtgattcagacttatgttttctggaatggacacgaaccttcacctggcaaggtagctcaaaatagaaaaataatggcttttagtttttctttcttgcattcataaagctggtgagctggtgctgtaatcaggcctttgtgtcaggattggtccttatgtctgtgttgagtggaactttgtgtaatgaacgtgttcattgcaaaaaaaattgatgcatctcaaattagaaatgttaataggttttctttgattggttttcagtggtttccctgttgggctaaatgaattgtttgaatatttgctttgtggtatgttaaatgagctttttgttgattgcatgatgttcatgatagggccttattttattacaggcttctgcaatacaaagtatagtggcagagagtgtgtttaaccctccaaagcaagcagtttcaatatttgctgatactcagagcagtgaaatcaaagatcgcatatttgatgaatttaacaatttttttgttgtataccaaaaggtaagtaatctactcgcttccttcccagtggctttaatgaaacaaattattcgttgagtttggactaatttgaagtacttcgcaccatttcttaatttttaaaaaaatatttcattcactgacacatatattttattatacagtatcaagaaataaaacattgctcttttgggccatcagagaatacaaattattttgatacactcatgtgcaagttgtgcaattgtttggtgggataccgattactttaggacgaaatgcatttaaaggattggaacaatggtatgcttggcatgaatgaaaaatcatgtctggtttctctattcttattcacgcttttctttgaaacaggtgtgttattcaatttaatcaaaaaaaatattcataaacttgagtcgtgcatttgcaggatgcagaaattgaaagaagaatccagttagaaacaaaggctaaaagcatattcagaaacttttattactaggtgtgactttccttattttatatagtaatctgttggagtttagcaattagcattaatacgtaatgtggttgtactcccaagagtttgaaggaatcatatgcgtgtgccacatattgtttgaatggtataattacatataaatctgtcttttatttttttaaatttcaacaatgcgcaatgctgtcatgattatgaactgctgaggagaagcttaaacacagtttatttggtgatgatgaaggtatgctccagttgtggtggtttattcttttggttttacattacagtaataaaagaacattttgctgggtacgtgtcaacttttggtgcattctcagcttcggaatccagctgacaggctcacaataaatcttagcttcggatgctacgtgtcagcgccacatttcgtctcattttctcagcctcgatcgcgattaaagttctgggtcagtttgattaggtacagttttcttcaattggactgagctataagactttcacattttcttttctgcttgatgttttgaataaactttttaaatacagtttccacaaaggaagtcattcttgggacaaaaaatggtcaactttttgaaaatgtttctaaaataattgaccctcaatattcagatggggtggatatgtctgaagtgcaggtatcaatgccttctcaataaatgatttttttttcttattgatacagctcccattctaacagaactatgcaattatacaggatgaattctcggtcattataacaacatcattagtgaccttagtccatggcctggaaactaaatttgacatggaaatggctgcaatgacacatgtcccttggggtattcttgagtgtgtttgtgatcaatcaaagttgaattccttaataaaatttagcaaatgattatcattccagacaaagttcattagtttaactgtactattttcttgcaggtatgttaatgccataaatttgatcctgaccactagcattcctgcacttggaagtcttctttcaattgtctactttcagttctttctggataaggtgattgattgtaaagtgaattaatgcatgaaactatggttttttacatcaagactgacattaaggacaatttcttttctaacataataattacaggttttataattaatataattgatttttttttattttgtaaataactttcattttgaatatgtcattctgttatttcatattttttaaccaatcaatagatttcatcattatttcataattacatatcaaacaatcaacaatatttatttttattaaatatattatttatttttaaattttcatcatataaataatggataaataacagtaaatttaagtggtgacattttaaaaaaaatatttatagtgttattatttaaatttaatcaatatttgaaatttttaaactctttgtatttaatttatttgttacaataaccacataataatatttaattaatatattattaaaaaataatagtttaattatttgttattggacaattaaagttaatttaaaataatttatcatggagttttcatatctaacaaacaacattgtgcattggattattggttcattgtaacttttctaattcaactcaaccaaagttgaactctagctttattttttatttttgttaactatatctatcaacatttcagtacattatatttaatattatcgaatcttattatatatgatttttagtaatgaatattttcattacacgcatttaaaatatatagtcaaccaaatcaaaaattctaattttgttttttgtgttccttaactacctctatttgatgttcatattttttgtaattaacattataaacttatgttacaatgtttgcatattatatttcacattaatgaatcttattatattttcttttttcatctccaattttacataatgcgataatatgcatttaaatgtataattaacccgtgcgtattactaccttaaggatacaggtttcacaacggtctgttttgaaggaagaataacatgcaagattatgtttaaccaccggagaaagagtgctaaaataggagctggttggaaagcttttgcacgagccaacaatttaaaagctgacttcgagtttattatggagatttcatacccaagtagcaacatagtacactggtggatgtattgattgcaaaaaacagctcttacctgtcagcttttaaatatgcatgttaatagaaactacatggttcagttagaagttgtctcagtttgtagccactgtctcttaaacttatctgctttatcttgcactatttaattatgtccataagttgtatggataatactatctatataaattgcttttatatttttctttaccttttcgatcaatcttaaactgtttaacgcgataatgtgcataataatatataattaacccgtgcgtaagcgcaggtcaaatactagttttcaatacaatttcaatgattaaaaatttctattttttattctttatgaatttttgtaagtaacttaatttatattacttcaatcttatgtagttcaattaattttctctctaatagtttttatattaataagttgtctaactcacaaatattttacttatatgtcctatatttactataaagttaagtaactcgtgaatgataattacttatataaataactctctaatttaaattaattcaatatcacattagaaacactaaaataatatttaatttttttaagtaactctcattatagatgctctcattattatatagattaaaatcaaatttttaaaaaagaaatggataattgttttattaatgaaataattatcaataataaatataataaaaaataaaaaatacatgtgtttgaaatttttaattttgatgaatttaaacatgagtttaattaataaatattaatttttatataagtatacataaaatgtgaaaatgtaaattaaaaagtaaagaattgttgttttattaatgataaatataaaataaattattaaatatatgtttaaaatttgtaattttgaaataaaaatatttaatgttaattgaaaaaataaatattgatacggatagataaggaaattaaaaaaaaatgaataaaaaaaatgatataaaaaatatgttatgaaatgaaaaaggttgaaggggaaatatttagtgtaaacatttaagaataaaatatataaatttgagtcatataacgttaaataattaagattaaaaattaattaatagtcacatgatgattttaatttttaataaattatctttatttatcttttaacaatgatcatttagatattagctgatgatttacatttgttaggacaaatgataaaacaaatctttcaaatgttttattgatttatgtgaaggggtttagttcatttgattaaatagagtctttgagttatcgtaaatttttttttatacttatcaattttcacgaataaaaagtatattttgaatgatcttatattaagagctaaattgactaaggaaatgagtcataatcattatggagaacatgcatggtccaacaatcttttatatttaataactatagatagtattgtcattaacttagccgttttagaaccatccatgattggggaactcattgatccatttgcaactccttagaaatattatctgaataatatttctttctcatacttcaaatgctttgtagagtgcttaataaggtgttcttttaatagtttccatacctataagattattaacgatatcctttttagataatgttaataaattccaaaattcattatgtccttcagtcaccactatagtaatgacgactatcttttctattggtaatgtagttgttctttggttaagtattgaaataacattacccattgagaaatccctgtattttttaaacttacaaaattgattcaattttaaaataaaaatagaatgtgatgtgtattgtatatttaaggagaattcttttaaaacaactaatttccaaatacatctatttcattttagatctattctaaacatatgaatttgttctaaatatttaaattacatattttcttattgtaagtttatcaaaagaaagaaataatttctttcaaaagatcatgtgatacacttgttacaaagactagtggtgacagatttggataatacacataaggtcatagtcgtaactaggttcgaactttaatatgatacacgcacaaaaacttattacgaagaaatgatataatttcttaaacaaggagatagcaaaacacatttttttaaattaattataatttcatgtaacatcttcatactgattttctagttttttttattaaatattttttctatttttaaatattatataaatttattatttataaaatatttggaagactaattaaaagtatcatttcttataaaagagtgaaaaaattaataaaaataacagataaaaaacataaataaattaagaagtaattttaatataaataaaaagatattaataaggacatatattaagtggtctttatatatatatatatatatatatatatatattcttaactcgtcttctttgttcgatataataatgaaacaacctaaaaggaaaataaattactatcccacaagtacaagtgaatgtctacttcattttttcaattaaaaaattcaatcatattattattgtatcaaaaaaaaaaagtcatgacccacctactcaatgagagcaagatgtcgtccaaacacgcacttctaaaaggaatttgacttggttataaaagaaaatctgaaggaccggacttggaatgaagtgagacagggtgagagtgacttttgcggaaaggggaggagataggggggttaggatgggccacccccaaattttattaatataaattttattatatatattaaaaattaaaaaagtaatttaataataaaaaaaatatattacataatataataggatataatattttttaatattacattaaaaaataggataaaatatttttgaaactgcattacataatataatagaaatctttaaaattacattacataataagataaaatattttttaagattgcattcaaatatagtatataatattttttaatattgtatcaaaaataggataacgaatgataagtattataagtgattatcaggcaaggtttttaatttcatttgcaatgctgaatcaattcattatgatgaaaatgaatgacaactattataaatgatttttagaataagccttcttttggcacatctcatacaacatagtcactggttgaggctgtttctccaaagcatccgggtgtcactattgcctccaaaacacccctcacaatcacaattattttcacaaaccaattttcatcagcagtaaagtttacgcaagccaatcttggcagtttcaagctttgcaagatccttttgagaaaaaagaggagttcctcaaaccagttcgattaacgcttcccccttatcttccacgtcaatatccaatgctttgggcattagttgctaatttgccatctttgtcgctgaccaccaccatgagatgagttcctttttttttctttctttttttctatctccctgacacatttagttcatgattggcggtgtgtatgttcttggatgttttatattgtgtgtttaggtctgatttgatcaacgaggtatcaatgggttttgattgaggagattcttctattggtcaactgaattatcgaattggttccttactcttatcttggtgagttttggacttgtttggattgatgaaaaagaaatagaatgagataaagtggaatataatggaataaaatttccagtctattggttgcatatattataatagcatggaactaaatttacattctattatttaaaagaaaaaaatgaataattattttactctcatattatatttaatctctaacaatctcctttacccatatagatgaagagaagttttttatttttgaaatatatggctcattatgattttaatatttgcattcaattaagaggtgactatgctcatcagctcatgtatacttcactcttaacatcaaacggaaagatagttcccttcccattcaattcttcattctctctatacatgcccaactgaaaatcctattttatatatgtagaaaccccagaaagtcttgttctcacgaccccgtcatatgatcggatcctcctccaccttgttgtgcaggaaacggattgactctaatattatgaagcaactgctgtagccatctcctagctgttgggtgttcctgaataaataaaaccaaaaccataaaaaaatgtaaacatcctaaaaccataaataatgccctattgttaatcttcaattcacgtaatcaactcacttcaatcttattgattaaatcaaatttttatactaataatatcacttacacgaaggcaactactgaatgtagcatctcttaacacggctggaagacaggttcttaatgcatgacaaactctgttttgaaatgaccaaagttttattagaaacttgggaagaacgtaaaggacatgggcagaactgcagaagcacttataaaacggcaaaaaaatttaaataatgctattttaataagaaattacgaaaataatgcattttgaaatcaaattacgcatctactgcttccattcgcgcttgagctgaacgtgttgaatcacatcatgggtggacgtgatcagaaagcattcacgggcacctgagacgtgttgagttacgtcaatggcagacgtattcagcgttcaatcacgtcttgcagggacgcaacttgcactgcatcacgtcgtggggagacgtgttccagctccattcacgtcctagagggacgtgtatcagctccatttacgccctgcagcgacgtgatcagtccccattcgcgctccccagggacgtgtttcagctccccctttttatacacccacaccccagccacacttgccactgcctctctaaactctctttctctcaaatttttttctctcatttgaagcaaggaagcaaggaaagtgcaaggaaggtgcaaatagggtgcaagcaaggaagcaagaagctctatataaatcaagttagtagtagtaaaatatttttatttcttttgagttacttgattattagttagtgacttaaatgcttactaggttagttagttgttagggtttaagtagtgacttagattgttaaatagttagttgttaaggtttaattagtgacttagattgttaaatagttagttagtttgtgagctaggttaattgtttgttattagtttgttacttaaattgttatttagtgacttagagtattagatagtgacctagattaggacctaggtctatggtttaggtaaatattttctatggtttaggatacaagtgggtgacctaggttacttgttagttgttagggtttagttagtgatgtagatttttaaaatagttatttagtgggtgacctaggttaattgttagttgggaaaaaaattaatgaattacaatttaaaaaagactacaaaattgtagcaatttgaaaacaaattatagaattaattaattagtattaattcaataaaattttagaaaaaaaattaaatacaattgttttgttaaaataaatgaattttttatatgtgaacataataagtatttatatcactccaccaattctatgattatataaagaataaaattgtattcaaattttaattcataacttcctaataagaaattaaatatgcattaaataccatatattatttaaaatagttaatttaaaatttaaatatttaattctataaaataaaagaaaaaaagttgtgaactaacaatgtaaatcatcttatattattatccaatcaaaaaccatcctctaggataatcttattggctttttataataactattttaaaagttatattaatttttttaaaataattgtttataataacattgtaattttttacattaataatcatcaacgttaaactctaaataaaaaagcatgtagagtcatatttcattttctttgcaaaatcataatttaaagttattgtacaaatgagcttgtattttatatttttttttttaatgaaaattgttgacatacatagttaatattgatgagatgactaattgtgatgacaataaggtatatagcatattgaaacacttgtgactagaacaaaaatagacctttttatcgttggtgagttagattattagagagtgacctagattacgaagtagattatcagatagtgacctagatacataataaatttgtaaaaataatttgttagttagtgaattaaataatttgtatttaaaattagggtttatattataatataattataaaatgtgtagcatattattatggctgagtcatcgtcatctgagtcacctcgttctggctctgaccgggagcatgagcctatcgatcccacaacgcatgttcttcccggtccatatagatgggatgtacttcgaaggcggaggcaacgcactcacatttcacaggcagtgtggaatgaggacacacagagagagctgaagatacgtcgcacaggtagactcattggtggaccccgacacgacgatatccatgcaggacgtgtctagggcaaagtcacgcccagccaggacgtgttccagcctcatttacgtcctcccaggacgtgttttaacacgtctcagctcgacgtgttttaacacgttttgtccagacgtgtttgaacgcagtagatttgcaattacatttcaaaacgccatattttcgtaattttttaattaaatcgcattatttaaatttttttgcccttataaaactggagttactatctacttaacaaacctctgattttctgacagacgaagataacaacgaataatgaccttcaaaagactacacgaaggttgctgaacaagagttaccaccatcgttccgaaaactatatatacttgaaaaaggcgccctgctgaagtacaaatatgtttcataccattttcaaccgacagaatttgttcaactataaaggttccaacatgcagttggtggaacttccattagattacacacaaattttcccattacaattattttgataggcataaaaagaggatcacgagatagtggcaaaaacaaacacatggcttagcatttacaatgcaccacaagaagtacaacgcaagagttaaacagacgtgttatttaaagatttagatctcaagtatcaaggacggggtatttcaacccatgtaactacaaatactggtgttgagttgcattttgatacaaccaagaggagtgtttgcaacactcttaaaattctttttattttttattagtttaaatttattgaaaattataatagtggttcttacttctcgtttgatgagtctctgtcctaatttaaaagtggaacttaccaaagtttgtgattttcaacaaatttcaaccaataatagaatgttaaaaggagtattgctagcactcttctacaaccaaatatgtcaagaagagtttcaacagtcctgtgataaccactaaaaaaacttatattaagaccaacatttcaaaagatgaaaaaaaagagagttcttaaatgatatccctccccaagttcacatagtatccatttatcttatgccaagaccactttcctcagttgtaatctcattgatcagataaatggtatgctaattgccttacacctcctatgtagcattgtattggaacatgcttcacatgcatacatgttcatcatacatacccaaaaaatgtaactcagaaaaatgaagcaaataaaaatcaagtttaattcatccaaataaaatattttatcgaaccaaattggtttaaaacaagatcagtaaacttacagtttttgacaattcaccgcctatttgcatactatgcaggcaaagcggaagaaactgttgaaagaaggaaacttatagctgctgtattatgaaactggtgaaatatcaacagaaaggaaattaaacacatgacaaaattcaagtataaatgtacatgtgacaagcaacaaaaaaaaaaaaccaatagcttcatcccactaggaaaaaaaatcaacaatatcttgaagggcataaaatagttcggaaaattttgttccctgatactagcgatgaactaatccgaacaacttgagttgtatgtacctgttacatcatagaaaattattacaggaatgaatttgaaacttaacaaatagttgaaaatctacatgaacattataagattataacaagactaattatttgtggcaactaaaatatttacacatttacctgtgtgccacagatttataataatcaataatcagttattactgttttttaaatgacatattagttgaggttattgtagtatttagttttttatggcaaggtttattgtgacaataatttactaattgaaattattctctgttcagcataaatgttgtataaaaaattattcttctcatagtctagtgtattcaataacagaatcagcaaggacgtagtaccttcactaaggcaccaatgactccaagactggtaagcctcatattctcaaatggattggccatactggttgtattaagcaagggatacatatatagaggtatacgagctgcagatgagaaaaaggtaagtgtaaagagtgaaagagtcatatctttttccttaaagtgttagtttcaatgagcaaaaaccctgctgaaacggatatggtaatgtcaaagcaatctccttaattttatattaacaaaagaacaactaatatgcctttcaattgcccaaaagtttctgtccatggatgcttatgaaagtatattggcagtaaaaaaaatataagtatgactgaatgctaagaaagaagaacaagtggtatgacctataaattgaaagggagagaaacttcattttcaagtaagataaagtagaagtcttatgataagatagagagagagcaagttgcatataaaaattgactgcatgattctgttttataggcagaaaacattttagattatgtatgtatggtcttttgaccattacatttaatccaaattaattggaggttgataataaatgaacttaatgataaatacaagaaagttaaaaaaaaaaaaaaaggagaaggagaagaaaaagagaaaataaaataaaaaaaaagaaaataagataaaagaaaagaatggtaaaagaaataggagagaaataaatgcaaaagaaaacttataacaattttaatcatcttttatgaaattttatagtttaacaaattatttcttacttttaaattgtttgcaattggttgcttttacaatatcttataacaattttaaataaatgcaaaagaaaatttattagtgagaaaaaaagggaaaatatatctaggagatgataagatatcaacaatcattttatatgtattgaacatataccgtacaaaagcaaagtttgggaacaacatcaaccacaaaaatacatgaatcatgcaatgccgtttgactcagttgaagaccaaattttcaaagatactatttatcataaataatattatttaccaaacagaagttcacggtccttcaggtgaataagaaaaaatatcattaccatggaggaattccatccttatatcggggtgagatgccacacactgtaagatatccatgagagcaaaagatatgtgttagtaagaacgcattgaagaaaaggagagaaagaccagacaaagtatatgtgagtggacctgaagaagaacaagagctttgcacactcgatttgagtgtgcttgagtcaggcctggaggtgaaataaaagggtatgctgaaactatttcctggaagaaaaaaaaatcctagtgagtggtgggcaacaaaggtcaaagaagcacctcttcattgagaaaaaaaaaactaaaaataaataaattaggagcatgtttaattctctctttttataataaaaaattacactactcaacaatgaatatatcatctaaaatctattaaggtttgaaattgtttctaaaacaaaccaaaatgcgtcaaagtacaaccaaattttcaagactatacataaaactgggatttgaaacaaacaaggtattcaagaaacaaaatattagtcagtatttatggggctattcattcataaaaaaatataaaaagacaagaaagataaaaaaaaaaaaaaaaaagcaaaagaaagccaagagtgacaaaggaataagtaataatacctgtaaaattgctgcaatggtaccaaaagaattccacaataatggagcaagatcctcaaataagtctctcatctaaaatatataaaatattaaccgtgtgagccttgaaacgacgacgcatgtgatatagtatatggaataatggggcgttgtaaatggggtgttatacagtacttaattggactattaaaacgacgcacgagagtggaaaaacgacggaaggtaagtactacattggagagctcatggagagagtttgctcggagaaaaggattgctgagttcgacaacgaggatttccatatacgccatcctgctgcgatcattgccggtggcagaaggagctccagacgacgcgccgcttgtggaggtggattcgggtaaattcgccattcactctctaagaaattgtattattatgtgcattgaatgagtattatatatatatatatatgtgtgtgtgtgtgtgtgtgtgtgtgtgtgtgtgagtgagtgagtggggtttagttcttgttcttgtaatgcaaacttcctcattactattatctatcatgcgacgaaatggtgcgtagtggaaggagcctgcgacacatgatatgatatgctttgcatgcaaactaaaacgccccgtttctatcaccgtgcgtgcccctcctaattctttcaactttatcactattaattatatggaaaatgtttattagccttctcttatgaaattaaaattctaaagtttttattgagaaatttaacaatatatcttctcttaattttcaatacaacttcaatgataataaaaaaagtctatttttttattctttatgaatttctctaagtaacttaatttatgttacttcaatcttaagtaattcaattaattttctctctaatagtatttatattaataagttgtttaattaacaaatattttacttatatctcttatatctattataaagttaactcatgagtaataattacttgtataaataactctctaattttaagtcattcaatatcacattaaacacattaaaataatattttttttaaagcaattttcattgcagatgctttcattattatatagattaaaatcaaatttttaatccttatgaaatagtttactggtaagagggagtatttattttattttaacatctttgactgtcaatctttccaataagaattatttaatgtttattttaaaataatttaaaatacttgacaaggtttatttaatatttttaatcaatactcatgaaacgacataatatatatgttaataaatatcaatcaattgttggtcctagtgatactggggcaatgccttcatcctcttaaacatgtcttgaattcaaatattgtaatgtaaaaaataaaagtgataacaaagaaagatacactaatcaatcaagttttcaataaaattagtcactgaccaagtcggtaattctatgtacaaataacatggtattaaaaaaatatgttaataaatatacatcaaataaggaaaaagataacttaaaaaggaaatgaataattgttttattaatgaaataattatcaataataaatataataaaaaatacatatgtttgaaatttttaattttgaaaaattttaaacatgaatttaattaataaaatattaaattttatataagtatacataaaatgtgaaaatataaattaaaaagtaaagaatggttgttttattagtaataaatataaaataaattattaaatatatgtttaaaatttgtaattttgaaataaaaacatttaatgttaattgaaaaaataaatattgatatggatagataaggaaattaaaaaaaatgaataaaaaaatatgttatgaaatgaaaaaggttgaaggggacatattcagtgtaaacatttaaaaataaaatatataaatttgagtcatataacctcaaataattaagattaaaaattaattaatagtcacatgatgattttaatttttaataaattatcttcatttatcttttaacattgatcatttagatattagctgataatttacattggttaggacaaatgataaaacagatccttcaaatgttttgatttatgtgaaggggtttagttcatttgattaaatagagtatgtgagtaatagtaaattttttatattttttcaattttcacgaataaaaagtatattttgaatgatcctatattaagagttaaattggctaagggaatgagtcataattattatagagaacctgaatggtccaacaatttgaatttgaacggttttgatttgtttaaatacatttaaaattatttttaattataaaattaaataacctggatgaatgagatatagtgtgtattctccttaaaagaacaaaacaaaaaagagcataggttgtgcattacaaaactaaagatgaggtattagacgataattcaaatattggttaactgataacttattggctaactttttctctcatatagtaaaaatgtttaactatgtttttatccttgataattttttccttttccttgatatttgaaaagttttgttttagatccctaccgtaaattaagtgataatgtgtttattaaatatttgataagtagtgaatcaaaaatcatcgtacttgtttaaaaatcaaatttaaaatagatctcaattttttttaaaagagaaggttcattccttctccctcctctttcgtgaccaccttctcctctgccaccttcaaccactctcgtgtcatctatgtctccattgatgtcgatccgtagtgggccctcactttgtcaccatcgtgggcatctgccaccgcagtcgcatgtaccaaatctcccgtgtcaaattcccgtacacaccttcccccatcgagacaaccatcgagggaggcacgatttgagtattgtgttggaataaaaatgattcatgctcttacaaatggaattggtttgaagaacgaatggcagcttgccctttcaatttcgatagtcaagaattctagcaatgacttcaattgggtgttcaagaagggttccttgtttgcacaaaattgagattcatagaatagtgtgttgcgtgctggcttgattccaatgaaggggtaagaaccacattagtattcatggcacgatatggcagaacttcgacaacgaagcaataatgaccactcatccttcaaccccttcatcatccttcgcaacggcagatgaaagttgtggcagatctggattcgtgtggtgcaacatggtagatcttcaacaaggtcgcggcgatgaccaatcccccttcaaccctgtcattttcctccgctgtgacaaacaaaagttgctccaaatctagatttgtgtggttcccaccatgttgtaattattgttgcactggtggaagtcgacatcgacgctaatggtgaggaccaaattattgttgtttgatttatttattttttactttaattattatgacgattcttaactgtaaaaaaattttaatttgattttgaaacaaatactgacgatttttgattcatcacaaatcgtcttatcaaatatttaaagtgcacgttattacttaactaacgacatagatctaaaataaaaatgttcaaatatcagggaacatatacatcaacatcaacaacacctttaatctaacttaattggggtcaatggtagatgaatccaatgataaatcaaaaataaggaaaaagggagagaaaaaaagctaaaataaaagaagggagaaaagaggaggaaaaagactaaaacaaggaaatgacgggaacataaaactactaatatatatcaaagataaaaaaaaatatttaagtctaataaaaaataccaatcaattttgacaaattcttgaacaaggaacattgtcgaatccatataaaattgtttgtgttgtaagtggaagtgtggaaccaaacaacattataacaaaatgttgtaatgtgatttaatttccttatagtgtgctattcttcttcttttaatatgcatcaaatgcacccaaatccaatctcaattttgaaaatccatattttcaactgtgtatttcttaagacaatgatttaaatgtttaggtttgtttaccattctttttggtaatagagtaaaacaattttaatagtgaaattgtatacagtacgttttttaaagattaattatacatgatgatggagtagtcatcatcaattaaaatgcaaaatgttctttcgttccttcaagcttgaaatatcactttcgtttgatatgtgtggcatttgatggtttattttcaccaatattcttcaactcccttgcatattcaaagacaaccaaaatttcatattagtttcattcattcatggtcccatctcaaaaacattgacagatatatgacaaaactaaattccaaagtaaagattaaccttatcttctaaagtctaaacaataaatgaaggtaaaaacttacaactaagatatagatttcaaccttccattcgcatccctaaggtccacaatcacatcaagttggcagtatttgaagaaataatagaaaataaaatgtataagataatcacgtacgatcatggctttttggtgagaaaaagggtgctaggagcccatatataaaactgcaagctaaactgaataaaataacagaactagatatatcaacaaaaaactaaatcgaaataaatgaagaaagacaattctcacatcaaagatttgtctttttcttttctgaagtgtggagtacaagaatagaattgataattgagttcatcatgcattatttaaaatatatataacaatggagatcgagcacaattgaagaactcatatccattcttactcaaagtgtgtgcaagcatatgagtctaaattaagtaactgcaaaagattcgtcttgtgtgcaagcaaaagagacaagtcttgtgtgtgcaagcaaaatccattggatgatcttgtgtatatttttagcatgctgatcatttgtagcctgctgcatgcacaatgaacaaaacttctgtttttcgatttaacaacatatgaacccattgaatggaagaatctacactaaccagagatgagagatgacttgatgttcggttgagattttgatgaaaaaaaattatgcaggaaatgcgggagagttggagaccatccgaactacatatatattaaccatccagtcatccacttataacatactactatattgaaagtttattaaaaaattcttaatcctaggctagaaattttaatctttgtttacaacatataaattctaatatttaaattaattaaaataataatattaacaagtgagaataaaaaatcattattaatatagttgtttgtcctatttccataaaataaattaaaaaattattcctaattttttcaatattttggatttaactgtgcagtcagaattttaaaattctaacccttacattaaaaatatactaacattaaaaaaaatactaatgtactcttttaattattatatttttaggaaaaagagtatttttgggcaccttaaattttatctcagcttctacaaatagacatattaaattttaattttatcctagttgattcctaaactttatctagataccatgaacttaaatttcgttttaatctttttttttgtgttactatttaaacatggatttgtctatggtgggaggccgttgaatgtctcctctaatttttataatccttgagtttaccgaacatcttatttgagtcaaacatatacaagtgaaaataaaataattaattagaacagtttaagacctacatatgagaaaacaaataccattagaaaaatatcacatgcatatctaaagctaaattaattaatgaccaaagtttagaggagggggaacatgaccaaattaattcatgataaacatatagacttaactgaggatgaatgtggttactaaagtgaattggaggatcaagaaaattcttgaacattcctatgtatgtttcacaatcaattgcttaaaagtatgacatatatatacatagaatagtttctttatattaattttaaaaaaaggaaaaaaaatccacctgaacttttgggcattgaaccaggcaacatagagaaggataagatgccctgtcgaatgaggtttagttgttttaagtgtgattcatgtatatatacttgttctctcatggcctcagtagccatgtaatatattgaacaacttcaacttctttatttaggttctaaatatttgaaaccttaaatttacattaatatcttagtttaccactacttgatttgccctcgttaagatatcttattttggaactagattataattgtctatcaggtatcttagagtcataaaggcacatcccttattttatgtagccattgaactattattggtttgtttgattaattaagcatatttatttttatataaataattgcgtatttagatttccagcggcatatattcatttattttttattatatgttattgccctactaagccaaagatatttcttttaaaaggaattttattcatgtttttttataactaaacaattttttttttcaagacgaaaattttgccatcatttttataaaatttattgcaaggcgttcaaattatgttgagataagtttccaatgattaagatgattaagtcctaactccgacttggcaggtccttgcagaggtggaacacatgtcaaatgataaagcacatgtaaataaagcaatagatcgaccacaaaataaaagctgggacttcacatgtaattaaaacagtgaaccacataataaaagtcataatgtcactcgtgttttaagaataaaaactacattgtaaagttacttaaatgtacattgtttctacattaaatagataaagattatccgcctttataatcaagagccattttgggcatgtttggattccaaataaaattgattttagtctaaaaaattatgataaataattaaaaatgaagaaactttcaaaaattgttttacttgtgacaagtaagatgtggtgacctacctaatcaaacacgcactgttatcatgtatgtacgggtatattatatatatatatatatatatatatatattttaatgtttttaatttttttataataaagtaatttatattaatactttttgaaatttcataaatttattttgctatatgaccgttaatatttatttatatataatatatatacctatttctgaatattttattattattcatttgactttttttgaaaatatatttttatagaatattaattaaatatcaaatttatgtcataaaatatatgaaaaatctatttattcatatatttatattaatattatactgataatattaaatgttatattaatattgtttgtcaaatatactttattcaataatttataaattaatatattcaaagtcaaaaaaataaaatatatatatattaatatacatttaatttttttttttttgtgttcaagctagttttataaagtaattttataaaatatcaattgattataaaaaaatgttttgtcttttgatagtaatttttactcttccaatgtttggtgtcccagaactcttccacaagtgggccttctgggcccaaagccaaggccttttcctcgctcagaaccaccgccaaaatccccacacaccccgctcccatcatcacaatactggaatcatgtttcagtaatggcaaacttaataaggttgattcgattggattatctgagtttgatatttgaaaaaaaaaatcttgatcaaactctatttatcttttcatcgatcttcaaataattagagttcctttcttctaataaatcaaatgattaagacaaacaaatattctttctaaaaatattattgataatttttaatcttgttatccttgattattttattattttttttctttagattgttctattattttttattttaatacctttgctacaaaaagatgtcttgtgtagttatattcaatgagagcaagatgtcgtgtcccacctactgacatacctacacaaacacgcacttctaaaaggaatttgacttggttataaaaagaaatctggaaggaccggacttggaaaaaagtttgtcgatgagttgaagtgagacagggtgagagtgagtgttgcggacaggggcggagataaggggggcgggggctagggtgcaggggcggatccagaaaaaaaattagtgtgtggttggtgcttaaaaataacaagagtgtggtcactgcattcatgaaaattataaatataccgattcacactcactcatctcttatttttcatcttttttattattttttttctatacttttcaatttctccttgtgaaaacatctaagttatttttttattttactttattttattattataaaaaaattacccaaaaatttttaaacatattcttgagaatttaagggggggcactgtccccccaatctatagcctgcgtccgcccatgctagggtgggcaccgcccccctaaaattttattaatataaattttattataatattaaaaattaaaaattaaaaaagtaatttaataataaaaaaggttatatcatatgatataataaaatataatatttttaatattatattaaaaaagataaaatatttttgagattgtattacataagataatataataaaaatctttaagattacataaaatattttttaagattgtattcaaatatagtatataatattttttaatattgtatcaaaaataggataaaatatttttaagattgtattgcataatataaaatatatttaaaattgtattgcataatatgataaagtatttttaagattacattcaaaaattggttaaaatcgtatgcttaaattagtataaatcgaaacatattttgtggtaatcaattcattacgatgataacgaattataagtattgtaagtgattatcaggcaaggtttttaatttcatttgcagtgctgaatcaattcattatgatgaaaatgaatgacaactattataaatgatttttagaataagcttttacttttacattgaagttgctgtataattcaagatgatgaaaaaatggtttgtgaaaataattgtgattgtggcagataatgaggggtgttttggagccaatagtgacaccggatgctttggagaaacagcctcaaccagtgactatgttgtatgagatgtgccaaaagaaggggaagcatgttgatataaaacaatcaagggaaggacatgcaagtgttgctaaggtgtttgttgcctcctcttcttctcaaaaggatcttgcaaagcttgaagctgccaagattggcttgcgtaaactccctcatgtggtgccttccaccgataagtttgccactaacatgaagctcaattttagtgctgatgaaaattataccttgatttccataaattatggacttttggggtgataaggaattggaatgcatcgttcatgataatagatccacgtggaagatgggacaatgactatgtggtcgttagttcctgccactagtttttggttggatgatgttgtttgttgggagtttcattgcctcacttctcatttttcagttgagtacataatataaccttatactatacttgaacacctatcacaggtaaggtaatctaactatgagtttggaatgattaattttgatgcagggttagtttgataatatcatctttaaagtacatattattagaatgtcttgagtaagatgtcatgtcccacctattcaatgagagcaaaatgttatgtcccacctattcaataagagcaagatgtcgtgacccgtctactgacctatctacccaaacacgcaattctaaaaggaatttgacttggttataaaaaaaaatccggaaggaccggacttggaaaaagtgagttgaagtgagacagggtgagagtgagtgttgcggagatggacgtgtatatgcttgaggaagtacagaagataaaaaaatgtaaacatcctaaaaccatgaataatgccctattgttaatcttcaattcacgtaatcaactcacttcaatcttattgattaaaccaaatttttatactaataatatcacttacacgaaggcaactactgaatgtagcatctcttaacacggctggaagacaggttcttaatgcatgacacaataaaaggtgataagaaataaagacacaataaatgtagtcaatatagtttttcgataaaattagtcaccaacaaattagatagatctatgtatgaaaacatggtattaaaaaaatatgttaataaatatacatcaaatatggaaaaaatataacttaaaaaggaaatgaataattgttttattaatgaaataattatcaataataaatataataaaaaataaaaatacatgtgtttgaaatttgtaattttgataaattttaaacatgaatttaattaataaaatattaatttttataagtatacataaaatgtgaaaatataaattaaaaagtaaagaatggttgttttattagtaataaatataaaataaattattaaatatatgtttaaaatttttaattttgaaataaaaagatttaatgttaattgaaaaaataaatattgatacggatagataaggaaattaaaaaaatgactaagaaaaaaaatgatataaaaaaatatgttatgaaatgaaaaaggttgaaggggaaatatttagtgtaaacatttaagaataaaatatataaatttgagccatataaccttaaataattaagattaaaaattaattaatagtcacatgaagattttaatttttaataaattaccttcatttatctttcaacaatgatcatttagatattagctgataatttaaatttgttaggacaaatgataaaacagatccttcaaatattttgatttatgtgaaggggtttagttcatttgattaaacagagtccgtgatttatcataaattttttttatattatcttcaatttttatgaataaaatatatattttgaatgatcctatattaaaagctaaattgattaagggaacgagtcacaattattatggagaacttccatggtccaacattcttttatatttgttttctagtaataattatatataatattgtctgtaatgtggacttagcagttccaatccatgattgagaaatcaacgaatccatttgcaactcctttaaaaataaatattatatgaatgatatttttttctcgaatttcaaatactttgtagagtgctcaaaaggtattttttttaatactttcagtacctaagagattattatcgatatccttttgggagaatgataataaattccaaaacttattttgtcctccactaactaccactatcttttctattggtaatgtagttgacctttggttagatattgatcatgaaacaatattatctattgagaaatttctaactttaaatttttttaaacttataaaattaattcaattttaaaataaaatagaatgtgatgtgtattatatatttaggaagaattcttttaaaacaactaatttctaaatacatctatttcattttacatctattctaaacatatgaatttgttcatccttattgtaagtttatcaaaagaaagagataatttttttttcaaaagatcatatgtgatacacttgttacaaagactagtggtgaaagatttggataatacacataaggtcatagccgtaactaggttcgaactttaatatgtacacgcacacaaactcattacgaagaaatgatataatttcttaaacaaggagatagcaaaacacatttttttaattaattataatttaatgtaacatcttcatactgattttctagttttttttcttattaaatactttttttctgttttgaaatattaaataaatttattatttaaaaattatttggaagactaattaaatatgtcataataaatatatcatttcttataaaatagagaagaaattaataaaaataacagataaaaaacataaataaattaagaagtgattttaatataaataaaaagatattaataatgacatatattaagaggtcgatctatatatatatatatatatatatatatatatatatatatatatatatatatttatatattcttaactcgtcttctttgttcgatataataataatgaaacaacctaaaaaggaaaataaattactatcccacaagcacaagtcaatgtctacttattttttcaatcaaaaaatgcaatcatattattattgtatccaaaaaaaataaaaaaacacattattgaggcaatatattcgacgcgtgctgtaatgctcatgcatagatactcacatacacacacatatatatatatatacacacatatatatatatatatattaggcttttgcttctggctctggtttgttcttggctttgtttccctgcttgtgcttcaacatgaagaagctaatccacgtgaaaacctccaaaccaaatgcgatggtacccaacaaagcaagatttccaatgtatccccacttccatgcatctccaccttccaaaatggtaattcctttgaatatgtttatgaatatgatagccagcaatccataaccaagaaaatgatggtacatattccaatatttccggtaatcatccgtcaccttcggcttcaagcgaaaagccaacatctgaaaaccaaacacatatctttcatcaatgtatatcctaatagagattaattaatgcaattaataagaatgaaattaaatcagtttctttattttttcccccgttaaatctatatatgaataggatttagcgatgtaaatcgtaaatactataaattataattgttggttagaaaattaatagtgggtgactaatttttttaacagataattcagcccttatattattttggtaatataatggtagaactatcgaatattcaataataataaaaattcttatactaaatgcattttagaaagcaaaaaaattaactacatattttaaacttttaaaacagatgtggagcatatattaattaaatattttagagctaaacctaattactaaggaatggatctacaacttaaccaagggtgaaagcacatgcttttgagggatatataatttaaaaaattaattattaaatctaaataggttccttttagtgttttttttctttaaaagtattttttaatctattatgattttctcttttaaaacatagacctttcatcatcatttaaaagtatgcttcttatattaattaattttaaaaaaatattttaattccctttagacctatttatatattaatcccacacgtaccctaaacggactatccatctacaatctcctttatatatctgtataatctatattcgctttattagataattaaatagctaattttttatgatgatatttgatattgtaaaggtacatgatatatatatatatatatatatatatatatatatagaaagaaagaaagaaatattaattaattaattacctggactgtgctaagggtgaaaatgagaatgccatagtttcgatgagtgtggaaggtgtagtatcttgaagaatggccgagacttaacccaatagcccatccagtggtgccaacgagaaaaccagttaattggcaaccaatgtgcaggttaaaccacattggctcccatttgaaaggaaacacccgaaagtaccttgcagttataattccaatcggcaacagtgttccccacccgataatgttcaggactccatgtacctagattaatttcatgcacaaccataagtataaattaaatgtgcctcttcaacacacaggaaagaaattaatcattctcgtatgagactaatcctgttgtttatttcttatttgtgtaacaatgatcacctcgattgtataggtatatttaccagagtgattctattaattagaaaaagaaaaatgtatatcaatctaatacctaattaattagtagttagacatgtgggaagttgaatttgccattcttctataaacagaacaaattcaatattcttgaaaatatctagctatctttaaagtttttttaattttaccagtttcacatgcctaattttcattgaaatactagtgaatctttgaatagttaatggtaacatgttgatccaaattcaattcaaacttctaaaaccaggttcaaatttgataaacaccagacttttttttagcctacattagatcatgatcgaattacactaaaggatataaattttaattcggattcaaaatttaaaggtctccctacattttattgagtgaattcggcctaaccgagtttgagtcatgccattttgccactctttgtgtaatgaacacttaccatacacaaacacttccaaaaagttaatttaccaataaaataaaatataatttggatcaaagacaagtaagattggtaaatttactattgaaatgatgacatatgttcatgatcatttttttttgaaccaggtatacctttgtcgaaagtcaaagaccatgaccatctttacctaagcattattaatcaaagaataataaaaaaaaaatagctctcgcgtaccgatctaagataactccggtactgtccagtgctgcgaccgtttttgtcagtcaagtctatgacctctgtgctgtcgacattccgaagagttgttggatgtttcaggggatgtccatcgtcaatgtcaatcccaacttgccacacatggttcagcttcgtaacgttgtacacatcagaaggaaggaccaatgtagcatacatggtgttcatattagcgaccttttcaactgatttgttgttcacaaacgcgattttcgacggaagaaggctgcaaccgtgtctggtctctttggtgacgttgtatgtgtctactttccacgttccgtcgccatgtttaatggctatgatggctttggttccaatcatctcaggcctttttcccgggttcacaccccacgccatccacccttgtgagttggggagtgtggcacggaacataatttctagttctatggattcattggtgagactgtggtaggaccaagcaaactctgcccccagagtgcgcagtgtcttacaggctgagatgttcttttgttgggctagtttgaggaacgcttcactgcagggttgagcatcgtggccaagggcgaaggagagaaaagacagtactgtcaaaatggttaatggtaaggtgagtgaagatggcatgtttttttgttgtctcttcatgtgtttctttgtgttgggaaaatgtgatgcatagagagatcttatgaaggggttttctttcttctggatggtgtttaatacagtacagctagttgcgtcatgttttttacttgctgggttgctgcagagtcacttttgctctttattagtctctcaaagggattgattagtactggcatacttcccaaagaggataagaatttagaaacttcaaactcacgttcagaccgcaagtgcgtttttgttgatcacacgctttctttttgagaaatagtgtgctaaatttaacaaaggtgctaattaattactaactgtgcgaatcaattgttgcgaaattattttagcttaagtagttttgaatttgagacctgtatgtccagttagttaaatgcttagatagagactttgttgttcattatccggctcaagtatgattacctctagtttctaacaaaaacaattaattactttgcataaacaggtaatattaggggaatgtgaaaagagctgtgctacaggacccggattagagaaatgctttgtttgaactttgaaatttttcggattttctttttattcaggcatctaaaaaataaaatagctattaaaagtggtaacatgtcaaaatccccatgtgtgtgtatatatatatatagtatacatttgatctcagaacaatcgcagctgacacaaacatacgcccgctactgtttttttcttctgtaaatttagaataaaactaccaacatggcattatactaatgtaattatggaatttcttactgctgtcatatatcttcgacttctcactcgtattctttaataagtaattgtaagttttttattagtgtttttttggattatatacttaactaagacaccatttcctctccttatgtataaaaagtatataaatcatagactctgcctatatactaaagggtaaagagagtgtaacaactaacttcaagggattactcgagtaaggtaacacagggtttcacctaacgtgaatcacgtttaataagtcacaagtgagtctacctttagatcctaaaagtgttagccaccattcggaagagagctcgacaactcgtgtattctgctttaaaaaaggataaactaaatttacacaagttggaaaattatgcttacgtgacctgtaggaaattcccttcactttttgctattttacgtaagttctccaaagcaataacaacaaagttgttggtacttagtttgtcgttcttatattcattactttatgacgcagtcacatttgtttcatacttccatcgaaagtttgtgttgcaatacacagaagtaacccattattagtcccagtgaacacattatccatcaattcttaatgaaccatttttcatcaattttactatataaatatttatagaaagatgggtaatatgtaaatgaaatttaccatgaccgtgacaaaaggtaaaaagactaatatatatggcaaaagggagattaggagaggacacttgaggaaccaatggtataacttatgcaaaaattatgaccagaaaactgagaagatgtagtgatggattcaacaataaaatgagcaaatgaaacttatattacaccacctcaatattatgaatctgcactctatcatttattatgttttggtatacattttatcaatttcataagtgcacttgattttttttcttattataatatgaatatgcaattttgtcatacattgtgttttatactatttacaagtatggaatttgcactttattatacatttttatggaaatattatatatcttattggtttgatagtaataaataagtattttattattattaagcagtttaaatatttattaattaccaaaattgttaaaatcatcggaatgtaatttagagacctaaatttaggtcgccaatctggaaaacagatgtcacttttgtcacaatctacaaagtattttcatttaaagtattttaattaattttttcagcaaccagcagaaacggcaactaataatattttcgacaaaagaacctaaataatacaatttaaataacaaattacgaatttgggactgtttcaaaactatttaccaatctggggcagttggtcacgcccagaactgggcatagtcacgcctggtgctgggcgtgaccagtcatgcccagttctgggcgtgacctactcctgacacgtgtcatgcacagatgcagcgatgcgtatataaacttcggacgatcataaattttgactgaaatgtccgattgaggcgaaactggtagccacgcgttcgaaattgagaggagaagcacctggcaagtttcaaaggggacttggtcaaaaaattttcccaaaagaggcctctaagtacctcaaaattgtgatttaatcttcgaagatctaaaattttcttgttttctgcttttttaattattcagtaagttaattgcatgctttttttttattacttctattaatttcgagcatttcgacatatcgtacacctcgatcggatatttctatcaaaagttagaccatttgaaggacatatcgtacgccgttgtaacttttttcgatattctaaatttttatatggttttgtttaatattttttggattttttatataataacctcatttatcccaaagcacattcattcctaacttttccgcactcattccacactttaccacttgttccactcatcccaaagtgcactcaccacacaataatcgaaattgtagcaccccattaattccaaagcgcacttggagcggcgaaacattgcagaactctagaaataggagtggaactacgtgacacaaagtgaatcaaattgaaatgcaaagaattgcattgcgcttacccagagagataaagatggtgaccaacctactcgcacaattgatcattcaccatgaaagatggacgatcctttctaattccctttctcgcttggatgtaaatgttttgaccacactaattttatacaattgtgtcaccgattgacagaaagcctaagtttcggtgtaatttcgatgacaagttagtcgactttgtgcttttgaccggaacaaaaagagaaaaggagaattgtcttctactttttttgaaagagaattatcaaattatgagagaatgaaagagatgatgagagggatgagaataatgtgcttaatggggtagtctcgatataaaaaatgagaagtatcaaaatataatattctatttaaaatgctttctatattaaaaaattatttacaaaaatttagaaaaaatgagaagtatcaaaaataaaaatattcaattttttaaaattccaaaataaacaaaattatatataccaaaaatattatattaaataaaatattgaaaaatccaaaatccaaaaattttgaaaaattttattaaataaaatattttattaaatattagttatatatacaaaatccaaaaaatattaaacaaaatcatataaaatttagaaattatattaaataaaataatatactaaaaattataaataccaaaaattcagaatatattaaataaagtcatataaaattaaaaaaatatactaaataaaacaatattaaaaacaagtaaaaaagatcatatctatgatgaagatgagtctaaaaatactttcaaattaaataaaaataaaaataaatgatattaaatgatattttatgtcaaaaattaaaacacgccaattttgatctttatttcagtcgctaacagtttttccgacaaattattttggtcgcaaacaaaaaaatttaaaaaatcgaattttccgtcactaaatcggtcgcccaattttgggcgtgaccaactgcccaggttggtaaatagttttgaaatagccccaaattcgtaatttgttatttaaattgtattatttaggttcttttgactgatatttatatatcttaatatataaatatgaaattgtaaaaataataataattaatttgatagtcagcttcttctcacactgatcctgcattttccttgtccaagtcactgtaaaaaaacaaaagacaaaaccccgaatccctccctctctctctccctctctcgttgctgaatgctttcatggagttcagacatcgaaattacagtgccgagcttgaatctcacgcgctccctcgcctacgcgccggagctcatcctctctctgctccacctccacctccacctctctcccaggtctttctcgtatcataatttctctcgcaattgttttttcttcttttaaaacaattacgctaccttgcttgatcagtgcttgtgactatgcagaatcggtgttgcattcacggtttcggatgcaccacgaaatatatcagttttttttttattttattgcgtagagttaggattcagttctatcatcctgaaataagaaaacgcctaggattttaatcattcagttaaattaaattctatcgatctttccctgtgtagatacctttatcctgtttgatatagtctaatgattcgatattgttgaaacgagtaatgtgagtgtaattagttctgtaaaatctgatgtaatctggataattattcaaacaatcatagtcatgaattgcatgccagtagtttatgtaacactgcaatagtgcactaagagctgaggaaaggaggggaggtcgggaaccaggaaggatttcgtaagtaactacaatttaggacttactaatttctgttgactcgcgtaatgaaaatatttgttgacttgcttaatgaaaatatatataaaaaactgtggtcgtgtttattaggtggatttgtgacggtaaaattttacatatcttgcgcttttgacagtattcatttatttgttgatatgtttgttttaggtcgatgtcgtagatcgtgggaacactgatttctatgatccactaagaggaactaataataatgcaaatgctgcccctcctgatcatgacaacttgaatgaagctgctgatcatcagccaacaaaggagtggacctctttcaggagattactaacgcagaggtttcctgtctccaaaatggtttctgttgcttcagtaagttttacagtattttctttttctggtttatgtaaatgttaaagatgtactgcatataaaaataaataaaaatattgtggtatctaagatggctaagggcaaatacagtatgctgcatatgatggaagcatgcattgtgatgacactgtagattggctttgaacattcttaattgtcagtagtggtagatcaggttagatcatagatgtgaatttagatactgctggcaagttaagttcaaccagtgtgaatttggacattacctccttctgcaagggttattcattctttctgtgtctttgttttagctggctagggaaaggctggacatttttctgtttggaaaacagtagaactgtctgatactgttttattggtttccatgtgattaaaacatattttaatcggctgcattaacggatatcaatcgttaaacatttttaaggaagaggtgtattatctggcaggagcagacttgggaaagttgtgaatacgtgttgtgcttaaaaataaatattgactaagatatttctaaatattcaaccatttattaatacatctcatatttcaccttaggttccttcattattcttttttccacctctcagctataaagataatgaatcaagcttgggtatgggcattgttgtttatgattttgcattttaagggccctatgctagtcgccagataatactgctcatatgagctaaccttctgttgaaaaaagttcacaaactttgaaatattcttatgaagtgtaagatatagcagttaattactatatactaatatacatctgtaatttctattgtgcaatgttgattggtagaggataggtcttaaagtaagataggtaaataatcccttatattcttaaaccagttttgatcctttatctctaaccctttcagtttttattatatttatctaattatttattctttaaattacagatgcccgatgttttaatgagaagtggaaaatgtatgccaatatcttttacattgtttttccttttgttttatcctttatttatctttacttagttatgtgacctcccaattttcagtacttgagaaatcttcaacaaatatgcacttggaggaattggacgatccacaaaaatttgctgatgagggtgtcaagacgattacttggcaggagtatgtttctcgactacatgaactcaaagatgaaattactcgttcctggcttgctgaagatcgagtgacatccttaaagttatcaataaaggtgaatttttatgtatttaatgatttcttttcaacattatagtttgtatgagtgcaatcaccttttggctttttaaatgaaaaaagagacatttttgttttagttattccatttagctggagagagagatggaaacaattgtgaaggtggggggttgagagggtgtcgagtaaattgttgaaggaatattgagtgggctgattgaagaagctcttcatcagaaaagtgggagagacctgggataatccctttttctgggataatatattttcccctttatcagatagtgtagggattgacggcccttaaaaatggatatgccattttgtattttcttttcctcctgtactttctttactcttcgtaatatttatatgacagaatacaaatgttgtataattttgtttaacaagattttaaaatactagggacttagagagatgggcctacccatttaaaatataactcatttttatacttagtttcggagtgggagtgaaatcatactgatttattttcatttcttgtctaagtttgtcttgattttgattgattatgagggctgaaactgattattctgtttgcaggttgctaagcttctgatggatacgtcagtattcgagttttatcctacactttttgttcttgtcacagatatcatggatatgcttgggaacctggtttggcaacgcataaagcggaaagctgagttttccgaagatggagctttacgctgcaacttagcaggtcctttgtcaatttgaaactcatcacaaaatgttgtttacttccataatctgtagttatataaatattacttattcaggttaagcttgtggattgtctgagggcgctaatagtttttcaacattaaatctttttcatgctaatgttttgaagactaaggattctgtgttttaactgcaaaaaggttctcagtatctcaaacatcagaagccaccaaatatgtttcattttgtatcttgtatcttgtttattggaactaatttgtacatgtcatacaagcttgatgatctgcatgagataaatggacctcctttagaagtcacatcttttttcttaaatgttttatttgaatcttgtagaaaactttcaagcaagggatatttgtgctgatgcaaaagaaacttgctataactggttcaacaaaattggtgctgtgcaagagcttcttccacgcatgtgaagtccttatcctatgccctgtatttaatttattccgtacatgttttttcccctgaagttatttttcttctctctgcttgtgttggttcgagactttctgatgccattttaatgtgatgtgacaactgataagcattttttttttctgtcaaaattgcttgaaaaagttgctacaatatagacatattttcagaaaagtttgaaagattttgtcaataacattttgaattttgacaagctgttgcactaaagattgtttctcactgactggtatttgctgactgtttatctgaaattgtactagttacttggagctggcaatattgccttgctggcggtttttgcttgaccaacctttagacagcctccgacgcttggtaatgatgataagaggattaggagatccagtagcatctgcatattgccgtctttatatggctcactgtgctcagaatctgccttcacacgatataggtatttttgttgatattatatatctatccttagggtgtgtaaaaatgtaaacaagaagcagatgggccccttttaattgttaaaatacgatctgtatgtatttagatatattttggtctaacctttacatatgcaattgtttatcataatgctctaacacccttacgaactgtaatccaagaccttagtgtgaaatattatatactctttggtgtcagtacagtcacaaatactctggtttaaagttcttgtatttcttccataaatttccaaatttaaaagttgtttagaatgtgaaaagtcggctggttaacacattattgtaccagttattcagataaaacagaatcaatgaatctagattattgcttcatactctttcctatatgaaattttgtgctctatagcagtgcttagttgcctctgattaattttctcttgctccttttctgaaatgggatgcaaaggtcactgactttgctcattctgaatttaatatatccgattgctgttatatacttctttctcatgtttattttcataaaacttatttcataaattgtgcaactggaacaggctatcttgttacatgtgtcaatgacatcagagttgttttgatgcaaatcttgtcagccaatgaaagaactcagaaaaatgttaaactcaacaaaaaattgcaagtcagtctgatggaaccaacaattgagtatattatgaagtgtatatttactgggttgtctcaggtatgtgatgaagtttctcttcaaaaatatacttgttttggatgtattatatatgatcatatttccatatatcttgttatacaaaagtgtataattgaaattttattgattagtatgtttgctcttctattttgaattttccatgagcatttcaagggagtggaattgcaggttgaaatttcatgaaacaggtgtatgcacatataattagctaaatggttggggttcttctcattattataatgaaaactcaattcttatatcttaatcttcatgaagaattattgtcgtcgttatcttttcaaaaactggacagtaggaaaaagaaagtcagtttgctaatgttttccctgcttttctcccctctatatcctatgttttatgctgatctaagtatgtctaactgtgctaaagagacaagtcaatgaagttttatcagagtttggattgatgaagaatcaacaggatttggggagtgtttcaatcattcttcatcatttactgaaggaactccctatagaagtagttagttctaatgtcgtgcagatccttcatctcattgaatttagcaaggataattcctttgatcaggtatacttttgcaatttctatcatagctggatacttcttgtacacattataaagtatttaccattttaccttattatagaggcatcttcgtttaagtttttcccatttgcggttttaatgttcttcttttttgtaatacagcatatgaattacagattgcttggattcaggctgtacgaaagaaaatcctctgttgatattgtcaatgctgtgttagataaagttattcaggtatttgtaaaattctagtccatcttgcatcctttcagagttacattattaggttctttgcaattgcatatattcttcttaaatcttcatctcttcatccatctacaccttgggggaaattgtgtattttctttgttgtttcctctcgtggtaaggtgataattgagggttgattctagccttcgatgtaattaattgaaagctaaacaatcatatactcttccccttagcatattataaataatatataccttgacttgtttatacataaatctccccgattttaatttttaacataccagtaatccctcttatttatatcaagatattttttttggtaatttatccaacatctatgctctccactcctggtcaatttgagtatatgataatttttacctctataaaaaatgtgtgcgatttagtatggacttcatttgtaagcatgttttcaactgtcagtatttccttcaggtatttcatttgttctctaacttggctgcaactttaggttattgctctgtatgatagccttgacaaatacctgaaggttgtagatgcttatactgatcttattcttcagaatcagatggtaagttcaagtgagtgagtagaatcagactgttattagttctccatgtcttctgaaaaaggtttcttatgccattatgtatcttctttgttgggtcacttgggtgcactaaattgttgaccatttacatggtatagatgattttggctgaaatttatgcatttgtagtcatcatctttttatgtctatgactgttaaaatattaaatgctaaggtttagatattttttaactgacaatattgcttaaggaacagtggcactaattattcttgtaaagctgtgataaacaggtgttaaatgttaccaagttaccatggcactgaaatttctatctgcttaaggcattggttttatggtgcacgtttgattaatttagtgagctcaataggattcatgttctaagctacacaactttcttttctggctatctatgcaattttaaatctacatcaatattaaaacttcttcaaaggttaagctaggctttaatgcagttcttatccttttgttgctaatttgataatcacagttgattgatattctataatcacatcctttcttctcacaataaattcttttaataaaattaaattaaaaaaagagatacaaaaggaagtaggagtaattgtaaatcttcagcaaggagaggtttgaggtttgaaactctttaggagcaactaatgcttgtcttgactaggcagttaacattatattacccaaatgttttctacaaggccaatgtttggcatttgtgtcgtcatcatctagatctacgcattatatcgacatattatagttttgtaggttgagtgggtgtgctggcaagctttgttgcttcccagtaactcccatttgctaaatctcaggctttgaactttttaatttacaacttgcttgattccaatctcctagagattgaacgtgctccttctgaatgaagcttgatgtccgatattggaacaaattaatggcaaagtgtttttagcaagaaggtagtgaatttgattccttagtgctgaatgaattaccaataatacttgtcttgattaaatagtcaatagggtaagggtactgtgaactgaaatgataaggaagctaagtacaagccaatcccccaaaagtaacaagagatctataactaaaaattctggaactaagtttctaagcttttttgtgcaaggacaatagcctatcctcctttctttgcattctttctttctatctattggtatgttctttaagtagacgatcatcagtcaaacatatatatgacaatttaaagaaattccatagaaaatattgagatttaaactctggtccttgatggattaattgttatccaattacaaagtttagttgcaaattgatatacctgttactttcaaatgactagaataatatttaatattttcttttgtaatctttcctctaaatacaattgtttatgccaggataaccatttgaaaatcattttggaaggcatttcaaagcgtacttggaataaaggagttacagaggatgaaatgtcgagcttgcaatctcttgtggtgaagcttctgtctcattttaagcatctggaagatgtgttttctctggtatgttcctaatcatatcttgttgtacttgatcatctttctttttacatctttctttatcattcattcttcaatacatgtgctataaatactagtggtgatttgggtttttgttgatattattttgtaggatcattttcctgaaatcttagatgtaatgtatggcaagtcacaggatgttgtctttttgcatatccttaatatggcgacaaggtaccatttatcacaaacattttgttttactctactcctttcattccatatcacccttattgacactcccatgtgacataccttggttctctagtcttagaattttgggtttgagcctaactaagtcttacaaaaccggctagtaaggtgagggtttccctccacttatttacattaacttgtccatatcactagtcgatgtgggactaaaccatcacccttgaggctgtaattcaggcagccctcaaagaggctgcaactgagatgggctaggggtgacctcaattaaggtagttttccaacatctagtttgtatatgatatgtatgttctttgagagtttgaggaataagaatttttaacttttgttacttaattgagttgattgatatttgtgtacaaactctgtcatgaacaactaccataaatgattttatattacatgtctaatatgcctccacatgccagaggctgtggggcttgaagtgtgaacattgcaagttcacttatcttgtgctgaaattcatttatttatttattagaattagtgtgacaaggatcaacttctagaccgcttggtcattagaggctttgatatcatatgatgaaccaactatacccaaaatttaagctattaggtgaagaaatgtgaatgattttatattaaaatttaacaaattcctttacttctgtggcaattaaaaaaaacattttcttttgagttgtaaggccgtactgttgaataaatagagaggcagaggaggggagaggtgcaaaatagtaagagatgtgcaaaagagagggaaagtgatgtatgtcagaaagggggagagagagagggggaaaaggagaaaagaggcagaaaagaaagaggcgcgaaagagagataggagagagagggagggaggtgttgaagagaaagggagagacagagagaggtgtggaagagagagtggtgtcaaagagaaaaaaggagagagaggcatagatacgagagagggaggaaaagggagagaggtgcaacagtgatagagtgtgcactagagttttggggtgagagttttcaattttttttcattttgaaatcccttcattttaccagaaaaatatcctcaattttaaaattctttggatttgatatccaaacaagtcattttggcacaggatatttgaaatccactcaaaagttgagttcttctctccaagctcaccatccaaaattaggctgcattaaatacaccaaaattcctactaacattgtacaatttcatataaccattcatttctttcctctcctaaatcccctgtataggctgtacttgcacataaaagctgctgtaaagtgactgcactaacgtagataattgttatcacagaacttatacagacttacacttccaagtctactatcttagatctaattttgaaaaatacatcttatttgaacttctattttcttaaatcatgaactgctataaggctaagacattgagtcagctttgttaacattaaataaggtcattgaaacccaattaaaattgatgggatttttttctttcaaaaaagttccatgggaaattacatccagatcctgaatcaaaacttaaccatgtatccacaccacagagtttacttttgcattttcaaatgtttttgtttcataatatgctagctgcctgcaacatactcttgattctatctttctgattggtgagtataatttattaagtattcatttcattaccatggaattatctgttattatttgttaagcaggaatggtcgcattagtgatccgacgagcatacagttgctttttgaaatttctctgacactacataataatatagagattatgaacgtaaaagatgatgatggccaagtggcatgttcaatagctcgctttgtgcacatggtaacctgttccttttgatattatttgtctctatggtcactttctttagttgtggtaatgtttttgccatgattatgaatgttgactctaaattgccttattcactaggtagaatatggaacagagatggaaagccatttagcatttctggttgattgccgaggagcttttggtagattaaatgagcttaaggtttgtctttgtttttcttaaaagttgtggcaaaatgccctggtataagtgataaagttgtcatgctttcttgcaggaaactcttgttcactctagcaattctttagcaattcaagctttgaaatgtgataagaaacatctgagttttgtcaaatcctgtgtcacatttagtgaagtcacaataccttctatttatgctcacaggcagtttgatctttttctagaaactgcagaggtaggtatgtcagttcttgacacatcaaagttgtgtttatttttgctacttttatatttttcatggattcatagtttgaatttttcaggttgcattcttagggggcttggtttctcattcagatggattgattgattcagcgatcagctgtttgcataccttagacataattgatggttagttgatatgtaaaacctgtaaatttgttgctgatgcattgtgaaagtactaagaaccaatacttgaaattgaatccttgtcatttgttacttgtggcatgtctattttgtgaaatctattcaatgctaattttctatgtgctatgatgaaacggtagtggttaaaaggttttgagaacaattatcacaattcacaaccaaaacttgttcatgttgtccaaactataaattgttttatattttttagtgactcagttcagtcaattgtgttgaagaaagcccaataatttgggcattttttcttcttcatttttatccccttttttcaaatatctaatgatttgaaggcatttatgaaccttgtaaatcttttttttctcttctatcccctttgttgagtatctaatgatttgaatacaataatttgagcatcttttttatttttttattttctcttttatcctcttcgtcgaatatcttatgatttgaagccatttatgaacttcgtatatctttcaaattcctaaaacccaacaaggattggggcttcttataacatagagcttaaaagctaacatggaaattgttatattatacagttaagtctccaataagatgttgatgtagaacctatatacatgcatggtctataataatgcaatgctaaatgatccgtaggtgcaacttgtgaaaatattttccatttcacttcatttattgattaacccagtcagaaactagcaatccaatatatatttatagttaactgaaaatgatgtatcagagctaaaataggtagatccttggttaaattagttttatgcttaatcaatcaatatacgaactgaaatggaaattttttggagtgccaaactttagggtcattttccctatattattgttacccaaggcttctaatgcgtaaaagttagaacttaaaaaggaaatgtggttaaacaacactaatctcttcttgaatacaagtatcctagcaatagttcttagaaataactaatacaaaattggatgctacaatatgttaaagacacctgccatatttttgcgaggggtttttattgagcatcattctctttggtcttttggttgcttgtatcagcatttttttgttcttaatgtatttaaaatacattaattgtgccaccatggctttctaaaaaatgacttttgtctgtactctagatagcattcttataatataattgactgttgatttgcttgattttgtaggcttccgaactccaactgatgttgaaggactagtttcatctattagaaagctatgtggcttcttaattatggttccaggttgtaaatattgtttcagctttgcacattaatatacatagacacttcaaaatctctctttctgggatgtatttactatgatttgtatagaaatatataggtactaggttagagatctagttcctttttacctcttccttgaatgcatatatttactatgattttcttcaactttattgaaggtactcttaatctaccagtcacctatttcccaaatagcttatttagattgatcagctcccgatcttggtaagttttctttgggatatatcacaatcgaagcttcttgccccccagaatacttcccttattgttttagtctctcttctcccttcgtgcatcttgttcgatgaatgaattgaaaacccttgcaggtttgaaccaaaaatgaggacacaaattttttctgctatcatattattattgacaactttatcacaaaagagactgccatatcatgcaaatgcacaggtataagtggtatagctttgcatttcctcttttcaattgcattaatggaataaagatgacatatctactctttcactccaaaatggacaaaacatattgaagttgaagagtatttagagaagtcttgcttattgttttgtgtccaagtagtggatgtaagtgtcatttagtggtcatagctccagtataagtaaaggtctagggttaagctaatgtagtataattattctgagcctgttagtgaatctaatttgccttccctttactttgcactgactataacaagtgtaaggtttacggttttgtaaatcaaggtgttcctgacatgttatggtttatggtttttgtatcttaattctcaaaacaatatatttttttcctttccagattccaggcaatgacatgttatactatgaggattcatcgtacaaccaagagcttgtttctttgtctaaacttgttcttgaaaacctgcttagtgccgttcaacaagaaccttcccaggtatcatcattttggctgaattaatagtgtttgatttatttaaccaattataataatactgatttattataacaaaataaaggctgctcgaggaattatggcacttgaagcttgcaattgcattgcatcatctttcatggtaagctgctctgtagttgttttgaacttagttctcaccatcattgacgtggggagaaagtacaaaggaaaaaaagaggactcagattacaatttataaattcttgaaaaacattacaaaactatttccaatttaggcatcctaccctggcaaatgggtatttaaatcaacaggcagttaacccattaactggtttgtagtgtgtctgtatgtatatatatggtctctgccccggcatccccatgagattaatcccattcatggtaattatttaatatttctttaactataaacagaaatttatgaataaacattgttcactatacctatataatatagtttggagcattttgttataaaaggtaggcaaatgaaatgtccttgttcctgtcagaaaccgattcagtatataattataaaggaaaggatgaatttttattgatgaaccctaaatcacgattgctgtgccaatgtggtagcagcctttggctaggttttgaagatacaaaacgaactatttccctggatattcaagattcaaattatcctttctcaaatgataagatgatttctctcaacctcccctctttatttattatttataggcaatatgccttttttgtttcactatcgcggccctggtagcccacccaactaacctaccccactccctcactaatagacacctaactaactaattgaaatacgtgtttgcttcatttctcaggttcaacaaaattgttctgtttcacccttgtatggccttatgggtgaaatatatcttatttaaggatggcctgacatgcatctatgcattccacaacagtgatcactttctcgatacatttgttatcaataaatggtaacaggaatcaatcattttcaaaactcttaaaattcataagggccaaaacttataattttttagggattaaaatctaattttgtcatatttgttggattaacaaacatattaaacctatctttaaatcctaatgattgaatggaacagaaaaaggaagtcagaatatgcgttttcttatgagtccccatgataatgttctgttgtaattcgtaacattttcttgtttgaattattcatttttagcatagccttacctagtattatgttaggggatgaatccttgttgaaagttatcatactctgttgtaacttgtaaccacaaattccaaatgaatttggttgcttggaacttgcagagttgtatctgaatcatgtgcagattctacttcagttttctaataatggtttctttcttgattgttgacagctaaacaatgagttattgtctgcttgccttacactggtcgaaactgccaagtcatgtttgagtgccaaagacagatacctccagtcaaccattcaactattaaacaagcaatcgccaacttctgtagggactatggtgtctacttttgtatgatttgtgttcatctatttatttttctctgttttttttttcctttgaaaatgttctttctccgtgtgggtaaggaacgaggttttctctttccctccctcttatttctctttattttgaacgagggggcttatttgttgcaaatttattatttctttttctttcctctaggaatcaaatgtattacttctaaatatcgtgaacgaactaaaaacggggcataaagttaaattttctacagtattctattgaccttagtattttcctcctaactgaatagttaacctaattttggctagcataactgcatctaacaaaattatgacggattgagttcactttattaattctccaaagtacctttaattcagtgaaaacattcagttactgatgacgatccccttttgaaagcatacagttcttgttgttccaaatacacgaaacaaaagtaccatgtgaaaaacatggcgactttttgcatggggtacccctaatggctatacatgatgcgaatactacttttagaatgggttgcacggtgcgtgtatattacaccgttagatcttggaataaatgagactactgtagaactatctacattagatttttctctattttgcgaaatacccttcttcttcggtcccctcctcttccctccatcactccatcatcattcttccgcacacccacataaataaataaaaccaccatccataaacgaaaattaaactcagatcttcggattcaaatctataataacatgtattttcttatgaatatagcgtacaacattcagatctaagaaaccaatacaaaaaaatcaaagaaaccaatacaaaaaatcagcaacaatacataaaacaagtatttacgataaatgagaatcaaaacttaaatactaaataaaataaaataaaagcgtcagatctgccgctgaaatcgcaccgaaaaaactccaaagttgtggtcagtggcaacgcaagatcttccatggtcatcaccgcctcaccactctcttctctttaaatcttaacggtaaaaaaaaaaaaaaaaaaaatcacaaggtacaaccattttaaaacattcttgttcgcaccgtgcgtaccatgtagagggtatgcacgttagccagagtcgagaaacattcaaggtcttgccatacttggatttctgatgtaaatcacattttgtccgatcaaggcagagactactaagtaagcaatccaataatcaatcagattgttgcatcactccttgagcttcaaagtgtggatcaaaagaattcatagtttctttctttttatcagaccaatttgtatttattgttcgacattaaagatctagcgtcacattatcgtagtagaacttttgtttggatgaatatggtagttagtcgtttgattttggctagaatttgctgattagtcactcagacgatagatttctattgaagctaatgtcgaagttttgaggcttttggttataagaattactcgatgtgcaatggagttctcgttgaaaagctttgatactatctaaataagcagaacgaactcaaaatgaggtatatttgctcaattagagatggcaatgggggtggcgctgctcggggacagatttgcctctccgttctcgcaaaatgcgatacgcattcggaaataaaagagggtttaaatttttcatacattctcattggattttatcatcgtagataacctgttatactcttttttataattttaatttacatatatttataaataaattatatattaaaattttaattatgttttaattcaaataatatacaaatataataaataacaaataaataaaagataaaaataaagaattcaattatgtttttatttaattattaagttaattgatttatatttttgaaaattataacaataaaatctttataaaattagtaatattatgtgtgtatatatatatatatatatatatatatgttgtgacaaaaaattataaaaaaaatgtaatagtgacatgtacaatataatttgatattatttttactttaaaaaattgaataatacgtaattaaagtagatattcttcatcaaagtcaagataagttctagagaatactcacaagtatgaggttatttatcatgtctactcaatagtgattaagtgcacaccattttgtaatctgactaatatagtaatattactaattttaaataattttttatggttttatctttgatttgtatctgggaaacatgatttctggaaaagtaaatttcataaaataatgatttgtgtgaatgtgtatttgattagtcttaatatattttttgataattaaatatttatgtaaaatatgtagttaaaactttttttacattcaaaaaattagattcctgtcccccaccttaagaatgtgttttgacatgaaagtgaactaaattaattcttaaaaatcataattttctgacaatttttttttattaatcgtatcctaaacataaaaatcataatttcctactttataatttatgaaaaaatcgtttaccaaacttgtctcgcgctaaataaattggcatggtagtagtgtggacaaaactcaacatcttgctggcagtggaactacttaagtagttttggttatagttgacctctgaaaactctatctgactgtagaattctcgaattctgatatttgattaaaactaactacatcagtttcatagtcagaatagctacattaagagagactaaactaattattagaattgaacttaaatatactgatgagagtgtaaaagttttatacacattgtatttttgaagcagaatatacacattgttattaattattaattatttcagaaagccgacaatcaactcatttacgaatgggccaaaggcccaaagctccaactaaaacccgggccctgtgcatagatgtagccggtagggcacattccgacgggtcattacccaaaattcgttcattcataattttcaaatcccatagcgacaaacaaataatcatcatcgttttcatattttagagagagagagagagattgtgcgttttgataatcaaccaagttgcagaagcgatggatctggaggtggcagggcggcacgcgatgctgttcgacgacgacggcatggcggcgttcgtgaactcagcggaagctctggttgaatggaactctctttccatcgaccgctacgatgtccgccaccttctctccgctcccctccccccgcgcctcaagcgccgccctcctccgcccgaacccgatctcgatcaccagcgctatctcgatctcccttcctcttctcccgacgacgaacagccacaaggtaacctcatacacaattcctctatactttttactttctagttccttccctttcttagggttgattttccccaaatatgtttctgttttatttggaactctgttggttgttgtgttttatgttttcaccacaagaagctatgggagctttggttagtgattttgttttgatgaggttttatgttcttccctggagagaagttgggaagttttgttagtgttcaaggttcatcctaattttatataggccacggtgagaaaagtcaatcaaatggaagttgttctgtttaattaggttcgaggaagtccttaaactttgggagtgaaactatgggttttgattgagctcagcggtttaagataaagcttttgttgcttctttgtgggctttagctagaatgtttccttgcatgatgaaaggttttgagaacatattctggtttaacaaaaaagcttgccttcgtaatctttatttttgtaacaatgagggctttgatattttgagttgtgtgtgacatattgtgatgtgtgtatagagcaagggctattaataatcagtcacgggtaattctctaaggtttgtctatcaagtttgttcaatttgttctcatcattttgacacattgatatatttggttagacatcacatttagttggggcaactagttgatcgtgggttctttgttggctaatggctagcaaaacacatgttttttccgtgcatgttggaacaatccaacttccacttgagtctatgtcagagtgtttttttttttttccggcaacaacaagctccacatttgcaggttggaatttaatttgctacggttcccgtgtctgaatacaagtaaggatgttttcacctggcttcaatttaagtttggcgttgtgttgcaactactgtttttgctggatggttttgttgttattgagaattatattatatttgattctgatgaagaatatcacctctttgtgtttagattatggttcagatccagtgagttcaactggctttcatgctgtcgccttttcatatggaaattctaatgtgtccatggagacaaaggacaatgatactgagtctagttttcatcctaaattcccagtaccagaaagcctactcaataacctggtgagtaacctctgtcttaatatatactttaaattgtgtggttttccgatgttactaatttaattgacctttcattgtttaaccaatgtgattaggtgataattgtctagggtacatatgttattctaaggcttacaatgtctaagtttcagatgctcggagcataaacggagttcttgtgactcaaggtagccattcacaggcaccttggttccttttgatgtcatgagaaggggccgtgcaggtgggattaggatgatagaaatttgttgattccttacctcttgagagcaaatggaatgatacatgtcttcataaagttctgtttcttgatctttatcattatcaaagtatttgtgaggttgtcttgtgtttgtttagtaggatacaagtgtctaaatattctgcttggctagaccctttttaagtttatacttgtactaattttggaattcacatttattgatgacgaaacatttttttgtttgtttgtttttcttttccagcctccaaatgagaaagtacatcagattatttcaaggactgcaacatttgtcagcaaacatggaagccagtcagaaatcattctgagggtgaaacaaggagacaatccaacttttggattcctgatgcccgatcatcatcttcatgcatattttaggtttctcgttgatcaccaagaacttctgaaagttgacaaagatgatggaagctcaactgaggacatgaataggactcaggggcttgatcaaacaggtggtgcattgtcgttgcttggatctgtctatggatccggagaggacgaggatggtacaactgagaatacttgtgatgttgagaaaaaagaatgtgagggagctgttgatgctgctagtaattatacttctccaggaatagatcaggcagaatcttattcagatgtggccaagaaggatggaagcatttctaaaaatccaataccctctttgaaagaaaaagttcctgtcataaagcggaatcattctattggtactgttaagactgtaaccacagctagagctaaaggtgatggcttggattcagtatgtaatgcacagaacaagtcgcaaacttctgtgacgagtactgctaagattgaactcccagttgttgaacctccatctgatttaaagagagctatagagaagatagttgagttcatcttaaaaaatggaaaacaatttgaggctgttctggcagaacaggatcgacctcatggaaggttcccatttcttctgccatctaatcgatatcatacttactatctgaaagttcttcaaactgctgaagaggtgtgtttctcagaactattaaaatttagcttatttttaattttcaattaatgtgattcaaattgttcccttctaccctactcttccctcccctctaaagcaaaaacataatttaattgactgatattatcacctgtaaacttatctgcagtaccctaatgttggttattctaattaatcattggtcatgtttgtatttctgtctgttatgcaaatttgtatgcatgtggcatgtatgctttatatagctataatgccttgccatgtagttgtgataaattatgaatttttgaagcagtcatggttatttttattcaacttcgcctttcaaagattttccttctccatggaattcaaattttggtaattattttatttgggttctggagggattttttgcaccttgtgtattctatgaattatttgggactgattaaggtagtgttaattttgactttgagctgctacttactgatcttcctaattgtttgtagtctaagttactaggcaagggccaccagaagcacaatccagcaggtcgtacaggggacaataaagctgctgtacatgaagatagtgacaatctttcacatggatctatggcttctgatctaccatatgacatggacagaaaagaaaagttcaagatgattattggcaagtctaagaaggatgatcaaggtccaattccaaaagaccaagctcaaaacacaattagtatggatgcagcagcaactgcagctattcttcaggctgccactaggggtattaaaactccccatttggaagttcttaccaagacatcaagtggtagtggtcaaggccttggaagtgatggtgggtatttgtccagctctgggactggtagtctgtattcatttcaaccacaaggttttgttgaaagtcaaaacctgaatgtaaaggcaaaggctagtgcttctgcccctgttgccaaggctattgcagaaaaagtagctatggcagcagcaggtgaggcggactcctctgaagttcacatgactaaagagcaaaagcttaaggcagagagactgaaacgagcaaagatgtttgcagccatgcttaaaagtggtgttggagcaagtgaactgccacgagctttatcagttgagccaccaggctctggagtttcaggttcagatgctgagactgggaatcttgtgggtaaagaaagggaaggaagttctgttccatttgatgttgataattcagataaaagtcaaaagtctgaggagaatctttctattgataataattcagataaaagtcagaaatctaaggagaaacttactgttgatgataatgaacgccggtcaaaaagaaagtaccgctcaagatctagtagacatgaagaggaggaagaagaagaaaacaaagaagatagaagggatcataaacgatccaggaaaaaacatcgctcacatcgtacttcacaccacaatcgggacaggcataagcacaagagaagacattcctcctccaaagacaagtattcttacagggggaccaagcacgatagctcctcttctgatgatgaacatcatcgcccaaggcatcgtcgtcataaatatgatagctcctctgatgaaaagcaccactcttccaaacaacgacatagggatgagaacttgtcagaccatgagcatagacattcttgccattctaatgaagattatagttcatctgatggtgagcataggcatcgaagcagaagcagaagtgtagggcataagagcagatctcatgctgaaagagaaagagagctggaggagggggagataattatgaaatcggaaaagtcagtagtaagtggtgaagttggacgtgctagtagggaggcttctgagggattatctaatccaagggcaccatctcaatcacctgaaataactgatgtttctgatgagcttagagccaaaattcgagccatgttgatggctaacttgtaaaagctatatggggctgacaataattgtattgctttaacttctttggtaatattatagtccattgctccaacggaaacatcctgaatttttcgtaataataaaataataatatttagagtagtctactaaaattaaaagaaacggttaggtaaaaattaataataaacgtgcaaaatttgattttttttcttttgcaaattacgataacgtataaattttatgattaagatggtatggtaaaagtaagtattgaaacaagtaatataactacaggaaaatatattgattataaattagttaaattggaatattaaaaccatataatgaactataatatttttagtaaatatgtttttagcattcctatttatgttcaaatcactaaaataaaacaaatatataccagtacttggttgatctctttcttctgttttgtcttttctatttttattttatcaatcaaatacaacatcaaggaattatgtaatgtcggacatatttcatgtggcaaaaaaattgatatatttcaaacaaaatattataatctcgtgagtaaattattaggacttttggaagaaaaaaaaaactaaaattctggaaattttggacagtttaaaatttaagacctagactcacttttaaaatatttatcttcttattttactcaaagtattatcatatattataacttaataaatagttggttatttggcgggcattaaactatgcaaacgacatcgtatgggaacactatataaatcctccgttgtccagaaccctagctttacttttactctcactcacatttgtagcttcacaacgccgccgcgcacatcgcagtcctcactctcccggaaaaccctcatcagcgcatcgaatatttgcaatctccaatagttctctttatctcttcaccataaaaatgtgtgaatccgtggaaactaaagaaaggcccaaattcaaagatattagacgctatttctgcgagtactgcggcatctgcaggtccaaaaaaacccttatcacctcccacatcaattcgcaccacaaggtacccttctttctaattctgcaaaatcaaaccgtttataagcaaccctgattgaattagatcattatgtagggttatgtgtggttttgttgtttacttttgatgtgtttttaggaagaggatgaaaaagcaagagctgaaagaggtcccgaaggaaaggcttcgaaatccaacacttgcgaggaatgtggtgccactttcaaaaaacaagcccatttgttgcagcacatgctaagtcattcaaatgaggtatttggactcttcaattaaatattgttattatttaagaaaaaacatagattcagttaagtgaaactcttaaactaagtatgttttatagaccgtcgtgttccttgagaaacattttatttgtggaagacaggcttggtgttgtgaattgattgtgttacttgttgtatatagactgaaaatacatattttgcaggatagtaatctataagattctaaaatcattggaaaattatggattaatagtgtgaagcattggatcccagaaaaagaactccaaaatgcacgaggcagcgtatatgaacttgatggattagtatcaggtagggagacctcctgtgaagctccatcaaggatgcctcggtcacgctctgttcgaaattgaggttggcagtttgtttatttgtgttttgttcttgtcagagcatcatgatacctttatgtgtgtaagtttctggatttaacagtattttccaatggttacagaggccatttgtgtgtcctgtcgatgattgtcaggcaagttacagaaggaaggaccacctgattcggcaccttcttcagcatgaaggaaagacttttaagtgccctgttgagaattgcaacagtgagttctctttgcaaagcaatatgaaaagacacattgaggagattcatgacaacagttctacctctactagtgacaaaagtcataaacagcatacatgtcccgagattgggtgtggaaaggtttttagatatgcatcacagctacaaaaacatgaagattctcatggtaggttttgttccttttgtaattctttgagttagttaaatttccatgggatgtttgtaaggttcttgtttatttagattagtgaaagatgttgggtgcaattttgaagaaagcctttattctgcagttaagttggagtcagtagatgtggtgtgcttagagcctagttgcatgaaacatttcgctaatgtccagtgccttcaagcccatgtgaaatcctcccatcaatatatgacctgtgacatttgtgggactaagcaactgaagaagaatattaagcgtcaccttcgatcacatgaagtcgaaggcagttcatcagagacctttcaatgtgagtttaagggttgcagctgcacattctcaagagtaagactcctcattcttaaatctaatcagagtatactataattgagttctctgtttggttacaagttgaactttcttttaatttgttcatggttttatgtcaacagaaatctaatcttgataagcataagaaggctgtgcactttaatgaaaggccttttgtttgtggttttcctgattgtggcatgagatttgcttacaaacatgtacgagataatcacgaaaaaacttctaaacatgtttttacccttgtaagttcttttccccttctattccctttgtgcaaaaggttttcttataagtgatattgtcatatagtcatgccttttcattgacttgctcataattttccttgcttcagggggattttgaagaagctgatgaagagttcaggtcaaggcccaggggaggaaggaagagaacatgtcccactgttgaaatgttaattaggaagagggttaccccacctagtcaattggagcattggttatatatgcaggatggtcagtagagtgcatttagtattgtgtgctcctaaatatacaagtaggcataatgtaaatttaatatgttgacataatataattatgtacatttaggattagtaattagtgttaacagagatatatagtatttatttaggagaataacgtgtagtaatgatgtatgcttatatatgacagattcaatagtgtagcgaatctatcaactgtcgtaccaatttgcaatttaaacaattacttgtttataatctggtttggaaggtgatgtatgctctcatcggcatttgctttattggctgtttgaattggttgaaggatatgaaaagcaaaggaacataatggaataagagttttttattttatttagaaattttatggtaaacgaaacacttcttattttatacacaaattatgttttttgaattctggcttaatgtcctgtagtttgtacaaatacttttgataagttaaaagcgtactattaattaaaagaacccttaacgttaagcataaaaagaaaaggcgtgttataaaaaatgccacttaactggcaaccaaaattatctattcccttgtttaataatatttaactccttggtttgcatttttttacatggttgactttaatgtattgtttcaaaataataattttttttctttctaaatcactattaacgttttgtaacagctgttagattttttttataaaataaaacaactctacccaataaagataacaatatatggttggaaaagtcaacgatggacatcttttgttatggaatatggatggtccttactcagttactgtaatgaaaatatcaattgtcttgacaaggcgataaacattacacttagttgaggatctttgagttaaagtgtcctctagagagttgaaacttaaaacatgtaaaataaaaaataatgttgaatttcaatggattgacccattatttttcccatttttttatagaagattttatttatttatttatttttgttattaataattatacatatacacttttattattttatccaagagtgctcagagatagatcggtccaatctaaataaaactgaaaaagcaaaactaataaatcgaataaactaaaaattgaacaaattaaaaacgaaaaaactaatttttttattgaattaaaccagatttcagttttggttttcaatgttgatgcaatccaaactaaacttttatatatttataaaattatcatataatttacacttatttatgaaaaaatatatttaactaagatatataatgacttatagttgaacgacattttaagttattttttgaaaaatcattttttattatgtttaatattttttatcatttatttaatagtttatttatagaaaagtaaagtaagactacaactgaaaaaaaattcaatccaaagcactctagactgtattaaactggatttaagatttaaattaaaccaattaaatgaaaaattaagaaaactgaagctattaaactaaattatttttctcttcaaaattattttaattcaatccatgaatatctctaattttatggtgtggttgtttatttttctttcatgtgatttaaattcataatacatgagtaaaaaatttctacacacaaatatatatttcattgttataaatattattttaaaaaataaaataaaataaattattcaattcatttatatatatatatatatatataattgttaatctttaaatggtaaattacatatagtggaacatttcaagccctagtaaatagtaattagtctaagtcaagagtctctctcattgccattcatatggtttctcctttagaaatcactcacgtgggcatcttacctcagttctgaaatcactactgcatcttggtatatattctcacacataatatttggttttagtcaaaacccattttttgttgccgactcccttgcatctatctctgacatctaccccttctcactcctttccttcaccctttaaataatttgtagacacaactacgtgagtcctttttgatactcatgcaaaaactttcttgctccccaagcacactacgtaacataatagggagtgtatatatatatacatatacatatacatataatcaacatggaacccacttggaatgatcccattgtgaacggtagtaattcttctgatccagtcatgtcgtttagaaggacaccacttgtcatggatgagcttgattttgctcagaagagaaaggagagtgaagatgatgatattgatgatgatcatcaaagtgtggaggaccttcatgttgatgtatgtactatatatgtagccaaactcacatttaaatatttccttagatttaataattgtaattttaccttaattatatatatgggcacctaattatgttcttgttgtgttaatttatagaccagctcagatcttcttacgaagaatgatactggtgtcaatagatcaacgaaagaagatgcggcattggaaactatggacgataagagctacgaggtaccctaattggttgttgtgtctaggtatatatgttatatatgtttgatttatatttatcaaaaaggtagcacgtttaagatgaatatatagtaattaatattaatttattcctatgggtatagtttgtagctttgctaactgaattggaccaaatgaatgctgaaaatcaagttttaagagtgttggttgatgaggtgaacaataactgcaatgccctacgcatgcaaattgtcaagctaacgcagaagcagcatagtcatggggtaatttatttatttgtttttataacattgaatatcaaataacttaataaataagtagtggtatatttgagtttacttgatagatccatcttaataaatttattgagttccaaaaaatagatctggcatttgatcatatattcaatgctgaaaacatgtatgcacttgttttttatttggttttgtgtagaattacggagtgatagggaaaatggaagatatggttccaaagtcattctaagacatggatgttgctgacgaggatgagccaaatacccagcaatctttagaggggaaactgagaggaagcaaaagcatggttgagttaggacatggcaaagatattgctgttttggagacagataagttggattctgctggaagggaaagtgcaaattaaagctagaatgcatggaagggaggcacgctgaccaagaattgatcagtaacaaagttcctagattggatccagcttcaaaaatcatgtcaatcaagaaagctcgtgtgtcagttcgagcaagattttcttcaatggttagtaaattatataaataaagtaaaattgacatgcaactctatcatctccaatatatagtaacatcatgtgatttacccattaacaaattcagcctagttagctagctaatcgatgacttctaatttctaaggaaaggggatgtaatttactaatgtgaagtttgcacacgttaatttcttgtttcttgaaaatacatcatggaaaatttacgtgttaactttcttttggatgaatcctttattacagattgcagatggatgccaatggcgaaagtataggaagaagagggcgaaaggaaatccttttccaagagcctattatcgttgcacaatgagtactggttgcccagtaaggaaacaagtatgcactcttgctaggaaattttttttctttaatttgcgttaaattgttctttctgctgagactagctaattaaagcaaggaggaaattctcttacggtattaggaaactagcaagacatttctggtgggggaaagacaaattaaaacttaatttgcaaaattttaatataatttagcacactttacctagcttgagttgagtgcactaaattaacaaagaattgaattataatcaatacattagtgaacaaaagatttatttaataatactgtactttaattatcagtaatgcacacccaactcaagtatattaggtttatacaagaatttctattgtacttaccaatcgatccctctccttttttggggacatacgctacccaaaagtgcctggtaagggcatggaaaatgatatacagcttagagtgtgaatgttatagggatcaaaaagcctgtatcagctggtgctttctaagaaatcttgaggggtaatgaaactttgccagttagctaatggctacaaattaaagccattgggaaggaattgatacattttgtctctaacattaacatgaataaataatatatgcatataattcaacaccttttatacaatcactcaatcacaaaatattatgtataataagtttgttagacttttataataagtatatcttaaatatcataccaaaaattatttttgattaattgatagtacaaaaactttataatatatatatgtgtgtgtgtgtgtgtgtgtgtgtgttaatttgttaaactccatgagtattatacagagaaatcaaggtttaccaaatagtggatttatgtttgttcataggtacagaggtgtgctgtagacagaagtgtgctgatcacaacatatgaagggcagcataaccatccacagcccaggcaatggcatccacaacatatgcagctgcctcaatgcttctttctggaccaatgccaagctcagatggcctaatcaatccaagcatattagaaagtgcttcacttccatgctctcagaacatggcaactctttgacctcagccccatttcccaccatcacattggatctcactcataatgcaaccaattcctcacagctacaaagtgaattaccacagggccaacatggcctcttattcccacttttggctcataagtttatgtcatttccaaaaatatttggactggcactgtgtgatcaaactaagctttctggcttgctggcttgcatgagtctcagggaatggacacaacttcatcatttgctaacatagtaaatgcagccactgctgctatcacagcagaccccaatttcactgccctcttgtggcagctataacatctgtcatggggagttcacattcaaacactaatgagcattgcaacaataatacataagactcgttaattgcttttgcaaattggtgtagttttgatcgttttcatattcaacataggtatagagatttttatttcgtcaatgtcatgcatacaaaaggatgttacatcggacgaatcactatattataatctttcattatttgagataaatcttaataaggcattcatttttttaagttgtgttcaatagcatatatcgctaacaaaacattttgcaagctttatgaactttattgtacaaacaaaaatgacatgtttttaattcttttaaaatagccaaaacaataaaattagtttgcttttttttcacgtacatacgcaggaaaagtgtttgaacaagtgaacaactacattatggtttttttttttttttaaagaactgcattatggttaacaattctttaagcaaattttgttatagtattttaatataaaaattacaaacaagtcttcaaaaccacgggacatttttaatttgagtataataggtttagctcctatatgatcaaccaaatttaaaatcatctataatataattttaagatatttactagtaataaacttatcataacaacatgcgattaaaggacaatttaaaacatttttatactcttgatggatgtattatttattctttattataaattttaaggatttatttgaagtttaataaacatgtacaagataaaaaaattacactattgatgaattaaaaataatctttgactaaatcaattaaaagtttgttgacatatttattataaaattcaacaaatttgttatatatgaaaatttgtaattaaatgatgattgttatcatcttttcctttctcccactctaatcttttttaaaaagaaaatccaaaaaaagaataacggttgaattaattatgatacaaattatcgttacacatatcaccttttttaattaattgtgatatgaattaccttttttattaaaatttgaattaatgatgatataaattatcctttttaattataatcaaattaattatgatataaattaatatcatatttaatttaattactattaaaaatgacattgactactattaaaaactgtaagttgtctcttaattaatttaatcttaattaaaaaataatagtttgtattacaattaattgtattacttaaaaaaagtaacttatatttataattaattaacaaaaatttgtaaagaaaaatatagaatataaacataattttgttgattacaagagtgcaaaagaattatacaatgaaaatatgatttcgttgataatatttttttcgttgcacttcctcttacataatggagacatgatctcattgtctaatttgttaacagaatcatgtttttcattaaaaagggtatttttggaataatgtcatttttaaagcacgtggggtacaaatagtaaaattgggagtgagagtggcaatccctaacaaaggtttacttttaaaccaggtcgtctcctcttatagcctacacacattgttccttcttgcacgacggtcgcaacgctgttttgtagccgttgtcggccttcaaaattaacaaaactactcactctccacaaataacctcacggtattctatttcttctctaaacttttcgttatttctttctagaaaatctgtgttggattcatcatacttcctcttttttttttcctatgttatcatcttcaatagttttttggtccggatttttctgccgtctattctgaagcgatgtttttaaagcacatacatttatagtcaagtgattcttcttgtttcttggcatagaaaaaagtgattcctcttgtttcttggcatagaaaaaagtgattccactcaaaacaagtttaattaatgttttttttttccaatatcttttcaagttacatgcatgcccttttgcttcctatattgagagttgaaggatttgaaacttgagtatgcaattaatggttatttgtgtgcttctgtaataacatataagcactttgtcttgtactccaatagaacacaatgagtgctgctgctttgctattctcctgctctatgcatgtgggtgtgtctcatcccaaggtggctgcaaaatcctctccatgctgtttgctcaatcagccatgggatcatttaaagtcaaaaacaccatttgggcattcaggagtctttgaaaatgttaaactttcacataaaggtgatgagattctgtggagggcgggggcccttcaagttgaaagtgcaccctccttctctgtggggcaaaaatttcaccttcatgatgtgattgaggctcagcaatttgacagagagactctcaatgccatatttgaagttgcaaggagcatggagagcattgaaagcaagtcatctaggagccaaatgctaaagggttacctcatggctactttgttttatgagccatccactagaactaggctttcatttgagtctgccatgaaaagattaggtggggatgttctcacaactgagaatgcaagggagttttcgtctgctgctaaaggagagacgcttgaaggtatgtcctttcaattaacaatgcaaagttttgttagtacttagtgggttctttcattgttattctatctaaaattggtgtttcatggaactttacttcttgcagatactataagaacggttgaaggttacactgatataattgtgatgaggcactttgaaagtggtgctgccaaaagagcagcaacaactgctagcgttcctgtaatcaatgcaggggatggccctggacagcatcccacccaggtatgaggaatttgccacaataggtacagattataattctgatgcttcacatagaatgtcaagtagatattatcataggatgatttatttttcaaagtaatcttgagtctattgcccttagctactttttgactgcagagattgcactatttcattttcatttgtagcatctgccaccttgttgttaaaaccatgaattagcattgaactatgatagataagcttttgctgctgagcaattttgtggaagcataactatgtgtgtctggtaacgtgtcatggtcctcgtggacatggtttttgagatctgaatagaagctactggctgtgtaacttttgcatcatttgttgatttgacctgatttgttccctgccaaacgtatttccaaacacagggaaaatccacttaacaaatttgtttccatgactcattactcccaatcaaattttaaaaacaaacccccttattatgctgatgctgttcatggtatttgaaactgaaagggccacaatttctccttataatttcttaggagaagttgattgggtagaaggggtttacaatgacctatgaatataaaattaattcttttatgggacataccttcaagacttcgactcaagaaattgtatctttctctttcttggggaaaagaaatttattttcaattaaccaaaaatgtgccaaaaaccaattgaagtataaatctaaatggagttccatttttctagtgaggtgcttgctatcaaggattgaaatggtagcttcctttgagtacacaccagtttcctagccaattataacaatatattatggacttttcaatctgaaggtttctttgattatactttattctttaggtacataccttatatattttactagtttatttacacttgacaagatgattccatgtttgattcttctttagtgtttttcttgtagaaaatacagacaaaggggaatttttgtgactttttatttattgtttgtttattttgctatatttataatagtttgggtggtaattggatgatattatttttgtgtttcaaaactctttctttttcaaactgctcaggcactgctagatgtttataccattgaaagagagataggaaaactggacggaattagagttgggcttgtgggagaccttgctaatgggagaacagttcgctcacttgcacacttactagccaagtatcaggatgtgaaaatttattttgtctctccaaacgtggttaaaatgaaggtaactgttgcaaatactaattatggtttcatgagaaggataagatgttgggaattacatgacaaaatgagttatggaattttttattttttttcataggatgacataaaagactatctgacatcaaagggagtggagtgggaagaaagtgctgatttgatggaagttgcttctaagtgcgatgtggtttatcaaactcgcattcagaaagaaagatttggagaaaaaattgaactttatgaggaggcaagaggcaagtatattgtaaatcaagatgttctaaatgtgatgcaaaaacatgctgtggttatgcaccctcttccaagacttgacgaggtaagcacatattgccatgtcatgtgatatatgttatcccaatacgaatgcaagcattaagattaaataaactaaattggtcccttaatttcatgcagatcacagtggaagttgatagagatccaagagctgcttactttaggcaggcaaagaatggtctatatattaggatggctctcttaaagatattgcttcttggttggtaaggatgcattcacttttcaaagtgaatgggatgatctaatgtcaaaaaaattcagttgttttctttgtctcctttccttgccttttagcatgtttggtatcatgttgacgtaatttcacagttagatcagagctggtaggtattgcttctgcgtcttttagtaaatggacgtggtttcccatgtatctactgtgtttccaagcgtagttaggcgtcacaaatacagtgagagggagaaataaaattttctttttacatgagtaaaatttccttgaaatgcaagtttttttccacctcagtgcaagctacagtcactaagttataatataaacaatctaaattattataacgtggaagtttataacatccataaccttggtaatttgttatccataacaagaaacaggaccatgcttctgtgtcccacggaataatctgcatatcatcaaattctggattcaactttgcttacaccatctaattctactgatataaaatgagtaaaagttgaaactctagaaggcaaatgcacaatcatgtctctgcaaggcttaacttccttcagactaagtgtttgaactctgcttccatttctgcaaactaacaaagtagtcttcttcgtttaaatgatccttttatgagaacgaccaaatcctgcagaattgtttgttttacttatgattcttatgctgctttttgacttggttgccttaagcatatgttaatatcaaagtagggattgggatgcgtgatgcaaggtattttgttctatatgactatgtgtttgtgcgtggtcaggctttatggaaatccatattaaggcgcgagttgttattatcgtaataatttcatgaaattacaaatcgaatatctttaaaattagtctttgaatgttaataaaataggaactaaattgatggatatttaatactttgagagcagtgctataccgtacgaaaaacaaaaacatgaaattcacgaatcagttaatttaactccgatataggtattataatttgtagccacgtatatttgtgtggattcgtacaatgaaattttcgtaacatttagtattttccatgtgatattattgtctcagcaaacatcatttgatgaaaggaatggaaagtaactattattggcaactgtagcaacaacgtgaataacctgtggttttttaaactctacccaatgcgaagaaaaaagtaaaaatgaataggctacaatttttctataacaattcaaaagcaagaataaaatcaattaagactataaaaaaaagtcacgtgaatgttataaatagacatggaaaaatgaaagcaacgtcactaataaaatatagggagaaataatttcaagcaagcagtataacttaatgaaagtaatatttagcatagctatacgtgtcagctaatatgtagggaacctagggtccacattgtgggcccaagactctaagccaccaacaatatccttggcagaagtgaaacccattttgtgaagatactgaacagccctttgagaatcatttccccttctgcatactacatacaattgtgcacttgatccagaaactgcaccactttcctcttcctctttcttcaaagctgatgatacttcaggcagcctagcctctaatgttgagagtggaatgttcatagactttggtagagatacaatcttgaaatggtgagttggtctaacatcaaccagcacatgtggttccttcttaataattacttcactgtactccttgctgctgattcttgattcactgggaagtagatttaacttcaaaggaggctgcatataaatggaatggaatgcattaatgacatggaaaatctcaaaataatatatactgggagacaattttgtagtcttttgggaggaattttatctccagcaatctcatccaatacaaagtgcaaatgaaaaatatacccaactaaaccttcaaacaatttcatctaaatacaaaggaggtgaaaggcaagaaaaaaaagaaatcataccacacgcaagggagtctgagtgaacttctcataatcaaattctcggaattgctgttgggtaaatgttgcattttctccacaagcttcacactgcatagaccttcctctaattttgacctgtgtaataaaaaaagtataatcagtaactgataaataagatcttgctatggtatcatcctcaaaaaccataatataatttttttactttgagacatcataattacaaatatgatttggaactgtatatattacaagtctaagtttaatttgggatagccagtttgaaaagcaatttgttattagaattataaagaaaatgattggtctgcatgacagttattattagtgacagaaaaattggtgtgaatatgagaatcactcaatagtaatgtcaatcaattcctctaaagagtatccttaagtaggaaaacctttaccctaatagttccaataccactaggatacaaaaccctaactttgcatccaggtaatttatcgaaataaaatcctaatttataagaaatcctaaacattcaaacaattatttgatgccccacttgtaaaatcctaatagacattggagttcttaacatacaatacgaatccgtccagacaatgcatccaagagaagcatccttcctgagagtggctcaccaacagaagctgcaattttaatagcctcaagagcttggagacagccaattataccaggaactgaaaatgatcagagcaaatgtcagaaaagcagaaaaatagcaatagcagaacaaaaaatacaaaggtactagtgagaagtaatgcaagttgaacaataaatattcataataactgacacggatgataataatcacagtttagctaaacgaattatgaaacaacttaaaacattccaaacaaattgaatttttagccaataagtcttactaaagagtacactctccggtaaacaataagaatttcttattgtttgcaaaaacctccttttcagtaaaacttgattgcttaaaacatagatacttccccgtttgtagagacagttttggcaaaaggaatcaaacaatcagaatcattttttgttgtcactaatagttatattacatattactaaaagtccatgactgaacttcacaatgaaaacaggagagcagaagaatttgtcttatggttcacattgttcatgctaatgaaaatgtctcgcagactagcaatgagaagtaaaagtgatacagttcacaaagacagtagtaattttacctactcctagaactccaccctcagcacaactttggcatgctgttctaggtggtggagttggaaagaggcatcgatagcaaggaccaccattgtaattgtagacagtaagctgcagtaaaagtttccatatttaatcctcaaattgtgatataatcaagcacacaggagtacttgtcgcactatgaagcattattcaacttaaatgctaggggaaaaaaaattagacatatacctgcccttccaatcccagtgcagcacctgatacaagaggctgcatcacaggaaaacagttaatataaaaaattgcaaaagtaacttaagttttcccataaatcatactatgtacataagtataaaaaataagaaccaaaaacgaaattgtttaacggaatgaaatataagaaattcatataattgtaacttttcaaatttataaaaaattgatgtctactgggagcaattgcacaaagattttggagataacaattcatatggcacatacacactgaaatattttatcggtatcatgcacataggagcatgcataacttcctttttgttgaattaatgtagatatcttttgcattgatgaaccaaaacattaaaaataatgctgacttagaaagtgtattcatggaggaaccaaaaaattaaagcaacaagtgaaaaggcccatgtgacatcaattcaaatggtcacaatctgttcatacatcaaaacattcagatttacctttcctagaaccacacagcaatcactgatcaagtatcgggtaggagcattatctgttgcatctactattatatcatatctaccaaattcacataattacaaaaaaaaaaaaaaaaaatagtcagtggtaatataaaaaatgaaatgtaaaatgtaagtatagaagaaagaggcctcaagcaaaaagaaaaatcaatcttattatagaaattatacttgctgagaatttccaaagcgttggaagtccgcaaagcttcttcatgttccacaacttgaatagtggagttgatcctaatattcaaaatatcttagttccaagaacaatgatgatacaaatattacaataacaaacatttgaaaaagaaaatttctcatgggattttatttgcagtttgtcaacaaaaattgatgtgatgaatggttggtgaaaaagtaacctacgagcgacaagcagcagcagcagatttcactttcggcttaccaacatatgcttccgtgtggataacctgaaataaagcaccaacttgtccaaattaataaaaatagtgaagttaattaaaaaaatagtaaacgaacacaaacactgaagcaagacacatattaacaccttgtactcgcaaaagtgcaaacgcccaaaggctgatgccagacacaaacacaacaattcacaatgtacgtgttgcaccggctatgccaaaagagggcgggaaggtaaaacagataatacaatacctgcctatgcatattattcagctcaactacgtcatggtcaataacacccaagcgccctgagtatagtttttaaaatgtaagtttcaagaagcatatagacagaggttatgtttgggacgagaagaaaataagaaagtaaaataaattaagtttcccccataagttaaaatcaacttggcacttatcttctccaaaagcttaagtgtataagatgattttaacttgtgcaagaaggtgacttcatttttctttcttatttccttcacttataagtgtttatgaaaaatttatccaaacaaagcttagaagtgtcatatattaccaacaccagaagctgcaaagtataacaatgcaggagcacccaaacctccagctcccacaactaagattgacgacttcaatagatttgcctgccctgcactccacaaacacaagaaggtgggaaaatttaagacaaaaaaaaaaaaaaaacaagataaacatgcagataagggctatttgtctataatgtctattttcgcagtgaaaacaatacatggcaaaattgcaattgttaaggttgttactataaagcagttgcaacatggaactaactacagttaatactcaaacacacacgtgcaacgaatatgaatcttccttcattcttaatttaaacttaattaggtttatgtagcatgaatgacaattaaatgaatatagaaaatgttgaagagaagaagaccttgaacaccaaaggaagggagcacaaggtggcgactgtatctgtgaatcatgtcctgggtcaatccattggtggggtacaatgaagaagaagaagcatagggtggtgcggcgtcgttttggagattaatctctttgagttgagcttcaagcgcagagattttgtgctcaattttggtcttttcgtccttcagcaaatccagttcccgaagaatctccgacgccgacatggcaacgcaacgaacaaactatctatcctatgttgagtgttgacgatgttcctgcgcaaaagcagggttacctactttctagtccaataatactgtgcttcgaattgatattggaaaaaactagtattaattactaatgtcgtattgatatggttattaaaaagtacagtagtttttacttaattaacatttcattcaaaaaataaacttaattattatgttagggtgttataaaaaatcatttttgtatgctctaaaaggattaataaaggcgtgaattgattggattttttgttttgatattaacattttttttacttttataattagtctttgaatataaaaaattccattatatatatatatatacacacacatattatttctatattcccatagtttttatattgaacataaattattataattagttaaattataattaatattttttgtaaatattttttaaaaatttgtaattagatatcatttatggaagttacaaaaataattcttaaaatttttatgttcctataaatatttaattatttaaattaactaattttaattatgtaaatatatatatatatatatatatatattagttaaaaaagtataactccttaattagttttaaccttttattatcaaagtcaagatgcccaactcaagtttgttagagggtgtgggttcaaatcccacttccgacatttatctttaaatccaaaaaaaaaaaaaaaaaacttataaaaaattattttattttattgttttattattattcaatacttataaaatgtcgatatacattatattaataataattacacaataataattttatgaaacatttacaaagttagttttagtaattattttgtaaacacaacctataataaataaatatttattatagattaatatctttaattttccactaatatattgttgggttgagtgatattaaactcaaaataagtaagtaaagttttgagatcttgtgaatgaaaaaatgtagataaaagaaaagatcacaacaaagtagttaaacatatttttcgaaaattagtcatcaataaaattgatgaatatttcatcatcaataacatataaaaaatatattcatttattttattttggtttctagtatgatatttttattttaaaaataaataaaatccttaaaaataataaatgaatgtattataactagtgaatgaatgcacaaaatcaattactcattaatgacacagttgaaacatgttagtactacctttctcataatacctaacaataatttttcatttaaaacttactttctactaaatgctccactattcattaaattcattttttaaaatcaattcgttacataaataagaaaagttactgtatttttttcaataattacaaagaaagattgtgaagtacatctcccaacgaaaaagtgaagaaagcctcttaaatgaggaaagtaagaataagttaaagattataattgtgactacatatacattaattttaacttttaaattaaattttgattaaaataaataaattagttttgttaaaaaaaatattattcagatatattgatggggaaaaaattgaacatgtattttgaattatgaaagtaattttgtcaatataaactataaaaatattcttataaaggtgcttgtttttacttaacaaaaagatgagtttgaaagcttacacttactacatattagatgtgagatcttattttacactattcaattaatatgttacaaatttagcaatgaatttttaaataggaaaaaagttatagataaaaaatttatttctcttgatatattagaaaattgaattcgattatctaatgatgaaattaaaacaacatatataactaaaatatgtgatcatttcttgaagggacgctttgttgataaattaaaaatgatttttcaacctcaattcaacatgaaaaaacttaccaaaaaaaattccattttgataaataaaattcatggtatccttatttctaacaatacttataaaaaataataataattatccataattagagagaaaaataaatatttttttatagaaaatctttagtaactacattttttaatctagtcagtaaattttcaattttatttattgaaaaatgttagcaaatcattcgttttaaatctaacacatacactttatcattggttaattagaatatattaaaaattacaaaatcaagagaaaaagagtcattaaataacaaatgaaacttaaaaaatttgtaattatcaataaatttcagtcaactataaagaatatgtttaaaagagtatattcaaaaatatgttgttagtatttcttttatttcaatatacttaagtaataaaggttgaaattaaatattaatgttaatcattaaattgaaattataatttaattaattttgtgataagtgtaatgcagtttagtcattgatggagatttttcttttggtataagtcattaataagtgggatagactagacagattcattggattagcattacgtcattaacaaagggcaatacatggatatctggattgagtttgaggccaggagtaatcttgtccttattgtttttggtttttatttaaacagacatgagagcccaaattatactaactagtaactagtctctatcaaacagccaaacatttcctgaagatagagagagggaagaaccatggtaggtggtcagttccacactcttctccatgccacttcaagatcctccatggtaaagcctagcagtagtaagccattcttcaacagcaccattaaggtatcccttttattttcatttcctttttaaatctctgttctgttcttttctttttctttcactcgtgttccaagttattctacttcaatttgcttctctgctctagagttactaatttacattatctacttgctgtggaaacttttttattttttgtacgaatgcacccactagaaaattaaattagactaacaaaacgtggaattttaatcatttttagtttgattttgcctttggttggaaacaagttttaattaactttttgatgtgtttgagaaggtagaattcatgtatttaatggaaggttttcatttttttgcataatccagttcttgaaggtggaaatctagacttgagaaatggattaaaacctagacaggctatgcttaattagattaaagttggaaaagtatttttgtgaattccaatttatatttgtgaatttcaatatataaaatgaaaaaggtagaatttgttaatttaagtgtaaaagcatatttgaactctctaataaaatccacacatgcactcaaagaatgattctattatgtgttgacaacatgtcacagtgaccagaaagtaatgtattatttttttgttattgaaagtatcagaattatgggcaagcgagcaatggaaaccgtagtaaccgtttgatggaagagagggcaccttccacagctgaagagttccaaagagttgcagaggaaaaggccaaggaaaccaaggaaggggtgactaatcagaatgttgacaagtcatatgatggtgcacaagaggctactaaggttcaatctgtcaagaacagctacaaatagttgtttgccaaaggagggttgattagaacttagaaaccactctctgaagtctgaatgaactatgagatttctattctatatctctatataatatatagtatgcacctagattaataagattattgtgttattttcctagagctcccttgtaacttgtaagcgtttctgcagcagcagaaaaaaccaaacaatttaaggccgcatattattaattattaatcattcttgcctcatgtacttgtaactactatttgaaattctgtgaagctaagaaatctaattcagttagtctgagtaagatgttgaagttattatctcttcctcactattttcaatttccaaaaaatctatttgaaatcctgggcttgggggattaaactccgcctttattttagcagattggctggttgattgagtatgttgaaattttgaaaaccaatgtagttaattggttggttagttgtttctactaaaaaaatttaccatctctatttttattttatttcacacttcaaaaaatatttttctttatgtcccataaaaatttaaagataatattaagggagtgtatacggtgtccccaataatttgaggtgttttgatactattaatttttttaatcaattaaattacatgtcaccttctcattaattatatttatttttttaaaattagtccttgattattattttttaaaattttaaaactgtacctttttaaaattaaaaaatatgattaaagataactttacatgtcacctttttaaaactgtaccttctctaatattaattacaatttttttaagtataccttattaaaagagagacaaaaataattgtatatgaaatgtaaaagtgaaaaaaagagagtaaaagatatactaaaaaaattgacagataattttagtatatatgataagattatttattttaaatttgtgtatgggttctaataaatttattctctattttgatgtatatgagtgaagggaaacaaaaaataagaagaagaaaaatgtgataaaaaaggatggagaataaaaagtgagtgcacaaatataattattatttgtgtattaaaaccttaaataataggggaaaacaaggagtattaatttttaaataggtatgttaaaaaagaaaaaaactattaacaagtatcttcaatgtattaattaaaatattaatatttcatattatatatttttaattagtttaaaaaagtattaaataaattcgcaccttcaaagtagtaaacgtttttttttttttcttcctattttaagacaccaggaacaattgcaaaaaaaagataggatgttcagtagagtcttgggagtttattctttacagcatcattgacttggtatgtctaatgtgttgtgtaatcacagcatcgcagaatcagcaattccttgtctaatgtggttagcttttcatttggtgtcaaaaaaagaagtgaaatttgtggtcatttaaacacttttttttccctttacggtgctattggtgaggtgagatgtgtccttatagtccattgagactatgtttttgtcccaactcctttaattttcgtggttgggagttatcgtccactttgaaatttattggaatgagagacaactcgacctactttagtacttgtctggcaatgtgcattattttggcacttagatgtatatctaggtattcgcatttttttataataaaaaaacagtgtatcaaatttaaattcgtgttaatactaattttaatattgatacatttgtctattggctattaataagataatacctggagtgtagatacgttaattctatcttatactgaaataagtatatacttatcatatttaatttgtgtactttaattgataataaatattaaatatataaaagataatctaaattcgatctccacataatacaataatatcaaatatataaaaaattataagattaccgtttaatctaatatgattttatcctaataaatctattaattctgatattattttatcagctatatttttatcaatttaaaccttatacagctatcttatttgcattttttatttattttctccttattttactcttacatccaaataaattgttaaaagctaaatattagtaattaataattgttagatgatatctttgattacaactatagataagatcgtggatattgtggataataacagtaaagattgtaaggttaaatagttaaagatgtccgccgtgattattaggaagatcgtgaggtcaagttgttagagatctcggcatgattatcggaaagaatcttaaactaacttagaggtaagtttagtataaataagggatgcttctagagaaaaaagtacgcacatcagttttctcttttctttccattaacactgtgcacacatctcaccagtatcgcttcgtgcatagtgattatttctttaaaggtgtttctcttccataaacatcttgagagaaagcttaatcctatatagtatttaccagcattctaactggacatttctgttcgtaagaaaatagaacaataatgataataaaatctttcaagtattggatgaacagatattctgagctttggcgacctcctgccatgacagttccccttgattctgcttatggcaccacgaaaattaaagtagtggaccaaaagtcagtcctgtctactcaaattcaaagagataatgaaaaaatatccatttagaatggaacaaaacacctgcacagagattcatacatgccaagtgggttaaaacaattactgtatgttttatttttagttgaaattactgtagcgtattgcaatataatccaatgaataaaagtaaaaacaagagtcgtgatttctttgcaaaaatatttttacctcaaacatattttttcgcctgatattgaaagatgcacttaaactgtgagagaaagaaagaagggtttacacttttactgaagagttacatacttagctttattcctatcctttgtagaatgtgagacaaaagagaccacgagtttgttaggtgtggaaatataatgaaataaaattataacttgactccttgtgttgtgtacaagacaatatatggggccacaagctcacaagagagtttggtaggtactaaagaaacaaaatggaaaattttattttgtgattaattatacacaataactttaaggtgcatgtcttttgacaaaggatgaagtaactaacaagaagaaagaccatcgagaaacaccaaatctacctgcaatgagagttaattaggagaaaagaaaatcctatgtaatttagaaaaaaattagagcttatgcaatttaacaaatataagtggtagcattacatgttttggcatgaataagatgccataacatgagtaaacaagaatgatgcggttgattctactcatctgtaaagagtaagaagaattcattgaacatttccgcgtactatagtctttagtcatgtcagcaaactggtgaagaatctgtaccctgaaatcgccaacacatagccacaaacttaactatctgctcaacataatggctgtgtattaatgaaaaatccaatatagattgggttattattcagtgacatagaactaaagaatgagcattttgtttcgtacgtggatcaggggccctgtcgtacgatggtaaaatcggtagaatcaatgcattgttaagatcctaaaataaggagattcgagtactatatattgaagattcaggtcacagcaggttttgctttgggccatggcataatgcccaaaacaaatgaactcgatgccatggtgtgcatctcgtgtactcactaggcttgggccaagacatgtgtttggttgagtttcttgcctttattttaacttctcccccaaacaagaaacttaaatagaaatttccttataaaaatatattgatttctaaggttttcttcgagaaaaataaataaatatgcacgacttgcaaaaattagtagatggaactaaatggccaaagttcaccatcttaaaattttcaattaccaagtattccattgattatttttttgtcgccccccccccctgcctcttttatcgttcaagcttttagttttctagtagtgttaatttgttgcatttatatcgagaagtgctacctatgccttttttattattattaataggtaaaatcctatattgatttcaacttgactccaaaaaaaaaattattaaataacgagtttcaaagagtatagtccaagcaatttttttcaacatttgataaatttcctcctgctggaatttttctgatttatatttcacatatgctacttttcttttgtcttaacatatgctacttgagttaacgtggttttgatgaaatttccggaatctttaaaagtccctgtcttaaatcgtgagtgccctgagtgatcacgaattgccattatggtttcctgattttcttgcagaattaattactgctgttcattaaattatcccaattatagatagtgtcgttgctgcagggtggcattttcgctactgcactactagtattccttttacgacattcaaacattcttgatgtaaatctagtattaattgtgcttcacggaaaatgacactttcacacaaacacacacttccttaaaaatgtcctaaagtgaaaagtaccaaccgtgttgacacttccacgcgctaacagagcgcgtcgaccaatcgggaatgagaaaaagaagtagtactaataaatgggaacatggtctcttgtgctgctgggtttccacattttgaaccttgtgatcgtgaccaataaatatacttgcatttgaattaacgtcgtggcactaattcctgcttgattttcgttttgggtggcttttcctcatgcgagaccatttccccgcaaattcggttacaaggaaaagtgcttttggtcctttagctcatgccgttcgttgcaaccgtaattaaaggggaagaatggaaaatcagaagacaagcaaacagagttatgaagaaagaaatggaaacacccaagaatctcgtgaattttttaaaacatatagtattgtcaatttagtgttatattcgatctcccttcctacatgctccaagtattacaaatgacacttgcctttttgtgtcggtagctgcaactattactattaggttgccaatttatcaaacttaaaacttttctctcaattgtcctttttgacgttgaaactcactaaattttcacgttttttaattatttagtttgtttgttttctttgtgataaattaaaattcttaggtttaaataaagtcgtaaaatatgacaaaaaataaaagcacatggtataaattgtccaagtctttaactactaacccaaaagaacagaaccttctaatttaactacgaatgcaactctttccaattgctaggccaactataagtggtgcaaattgctattccacctaatgtctctagacgcgtttctgcgtcaacattgattgtatagtttgtatcttactatatactaatatactcaaactacaattaccatggcagtgcaaaaattaagtaagcactgttaagaaatattctttgcccggaataatggaccaaaaaaaattctctataaccccaattagctagaagctaccaaaggggtttcattgtaataaacatcagcatgtgcatgtgattgatgcaatctagcaaaaacccctactagtgctgcagtattgtaggtacaagcctctgtttgaacgtaatttcgtctctcatctttaaattggtctttgatatcaggcccaccaacgagtgccccaatgagtacatttggattgggttcaacacgtccataccaattatcataaccctgagtgcacccaataaaacccttattttccccatatgattcaatggatgcgcccctatggtgcaccctccgcgggaattttggaccgtagcctaccaagtaactcatagccattggattagagcccaaaatataatcaacctgtgattttgccaaggccaacatctcatggggacccacctcccctttttggcaatgcagcttctgatcagtggctaggagatgatcagaatataccgtgagaagaaacgacgccgttgctacgtattgcatgttgttccattggcggatgtatagtaaccctcctggggtgcgctccacgttattaacgctgttgaggttcagacacgcgcataggtagtgctcggcttttgaacgatactgtttgagtatgacttcgtgtttcttgtgcttcttttcttccataaggaactgttaaaaggaaaaatgtcggtaagcaatttacggtacatgaatgacagggacattctttcttgtactcttttaaacatttttttataatttattaaaatttatttttagtgatagatcttgaataaagattttgaacttaatatctgatattcactagatattctgataaaggagttgaagaaatatttaacataaagaatgagtttttataaaagaacccttaatatgtgaagaaatttcctatttctcttttcttaagatctcaaaattagatctaatactaaaaaaaaaattatgcaattttaagaaaactacaaaaagtgatataatatttcaatttgaaatctatcactaaagatgttctaaaaatttattctcgatgtaaattgaatccaactatgctaatgctagaccctgaagaaaatatatatagagagagagagagaaatgctaatgacattttttaatattctttttttaatatttattgattaaaatttattgaaataattaattttaatagtatttatttttaattgatatttttctctcctaatttatattagatgagaaataaaacttgtaaaaattgataaattttaactaattataaaataaatatataaaaaaaaaagtgtgagaaagagtgtcactcctctctctatatgtataaagaaatcaatgatgatccataatatgtaactaaggtccaataatactggcagtatagtgctttttagtttttttttttttttcttttcaaagtgagtatagtacttctaatgcaccttttttgacaatttacaataaagaagggaagtgactctttgaattgggaagtgtgagggaattaccatggaagcaatggcttgaacaccagcgtacttaacgtcccagctgaattcagtcatggcccaagtggtcccaccaaagtcataagccttctccaaaaaataggttaaatattcctccttttgggtggccctatatagccaaactgctgcccacagcaactcatccatgtagccactaaccgaagcataataccctttagccactccaacactctcatcatacttgcccttgtacttgtcaccaaactcaaacaactacaataacacaacaacccattgaaattaatcctaattaaattaatccataactacgtaacattgtcaataaaactaactcatatacctgttgtgcatgatgcaaaagtagttgagagtaatgtgggtttgttctcctaaacaaaatggatgccgctgccaatgctgccgccgtctcgccggcaacatccgagccagggttgttggcgtcaaccttataagctcgccgtgatgtcgtcatgtcctccggccgctgccaacagtagtgatcagtgtcgccgtcacccgcctgaacattttaactcataagaccaaatatacacatataaccacttttataaaggaatttaacatcttcatcatttcattaccgtagcacacttcttttttacttttttattgagtgaaatttctgtatctttcgctaaatatgttgttgtcatttttgcaagtctgaatcctaaactagtgaaatctataacgtacagtattaaaaatatattatttgcggacaatgtttgataaacatgttatcttacacctagagataggtagagttgaaaaaaagaaaaaattataagtatgaaagaatttataatttgattgatataaagaaagaattaagaaatgttggataaaatatttaaaataaataagtatatgtatatcattactcattatttgcatttatatagtaacacaatttctaattaatatattaaaaataattgttactatatgatttaagatattataatctccgacaaatctttatgttttttaattggacgttgggtgtcgaataatctttatgtaataagtataaatagttacatttcttaatttattaaaaaaattcataacatatcccatgattaattgaaattagacgaccggattttacataataattttccttttagatactctaatttaacaaatctcatttacaaaattccatgttcatgccaagctgcgagtgataacacgcgccagtcacggcgagattgcggacgaatccgttgacagctccgacatttaaatctattcctccggttagcttggaagaagtaatcattcatcccattttcaacggcggcgcgtgggtaatcaattttcaaaaaaaaaaaaaaaaattcactggaattgaaattaatacctgaacccaaagaacatttggttgtgtgtgtgccttgatgaaataatcggttccccacttgatagtctccagagcgtgagcatactcgccggcagcagcgatttgttcgccgtattctatagcaccccatgagaggagtgttatggtgaaagccattggcaacccaaatttcacattgtcccctgcatcatagtaccctcccaccaagtccacctacgtgcccaaaaaaacaataaccataatattagaatgaatgaaaagctagcacaaaaggaaaataacatagtttaaggttaatatgttaatatgaagtaatgtatgtaccccttgttctaggccatcagtgagggcagaatggtgacgccaagtgaccctttgattgtagggtaagcgacctgaacgctgtgactcgaaatagaggaggctctgggacagggcttggccatagttgaaggactcacaaaagggaataatgaagattgtgatgagagagagtaaagcaatgtatagtgtcgaacaccgtatattgttcttttgaacattgcctttcttcatttctccctctctctctctctctctctctctctctcccccatatgctatatctttgtttctctttatatatgctgtgtctagtgttatggggttacgatttacggtgtcgttttcgtagggtcttggctagtgcatttggtctctcgtttgttttgtttgtaaacaaattcaaacagcttaatagaatagaatgtaaagaaaatatattttttaatcaagctgggcgcgtgagaaacatgataggggtgaattttctgtgtaattgaacggctttattatacatttcaatttggaacggtaaggaaacttattattcttagccttgctagtgtatagaatggagcccgagatgtttgaaaaggtatttttcaggaattcaatcaattctcacttggatgctagcataacggtatgtgccatgtgtattgtcttttaatgtctttgtgtatgtaaaaatctctggatgtgtcttgttttttaatgcctttgtgtatgtgagcaaaaatatggttggtaactttattcatgcgaatgcctcacattacaataacgaaagaactgaactacctgtgtatgtaagcaaattcatggaaggtaactttattcatgtgaatgcctcattacaaaaacaataccaaatttcacttttccaaaccctcggtccggttgattaattctttttccctttggttaaactttctatttatgtttggcttaattagacttttcctatcttaggtattataatggtgcattttgatcttttaaggtttcaatataaatcgtattctctaatattataattgtgcaattttattattgttgtgatgtggatatgaatcagggcaatggcacaataattcatgatggtgatgagtgactttggtagttttactcatagagattctcacgatcaaatcaaaatgtctatgagagtaatgaatgagtgaagttattcatgcctaagaaaaactcacctatataggcatattcagcgagaaagacagttgggtttgttggattccacgtgtaagatcacgtgaccagatgtaatagggtatcctattagttaagtttggatattactcttatttaggtaatttggggttaagtgcaagtgatagttttagctactaagtctggtgttgtttagggtggttacttttagtctggggtaaataggaaaagcctctttttatcgatcttcaattaaatatttaacaaattttgttaatatgttgccttacacaaatggttacgtattttcctaaattatgtgggaaaaaatgtaaacgttaatcaatttgaaatagagaaaatacattgtatatataatctcatatgtaactagaggaatctctctattaaaaaaaaaaaaaaaaaaactagtttaattagccggaaatgaaaagaaaagaaaagggaaaatagtactattgtcgtgtttaagtattttaggtgtgaattcagaaagaaagaaaaaagtaatttagatgtgaatatttcttatttctttaaaatttatttttgaatcataaatatttacattattgcctagtcattcaaaataggattttttttcccacagtaatcctttttaatatacatgatattgtgctaatgatatatcgttaaattttaccctaatgcctattttatactcacttgctattcaaccattttaatatagttttgggtaagcttgctaagtctaggcaataattatactcaacttgattgaatggtatgtaatatattataacctaaaaacagggacggattcaatttaggcccaactgcaccaccagatttttttctcaatgtatgtatagttacaaaatgctttcataatttgaaatgtagtgaaaaaaaactataatatgaaaatcgttcctagttaattatatatgtgaatattatttctacagctaatttttttttggatccgtgctgcttcaaaagctattcaaccatttaatgtctttatgagataaaaaataataataacttcaattcgtcaaatgtgaataggacaaattatttggataaaatatatttgtgaatcttctacattatacgttaggatgctaaactcaactcacaatttttttaggctcttactatttacaccccagacacccccttcctacctctcaattactcattataccatttttttaaaagaagtataccccttttattttccaaaaatgtctttccaaaattacatatacacattccgtaaatgtatttccctaacaatgattcatagttataaagatatacttccagaataagtatatattttttaataaaatatcacttaagaattaagctgatttacaataaataaataaataaatgataaatatttatattatactcatatttgttagtcttatttttatcctatttgttagaaaacgtgggtgtaaatagtaggagcctttttatggaagaccaacttacattaataatcgtgttattgggacatgcccgtcttcctgatggaccatacgtccaaagctaagcccgctatccactttccatttggatctaagagtgaaacttcttgcaccttcatatttttgcttggtaatgcaagagggtgcaggaagcaaactctgaatgctatacatgtcacctgtgcattctcttatgcactccttttgacaaagagccagcaagtgcattgatctttattgggtttgaaactgcctctgttgtacgtgtgttgtgtatgtggtgaaactgaaattattcaattttaacgcttttgcttatgataaataagctaatgtgagtatccttttgactgatgtggaaaactttctttcacctgtactgaaccgtgagaaaccaaggagtaacattcgaaaatttatttgcccttattctgtaaattggagttgacgtttgaaagggcagttctggacgaaattatcatagggcaccctggatgaacaacatttaaaaacattgatctaatcatctgcttaagaatcttagaaacactaataagtgcaaaggggtaagtgggacaagattggcaaacctgagatcacaacgcaatatttaaagggtaaaatactttgttcttacataagaaacaaataatatcttttaaacaagaataatattccttaatatatctataatctataactatatataaaggaaatagggtactttagtatataaatttgtatacccattttaataactacaataataaattattgttttatctctataatcatattcacaaatcactcactaacttttattatctttctttttattcaaagaaaatggaaaaacagtttgcctgttttctcctagtaataataaaaaatacaaaaaaaggagctggtgcgaagagcagaaaaagggtctgaatatcaactcccaatcataattctagaggcctacccgaataacagttttatttattgggtcattatcggcatttatttcttatactctaactttcactattatatcttgtaccttctattatgttctgaaaagactatttcaaaatggtcatttacattctttttcagaatgcaacacgaggtatatgatataatagtgggactgcaagatgtaatagccctaatgaaatcgatttcataacatgaactaagagagacactgataatgaccaaaaacaaaaaatcatccgtggaccaaaaaaaatgaaaagagctgcacccgaaagatacaggaattaaaagagaaacttgaaataagtctggcctttcacaagtaacacaatcctttattggaaagttatggctttgtaagtttccttcagtgacctaaactgataagattgaggtatttgttcactatttaaaatttaaattaaattgtatcgaattttttttaaagattaaattgacttcatccattggttctaatacttgaggaacgtattattggttctctcccttaaaacacacgttaagtttttccacttgtgctcttaaaaatcttccgtactatgtgtgtcaaaaagagtgagatggaagaaaaaccaattcatcaattatactcaaagacgttcttgacgcttatgattttatttaatcaggatatggacaatcatgactttcacgattctctgtttcacggcttccacattatgatttacatgattatggcttcttggtctaattcgggtataaaaaatcataaatacaaaatcctatgcgtttgaatgctttcccattaagatttacatctatttctcactccagcacaatgaagattgaattcaatgccaggaatttggatgacccaaaatttacactgtatatattattttaagggaagataagtaaaaggttcaggattttttttttttttttgccggggggtgggtggggggggggggggggtgggaggaggtagggagggggatcaaagaatgaaaataataaagattaagattttatagcagagtatgagattgttttaaatatattgataggtttatgtttaatcctctagttcaatatattgccataatttgttccctgaagttaattctttctaaactaacttttggttttagtttgaaaagttatatatctgttttttctaaccaaatatttcacagctaaagatgagttctatcgtttatgttcttggtgaacgagttacttaggtttacaaatacagttttatgcctgaagccatggaaaagataaatccaattttttctgttggggtggctagaaacaaggataaatatgaaacataacgtctacattatgatatatgcatgtcccacttccacccaatccatcaattgagatctccttgtccttatcgaacaataaaatgctccctcctcaaatggttggacaaaagcctctccctccaaaaaaaaaaaaaaaatcttcatccccaccacagtgccccaatcaaaccctagcaagctaaaattggtgtccaagtgaaccaaccagaaaaccgtagagtgaacctccatcataaagacattaaaaattgcccatataagcttatgtatagttttagggatgaattcacctaaaatctccagttttaattgaagaatttacggatcgtctaagcttagcatgaatgatctattaatttattctttatttctacttttgttgaaaatgaatttttagaaggaaaaaaaaaaaaaaaacttaagatgacaaacataaactactaattattttatttgtattacttcttgttaatgttattctccatcacatatcgtggtagactggtagcttggacaaccaagtgtaccagatgcaattatatctaatgtaacactagttattaagaaattgaacactatgaactatgaattatgaaatatgaatgagtcttaccgacctaatgaggcgggtaccaatccaaatcgcctatcatattttagtacacctgagagtttaagtgtagaaacgtcttagctccctatttattattaagatttttaaagtaaacgatacctgtgtgaaattggaaagatgcaagttgacaaaccaattttgacttgattaaaataaaaggttcatttagtgtgcaaaatatacagctaatgatttgttgataactaccattcgataatatatatcttttaaaatttataagctgatcattaattaaattaattcaatacatgtgccaaataaaaatatatctttcatctaacaatttttttccgtaacaagtcccttttacttaatttgaataatgacatgactgtgacgacctgaaatgggacctttaaattgatcttcatttttgtgcatgccaacgccctatgtgtggcgttgagagttgaaccgaaagaaagaaagaaaatgccctccaactccgaccacttcctttggttaattcaacgataaataaattcaatggctgccattattgttaattttctttacggttaataatattattgaaggataaaatggctgcagaaaacaagtactaaaattgatgttttattaattggcaccaaagtattaattactactaccttcgtccgcaagcattttcaattagcaaaaggtcccccatacgtatttgattgcatcattcataattgcaaagctagttggctgtttgtgttagcatggaaaaatggggcatttcaccgactaatctacggcacaataattttttctgtataaaaagtattaatcgcacgtcattcttcttctgttttttttttcttcttcttgctaatggcacgtcattttatcttttctcatttgtgtttctcaaaccttgtccatacggtaatatgacaaatgaaataaatttagttataattaattaagatgataaaaatggataaatataaaatattttaacattaattattatttcctagtgttgttctttttgtttatagggatatagggtgtgacaatcatttggcagttttgattatgtagactaaaataatgttaaatgaaaaccctttgaaaatatgacatttaggacaaactaagtaaaaataacggagcaacttgagtttttggttgtatatgttgctattttaggatacgtttggatgaggatttgatcaatgacgatagcatcaatctctgtttagttttttaaagattcttatttttaaaaataatcatctgacttttaaatgatcagtacaataatttaaccatcaaatgatattattttaatactaaaatatgtaaatttatttattggggccaaattaagccgataccaattacaccctacccaaaagtcattatttcaggctgcacaaaaaaaagtcgttattttagggttaatttatcggtcactagctatttaaaggtgcattcacttgaaaatttactcattttctttttcatagggtcactaaattaaatgttagtaatcctgaaatacatatcataatcaaaggacaaaaattgaattttggcatgtcatttgtctaaaaaactttatcctatcatttaatatattttattatacaatttaattaatttgacaacacatgaaataaacaaaattaatggtatatataatttttttactctaatatctctgtactggctatatatgtagtacatagattgaattttggcatgtcatttgtctaaaaaactctgataatgtattcgacataagaaaaatcttactctaatatctctgtactggctatatatgtagtacatagattaacaagttaaacaataaaaaaaattatggaataatttatttgttgttgacattatgattttttttctgtacttttaattctttaactatccaccaaatatataagatagaaatcacattaataataataactaataagaaaatgtatagaaatcctttttattgcttagctcaaggaattagttattatcctcctcaagtaaaatttctatgaaactcgtggggaaaaagatggaatttccacacgatggtgtagtagtgtctttcacggccttttgagattttgactaagataaaatccctatcatttcgaattaattaatggctataccattctgtggtgggatgaatgaaatcagaaggaaacacacagatcaattaccaacatttcccgttgccaaacgaggagaatgattattgatcgatcctgctgcatttctcctttgtcaagtcttcatcattacgggcatatttagatacataccataattacttttgagaattttttttttgaaaatatacgaatttttcagtagaaaaatttcaaaaaacacttttaatcttatattcaaacaaactctagtttgtcctcttcaaatgttctacaagtcttgtagttttcattggtcttagattcaacttcatttgatctgatctacaccatttgtttaattaaggaattacgtgcctatttggatacacggtgacagattaaaactaattttgaatacaaatcattttatcaaatttattttggaaattattttttaaattttatttatatttgaatacttttactataaaatcaaattaaaaataaaatatattataatttttatctaaaacaaaaattattcaaaattatttcaactcataatcaatttagaacttaaatttaatttcaattttttataaaaaaattaaatatatgaaaatttatctaaaatcaattttagaaccacagttaattttctaacctaaaactaaacatgcatgtttttccccttgattataattaaatattaatttaatttaatttgaatgcatattcacggtgtgatttctttaaaacttttataataactacttaaactcattatctataagcattataaaataaataatctcatttttttagatatttttatccttaattatataaactattacgacaatttattttaattttaaataacaattacatattttaaaataagttacaactaacaaagtagttttggaataatccctgatatgcattagataaatattagtatttttattgttaagaaatgatttcttataaaaatacagatcttatttttttttaaatcatattacataaatttactccaataaaaaatttataagaaccgatttcttcgtttaaaaatcattcaacaaactttgatttggagatctctaaatctacagcaagaaatgaatgtaagcctgaagtaaagtaaaatcccatagcaaacgataaaatcataaaataatagtattactctgtcatgatgatgatgcctattatagtattattcatttgccgagagaattgatgaattattatatatatagtcctgaattaattgattcccacccaatttatttctttttacccagaagaaacaaaaacagagagaatgcacatgtcatcaaatcaagcacggctggatggcaaagtccaacgttcaaatttgagcaaaattattgaaaccttggccctgtttccgtaaattcatcattgtttcaatcgaaaatcaagccaataatattatattttctcggctatagaaccaaacatgtcccttggcaatcgcgacctcaccccgttccattcgagacgtgtccctgtcgacaacgttgtcccaaacgatacgctgcacgtgtacggtcaataacatagcctactacatgatccaacggacagttcagctaacattttctaactgttttttttctatacaggaaaaaaaaaaaaaaaaacatttgtcttccgcaagtagtaacattttttctaacctaacattagcggctctgagatagtgcattggtggttgggtctccaacacaggtcaagggtcccacacggtgtaaagtgaaagctcttttccttcaaccacgttggcccactaagtccccaatcactctataaaattccacaccctctcttctcacaaacaaaataactgcaccctttctttttcttaattcctctctaattatctgcatgctctgcttctctctcaaacagagcatggctcctctcacattctccttcttcttcatccttatctcattcttttcttcatcatcaggtaaatacatctctcactactcttctttcagtttgtattagaatttcgtcttaccaagatgaactctggttgtaattagaaaatagcacttatgaaactgcatgtatattttgttgcttcgtttcattttgcatttgaaagttgttaactttctgacgggctttgcagaagcgggatcaatcggaataaactatggaagaattgcgaacgacctacctacaccggcgaaagtggtggagcttctgaagactcaggggctgaaccgtgtgaagctctacgacaccgacgccaccgtcttaaccgcgtttgccaactcaggaatgaaggttgttgttgccatgccaaacgagcttcttgccaacgccgccgcggaacagtccttcaccgacgcgtgggtccaagccaacatatccagctactaccccgccacgcaaatcgaagccatagccgtgggaaacgaagtgttcgtggatccaaacaacacgacaaagttcctcgtacccgccatgaagaacgttcacgcttctctagtcaaatacaacctcgacaaaaacattaaaatctcctcacccatcgcactctccgcgctccaaaactcgttccccgcctcatccggttccttcaaaaccgaactcctcgaaccggttatcaaacccatgctcgacttgctccgccaaaccgcttcctacctaatggtgaatgcctatccgttcttcgcttacgctgcaaactctgataaaatctctttagactacgcgctgttcaaggaaaaccctggcgtggttgattcgggtaatggtttaaaatacgccaacttgctcgacgctcaaatcgacgccgtttttgctgccatgtcagcactcaaatacgacgacgttaagattgccgtttcggaaacgggttggccttctgctggggactctaatgagattggagccagcccggacaatgcggcgtcgtataacggaaacttggttaagcgcgtgttgagtgggagtgggacccccttgaagcccaatgagtcactcgacgttttcctcttcgcgcttttcaatgagaaccagaaaacgggtcccacgtcggagaggaactacgggttgttttatccaagtgagaacaaggtttatgatattcccctcacggcggaggcgccgccgtccggggttggaaagagccaggttccggtgagcggtgacgtgacgacgtcgtctaagggccagacgtggtgcgtggcgaatggcggttcttcggagaacaagctgcagaacgctcttaattacgcttgcggagagggtggggctgattgcactcccattcagccaggtgccacgtgttacgatcctaacaccttggaggcacatgcttcctacgctttcaacagttactatcagaagaaggcacgtgcatccggcacgtgttattttgatggcactgcttatgtcgtcactcagcctcccagtaagtactgctgctatagtcacttagttatatttttatttttatactcatttttatccctataattatatctctgttattattttactttataatcttctttacaaactatctcctaacttttattatctatctttttttaaaaaaaacttgaaaacgcagtgagacacaaaatgcctattttccctgatcaaaataaattaaattaaacgtgcattaataataagtaccgactacgtgcaagaaatgttatgttttatttgtttatttcgccctatggccctatcagttgataaggttgaaattgagggtttattattgaatattgattgcttggccctatatggtcgacatggaacggttattttgtccatgtcattgcattaaaagcattatgcatgagtttagattttaatttttttttttttgttccaagagatgttaataatttgtgttgaaaccgtgtttttgaatttgtgttgcagagtatggtaattgcgaatttcccacaggacactgaaatgacggagatggagtgttttttttggtgaagccttgatttggatttaactggatttcgccggagtttttatgagcttttccattggtagcacgtgtttaggcttggagaaatatgcgttagcgtaactgtttgtaataaatcatgatgatgattactttggggggttattgatttcttttactcatttatttgtaattatctctattttttcaatgaagaaaaatatagaatacaattttttttacttgtgtttctactttacgtttctttgaaggatccatttcttctactcttttaaagcatttatgacttcttggtgtgcaagttattttagcaagcaatgcgagcttctttggaatgtctatcatagtttttatttattcaaacgagtactaccctacaaacttttattagactacaccgtacgtaaaacggaggctaataactaataagctccctaaattgttaacataaacaaaaagtaatgactatatacaaacaaattgataagttgcctttgaaagagcatatgttaattataaaaacattatatatatatatatatatataaagaaaagaaaaaaaacccacttggtacataccaaccggccaccatgcgtgtgataccgtcgatttctctatttgttggggggggggggggggggggggagggggatactatcaaaggacactataatataataaatgagtcaatattaatttgacttatttcagtgaaataattatttttttttccggccactataaaccataggtgtgttatgcaggaattctggtgagagagtcagatgtgatgtcaatcattcaacgaaatacattgtatttactaagggttaatcgacaaatttttttaccctttctcaagttgtttatgttccacgattggtgtctagtggtcatgaactgtgaccagagtgccactgttcccaaaatactaatcaaaatgtcacgcaaaaagtattaattctcatagtgtcacccattttaattcacaatacgtctaagcgaatttcgtcagctaatgtaacgttaatttgttggttgagcataaacgggtaggacacgtgatagcactacataattcgtttggcccagcaaaatacaaaacacagataataaaaaaagagtcattggtaacatgtgacatgcatggacgaatttgcgtcccagcaaattacgtttacgtgacccactgtataaacatctcccccttcccaccccatccctccttgactctccccagcgtgaaaggtaagttctttttttagtatttttctgttttttattttttgtaatttagtgttatatatttttatttttgtaatatattatttatatagttttagttgttaaataatatttaggtttgagatttaaaacattaggttagaggatatttagtgttagtttaggattattaaattataggatacatgatagacatatttaattaaaaatgacaatgttattataaaaatttaatattgtaatataactcttgagatataggaatattacaatgcattttcctgatgttgaaatacataatttaatctatttaacttttttttgtatcagaatttcatctatttaacttaacattgttaaagaatatttatcataaaattttaattatagattcatttagaaatttgtacggtcaaaatatatgtgtgtgagcattatatttattaaattcaataaaaatattttatttaataaatataatatatagtaatagtattaaaattaattatatgttataattaataaatataatatatagtaatagtatttcgctataccacggtcattgacagtttgaccacgtatttcgctggcacctatagcaaaatacatggccactagattgacgccacatcagctcacggaatttgctgggacgcgttgcgaattaggatgcttagtactctgggtattaatactattcactaggcattctggttaatttttttgggaacaatggtactttggtcatgttcctcatgaactcaacccatgataattaccgacggagtaagtactcaatctataagccttcacaactctttagtcccaagcctagagggcgaaaaagatttgcttatttgttttttcaatgtgaagttgggtaagtgttcgacctataatttaagagggtccacacacaatagccttgagaccaaagggtggtaatgttgcaaaacgtactcaatgacgttgtgtttctatcttaaatttgtttaggacaacagcgatttggttaagggtaattgttgatattgttgcttacttctgcttatgtcaagtctattacattgtatttccttcttgttttgtcaaatttttatctcaagcagttttattgtcattctaatgagctgattaggaaggagctacccgtcaacattttaaggaaatcggcccaaatcttatttgtgccaatttttgttcgtttcatgtgatgctggactttctttagtcgccatgttatattcaaccaaaacatgttaacgggccccaggcccagtttcacataatcttaaaaaacattttatttttttagtaatattatatcttataatttctgttaaaagaaatggttgccaactaaatatgttcaagaaattgggaaatatattattataaattaagtgtgtattttaaaatttagataaaataaaaaatataaaaaaataaacatgaatagttaattttattagaacataaaatttagaccaaaagattgaaaatacttaagattattaaaaattaattctataaacttctttttcaatgcaaggacttaacataaacatttagctttagtgtcttcatatatattttctaccatacacaaaataatccaagttttattcttaataaaatttcatcatatgcatacaccaaagaaggaaaaaaaccaagtaatagcagtatatgaacttttaatagactatgtatattttccggtcagagttaaaattattctttggagacttaaatatattttttatttctataatacattgattgttttttttgtccttataatttttttaaaaaaataatcaatgtaagatttctcttctttattttggtgcttgttattgtaatatgtgattaatttgcttttagtccttatcattttattccaaaagaactaattaaaaataacaaatattattttattttctaccaaaaaaattaataataatactacaatgatcaaacaaagaaacaatatatagcagaaattaaaggcatatttaaaccatcttttgaaatactacattttttcaatgaatatttttacattcacacaaatatggggaatcgaactcttaaatcaacagacattctatatttttttattagtaaggcgcatattatctatttaacgtgggtattttccaaatcataccgaataatcaatgaaaaattgcactcacgcaaacgcagaagaccgaagaggtacattttgtagcccagtgtccattcatttttcttttttgctaaggaatttacgaatggtacaacataaagatacttattttatgctaaattacatctttcaaattataacatattgccatttttatattctatctttatttataaaaaatcattattagttttcgaaattaatttttttcatataatcctatttattagtctttcactatttttcctgacaagtattgatttttgttttagtttctttaaatattatgaccttttatcttatctcttatttttatttttcagcgtcacataaatatttaacagacaatataaacgaaaaggggttaaatgagagattaaatacttttttttataaaaaaaaactaaataaaaacttgtcaacaacgtcaatgtttattaccagagttaaaaaaataataatattttttacttaaaaaacgggagacacattcattagggcagggtttagtctattatggcatgtgcatccccatgttcaaattaggcagcttttagtttctgatattttgggagaccagactcccccgtgttattggtgtgtagttttagtttgggtttggaccctttgccttcaaaaaaataaaaaataaaaaggtttaattccgtttccgtgaataatgagtttttgcatctgttagtagtatttaataaagcttattctggaactttattaaactaattgaaagtttagggtaatctaattagtttgatttaaataagcaagtcgaaggtgagagatgattggatgaagaagttggggtggtgtgagcatatgatattattattagtaggtgttggtgcgttgaaagaaacaataataaaagcgtaaccgaccacacccacccaaagccaatgtattgtattctggataagcacgaaatgaaaatgttgttgttgttgttgttgttgcgtaaccaacaaaatgcgcgggtctatcattttcccgcgcgcgcacgagtccaccaaaaccaaaacaacaaataaaagaaacagtttattattaatttagtgtctaaattattttaaataatttaattaattttaaactttaaatacttaatttaatctttaaatttttaaaaattaattaatttaattttcaatattttttacaaaattaaagattaaattaaatcatttaaaataatttaaaaatgaaatgaataattaaaccatatggaaaagacaaaagcctgtgaaagagagcaaaggattggacttgacttggccatgattcgatgaatgaatgcgtttcccgagcgagctgctgcaactggcgtgcgcgtttcgcaagaaaataaaaattaagagaaaaaaaaaaaaaaacatgcgttccttggccaacccaaatttccagaggagtccccacaactctttaacctatctatctaactctctttgtctttgcttcctagttcctacccctttcctttcttttcctttccttttccttttcctttttctacttctctctgtcctcacatcttacaaattacaatcgttaatcttctcaccatttccatcttgtgcagtaatatgtaacaaaattcaaaaacagtgcgggaaatatgttgatactatatttaattatctattgaattttactctatgaatagaaccaagtaagtaaatgtctaaatgatgaattcaatatatttaactaaactcacgtgaaattcattcagtaataaatgttggatcacaagtgtatttattttgaaattttcaatttctaaaatatatttatatgacattacgtttaaaataagatggtatgaaatggaactttataaaatatattcattttgtgttttttttaaaaggtatagaatagaacaactcttattataacatatatttactgaacatatgatgtaacgtgtatttcattttattactgtaaaatatattttgataaatagttagagagagaaagaaaaatcatatattattttgatatatcaccagttgaccatgcatcttaatcaatcaatatatccttcaacattattgtcgttcattccttaagtggaaaatttagaaccttaagttaaaaggagcaacctatttttaaaataaattttaataattatttacaataaaaggaattggaaattaaggggtaaaatatacatttttaaatattatgtgtaattttttaactgattagagtgcggatcttccattgtctctgacaggacttacataaagtgaaaccttactttaatttgattcacctacttgagttgatcatatatctttattttctatatatatatatatattcttagtatacattttttactactgttaaaatatttttagttttgtattttaatttatatctttatatttaatatatattgacaaatatttgtataatattttaatatttcttaattattaaagaaaaagggaatggggctggaaagtggagacgggaatgtggagggagaagagagaaaaaagaaaaaggtaaaaaaggaaagataatcaaagaaagcgaaaaaataaaattaaaaattaaaaaatagtaaccatttgatgacaattaaaatcgatccaacggttaaaattattcacgcacggtataaaacatgttttggtctcatacgactccgtcttactcaacagtcaagggttgggtgatgtgtaatggatacctgactagtagtttcaagcatagttttaaaaaccggaccgacccggccggtcggaccgggaaccggtgggtggaccgggtcgatcatgtaatcagatcggctatgctttcaacccggtgtaacccggtgtgacccggccgggtcaatggtccaaccagcgacccggtgacccggaccgggtcactatttaaaaaaaaaaaaaacgcttggtagctaaaatggcgtcgttttgtgatatttgttacttgtttgtttgaacttggacaatgatatttttttaaacatttttgtatctaaatatctatgttatgaagacaatagtaatttgtaattttttttaaaatattttaagacattgtcatgcgggtcaatcagtgacccaccggttcgaccactaaccagatcatgcgggtcgatcagtgacccaccggttcgaccattgaccgagtcatgcgggtcaatcagtgacccactggttcgaccactgacccagtgacccagtaccctgaccggttcagtcaccgggtcggtttttaaaacactggtttcaagaaactggtcgaaattcgataattaataaaactgtgaaaatcgtcgtccaatcgaagagatcaaaggaatataagtctaaaataatttattgatcaatttatatatatatatatatatatatatatatattatgtagaagaaggagtaaaatagtatgatattttgtttaaatttttaaaaatatttttttataagtattttttaagaaacaaatatgttttatttataaaaaatatttatttaaataaaaataatttagacaaacacatcagaaaatataaaactatttattttatttgaaaacatacttattttagaaaaattaatttaaacaaactagctcaatatttgaggagattaaataactttctagtttattttactaaaaaaaaagtttgttaaattagtatgtttggtaaaagagtttatttgaatggtctatattgttttagtagtatttcatatagcgtttgaggttataacttcgtaatttatgtttttcttcactactatcttattgtaatccattttttaatgtcttttaatgtcactttatgtatttatcacctacttagtttaactagtagttttgtacaaaatttaaacgaatatttattaagttaaaactataatatttttttatatttctttttactgattaaatttttaaaaaatatatttaaatttcttttaccctacgtactgatgcatgtgatgaaaaatagttcgaaattaaattaaagcattttaaactagcaggcatgttactgtgcttctgaatagttgtatcttttttttatcgtgcctttgacaattgcatcgtctatctgaaatggcatatgctttaattactgtttactttaaaaagaaagctgaagaaggggaagaaatgctaaacgtaccaattgttcagtaaaatccagtctggtgaatttcttagccagaaaaaaaaaaaaaaaaaaactccttttctttcatacgtaagccacgacagggggagaaaatgtagttgatgatatttgaaacattattttgtcgagaatttcagtgatattttcttgtgagtatagatgcatataaaatgaattcacattatttttcaaaacgactttgagtacgatttaattttccacacatacaaattcaacacatatctcatctaacatgactatttattttcattttattttttaaaaatatagcataatgtccaatcaattgataagatatagattagtagattatattttagaataaaaaaatataaatttaatgtaactttagataagatattatctctatattttatatgatatttttaattattttttatataattttttctttatttttttttctttccatttttttaatctttttttatttattattagatttatctaacatcgataattaatttgaactaaatctgatattgatattaaagtagtattgttgatatcaaaatttcttttgcgaagtcaatgtttttaagcaattaccaaatattaaagtattggtaaaaaaaaactattaaagtatattcactatcgtaataatcactaatataccaattcgctttttctttataatgtgctcattatgatattatattcgtatttaccctcaatcatatgaattatgatgcagtggttgtatatcttatgcgtgtcctcccccctagctcttttattttctttggttttaaggcgttgtttggttcatgttatgtaaaacggcaagaaagtacttgcttcttgaaaattagggaatcgatttttcaagaaaatacggggaaaaatcataaatatatcgaaataataggatcttatttatagaacaacattgtagaaaatataaatcatgtaaattgtaacttaaaacacatatttgtagaaatataagtgacatggcaaatttctaactgaaattatttatatgcatataaccttaattttttatcgaattaaattgatttttaaaattaaacccaaaatctaatttaatatttacagattattaatagaatttggcataaaatttcttcaaaatcaaaatcaattgctttagaggaagaagattatatttatttattatgatacatataagatcattaatttgtgtattgccattttgcatgtgcccaccgaaaatagatatacttcacatatgttgttacaacaccaatcattttaaaaaaatagtaattaataatttttctaataaaaattgcaaataaaaagaagaaagtttatggataattattagaaattggcgtaaaatatctcgaaaattaaaatctatttcttttagatgaaggaaatcgtatttattcattaggatttaacttacagataggaacatccatgtgtttccgactttgcgtctgaaaataagtacaattcacataagtaattgcaccatcgcttatatcaataaaaagttagttctaaccacaaattagtaattatcaaagttcctataaaaaattacaaacagaaaggattaatatttggctaaatgtgaatggcacttgtgcacagcacatccaacttattggctctcagcctaaataattaaaatgaacaaaaataaaaaacaaactaatttccttttagaaaataaaatttatggatcattattagaattggcctaaaatctgtacaaaatcaaaatctagtgatttagtggaaggaaaatgtatttagttattaggttttaacatataaacatacagatgagatcatttgtgtattttttactttgcgtgtgcttattgaaaaatgcgtagttcacttgagtaattacatctttgattattctaaaagaaagttagttcacaccactttttttcgctgaataattcacaccactaattattaataaataaaagtcatatcgaaagatacaaggaaaaaagattagtatttggccgaggacaataaattgacattgtttattcttctgatttttagcaaaaaatgaaactacaacattaagtattaattatgtggaatatgtatttttaagtaagtcagatacttcttgtacaaaaaaaagtaagtgagctacttaaccgcattgacaattatggattaacgtaagcatttttataatttttaaaatatactaaactaaaagatttgtatcgcttaattgagaagtcttaaaattgaaattcatgtttttgaaactaagattgaggctattaatatctatttaaacatactggactgtttgtttttgcttgaactttttttccctttatttataataataataatgtagaatcataattcgtaaaaatgaagatcgtgtatatatagtgttagaaaatacgtacagtttacaccaataattacactgctgattattttaaaatatagttagttcacactgctaattagtaattaataaagttcttatgaaaaacaaaaataaaaataatcatttaagcggctataaaaattgcaattacgcatggcacataattagcttgcttgcagggaggatctagaaaaaaaaattaggaagcagtagtgagtgctttcgaatttttttttttaaagaaaattaaaagaacaaatcattataataaaagtgtaaaatatggtataatttaaaagaaaaaaaaagataaaattaatgtgtgactaatacttaaaataacaaaagtgtgataattatattcatgaaaattataaatatatatattcatactcacttctctattattttttatctttttattattcttttttcatgtttttaaattttttctcgtacaaacatgtaagttatttttttattttattactataaaaaaattattcaaaattaacatttttaaagtatttttaaaaatttaagccaacttgaaacgtggatccgcccttgcttcctcgtccacagccgaaataattgaaatagatgaaaagaaaatactgtataaactaatttctttataggaaatcgatcgaaatccattgcttcatagaaaggaaattagtatatttatttattaaaatttaaaacagagataagatcttcatctgttgcatttatgtttacccctccctctgcgtgtgcacccagaaaaaagaaaaaaaagaaaaaagaagaagaaataatcagaggtatgctatcatgaaagggacctcaccaaatcaaaagtacaccaaccaaggcaaggcaaatttacctccaagaaaccccaagggccttctcgtcatttcgagaatcccttaactcactcttcgtaatttgcaaacgagaaaaatacataaaaaaacagagattctttttataaaataatataacagaagataaagcaagggataaagaaagcaagacaagaggtcagttagagaaggaaggcagccagaaaggtaacaaagaaagagtctatttttgaacacctcctaattttgaacaatttatcaatattttttatttttctctcatcatattatatttttttatttttttatttctattccgtgttaactagcatttgagatgttgacaaatatttttccataaagaaattaaaataaaaaagttaattttttatttaaaaaaatggcattagcttagagacagagagaggcaggaaagccattgagagaagaaaaacgcgaacacgctgaagacccattttttgtattatttattaagaatatttgagtgtgtgtagttgaaggagcagaagaagaagaagagaaggtggtaccgccttcaatcctttctctctccatttctcatacccatcatcttattatacctcttccatctccataacacccacttgtgaaaaaaacccattaatatatatcacactcacagatacatacacacatgtctctctgagctccaatccaatccaagaccacaccttgttgtgtcggacgaacctcggtttctgtctttttttttttttggtttcattaatttctccgaagagatgcggaagggcagaggaggaggagcctcggcggcggcgttggtggtggcggaggtgaacggatccgttttaaaggagcctcggtaccggggcgtgaggaagagaccgtgggggagattcgcggcggagatcagagacccgttgaagaaagccagggtttggttgggaaccttcgattctgccgaggatgctgcacgtgcctacgacgccgccgctcggactctccgaggttccaaggccaaaaccaatttccctctctcacctttttgctttcaacaccccaccaccgatcctttcttctacgctggtttccacgaccaccatcaccaccaccaccaaaacaacaacgacaacgacaaccttaacaaccctcaaagaccaacttcaagtggcatgagtagcaccgttgagtccttcagtgggccccgccctcccaccacaaccactacgtcgccgtttttgaccactacgcggagatacccgcgcactccccctcttgtccccgaagactgccacagtgactgcgactcttcctcctccgtcgttgacgacggtgacgacaacatcgtttcctcgtcgtttcgacctcccttgccgttcgatctcaacgcgctgccgtttgatgatgctgctgccgccgcgggtgatgatctacgctgcaccgcgctttgtctctgatgattatcgtgcgatgatgatttttaatttctcatttttttttatctcttcaacttgatttttttgttattgctatgcggaaaaaatatatattaaaaaatgatgatcagatgtaagattatgataatatgatcttaattctgtgagaggcagattccgtgttgggtatattattttcttctttttactatttattttttaaatcattttatttgaaaggaaatattgaatgggaagaaaaaaagagaaagtaattatgatctggttgtttgaaaagcaagatgaatttgtgggtaatccaatgtgggtatgtatgtaatctccgatcctcttctctttgtttctatgcatcaatttatcatagttaagaaattcagtgttgctctaacacttagatttagttatttctctttactattttttctttacacttggaaaatcaattcgttattttttggtttggttctttttgccttcattagctgaatttccaatgtttgaatgtaacgccaatttgaatttgattgatttcatgtaaattgttacatgatgagggaaagcaaatgcagctttgccggtaccgaaaggctttttattgtagttttgattatttttattttcttccttacctttatgaccaagtgtaagcaagagcgcttttaaagaaactttgtttggtgagcggagtgattatttgttgttaccttttcttattttgggagcaattgcaacaggaaaagaactactactatcattttgcctccgatggcactcaagctgtttggcagcgtgggttatttagatctaggtgtgaatgattggatttggacgggagaaaaatcgtttctttttttcttcttttgtggtatcttgtaacgtagtaatttcggttgtgtaagaaaagaatcaatgcaatctaaatgtcaccgttaatgtttctgtttctgtttttgtcaagccctgcatatggttaagttttagagcccaatctaacgttacgagtaaaaaaatagggctaagaaaatataatatatatatatatatatatatatatatatatatatatatataatattttcgttcttccttggtatcaaaaggatagtggaatacggtgttaggagtttgaatgatgaagcattaggccaccttgtgttgtgatgtgttgtatgaaggggtgtttggcaagagagaaaataggggtttctttgcatattcctaccccacttaatgaaatgaacgtgacacttctagaagccgcggggatggtaggttgtgtcttgtttttgttttgaagaagcatcaagcatagcataaaataaggtgcaatgttagagatttgtgaaaagtcaacgccagcttaaacacgcactcaccgtgtgaagtgacccttcagaactcaatggaggcctaatgtaatgttgcagcctaaccaaccattcctgcatggccacctaggtgcccctcaccttaccactcattatttccttgtctagtaatcatactcatacgttatatctctctctatgggattgattaacgccacacaacttcttgtagagaaacatcaattggtgagatcttagtaataagttcccaacaaattgttcttctccctttaattgttaacttgtttcacctcccgccattaaaattgagaatttattacatcattttggactattctcatcccagtgttatgtgtgagacatataatcaagcttatgactcacaaaaaaaaacatataatcaagttttattattatttttaattgagaatcttggttgtgtgaaaattgacctatgatgatcccaaatcatacaaaaaattctccataaatttgggttgaaaatcactctataacgcttaagccataaaaagaaaagtaacttgtgctatggctgtcaaatttctcttgtttaatgctatgttttttttacccgtttgtttaatgttgtgtgattgtatgctcaattgctcattaattaatatttgtatatgaaattatcttggatgactacgattttctttttaaataagtaaataacatgactaggcttagatgcactaatattttcccaaatcaaaagaaggaaataaagaatagatttggtgatgggaatcatgttctgaaagacctagaattgtgattagaggcaactcaaaggtagggtaggtattcaaatttgttaataggaagtgtgttagggtttggaccacgtcttggttggggggcatttttctcaactatgtatgtgcctcgtttgctctagtattgtcttaccttcaaattaggggagttgtcgctggcagggtccgcaacacatcatggcctccattcgcatcatatgctctttacttaaagaaaaagaaaaaagaaaaactaagtgggctgattaacttgcctcacaaaggattttgaagcccgtgacatgcttccacataacaaacactgaatgtgaatcaaagtccacatcagaacaaaaaaaaaaactattaaaacaatcaacatttaaaatatcgtcgaagacactataagagatttataaaatactcaaccaaataagttagatcttttacctcattcggtattttttaaggcatcgtagttgcttataaaaaagaataaaaatgcaatagacaatggagacacgaaaaataacaatatattatggaactgagatactacccaattgatcttcaaatattatgcaccacaaatttttagcaactagtaagtatctccttcatacatcacaaggtgtccttaaatacgagtgatatatatgtatatatatgagaggataaaattatatcggtataattttaataattattacatcatttttaaaaataatatgtttttgttgttcaattttgataaaatttggtacatacaattttaataatatatagatataattcaataattggatcaagaaaaatcatattttatatcaagttataaaaatgatataatatttattaaagttaatcggatataatttgattttctcatatatatatatatatatatatatgaaaataatagtgtaattgataactattattttagtttaataaaaataattaaatataaaagatacagatattttaaacttttaatttgaaaaaataatcattgtaaaggaaatattttagtgatgatatgtaaatatcacattgtgtcttatgttaattaaacaaatctgcattgattattttttcttttaatgaataattaattgaaaaggtgtaaataatttaatttaatatggaaaaacagaaaatgtatgtcataaattgaaaaaaaaaaagagaacttatgacatgaatacatgagagaaaaagtactaaacatattatctaactcttagaaaattaacaactcgaatttgttatataagaaatagtaataattactcaaagcacttctttacatctttatttacctaaatttgtaaattaatattttcaatgcaaataaattgaataaatgaccttaggaattataatattctggtatacattttaaattttgctagtctcattcaataatttccttaaacaataataataaactatttcaataatctgtgaacaaatattgttctaatttgaggcaaaagaaccaattaaatacaaattaaataaaaaattacgcatttggtgtcgttttcaaactatttacaaatctggggcaactggttacgcctagaaatgggcatgactggtcacgcccagaaccaggcgtgactaggggggtagtcacgcctggttctgggcgtgaccagtcatgcccagttctgggcgtgaccagtggcaccaaaaaatgggggtgcagggttttcgcggtgttttcgtaaaattacggaaggcgataacttttgactggaacgtccgattgacgcgaaaccggtggccacgtgctcgaaattgagaggagaatgcttagggacttgcccaaaaaattttcccaaacgaggcctctaagtgcctcaaaaatgcgatttaagcttcggagccccaaaattttttttgttttctgatattttatctgctcaattagtgaattgcatgctgtaaattattttttcaattacttcattcaatttcaagcactttgacataaaatatgcctacatcggatattcctacaaaaaattatgactgtttaaaaaatatgctttgatcttcattttgcttctttccccagtttccctagtgttctgattcattcttcttcttcaccttcttcatcatctcatgctcataatccttagagtaatcctttaatccccgcaaactgatccccgcaaactgctctctagaacttgcgaaactaatgcagcaaagcacttgttacaattgtgattagcgaggacattggtcttattactgtccttccaaatcccccaaaaccaaacctttctctcttttctcaatcaatcgtcacgtcacaccacactagcaccattcattactggtaatcatggaaatcagagcccctctctgtctcctttttttctgatattttatctcccctcgaactcgacgtagtgactagtgagccatggtggcacggtgggcacttagtggcgcagtgggcaagagagtaagggttcgagttcgagggtttaggcgcgtgggcaaggaagaaagtagtaaggaagtaaggtagcaaagtgatagctacatggtcgtttaggcgcagactaaaattttacaatttttataaaaaaattcaacattcatataatgtagatttgacgatacttataactttgaacagtcgtaatttttcgtatcaatgtccgatgatgacgtattttatgtcagaacgctcgcaattaagagaagtaattagaaaaataatttacagcatgcaattcactaattgagcagataaatatcagaaaacaaaaaaaattttggggctccgaagcttaaatcgcatttttgaggcacttagaggcctcgtttgggaaaattttttgggcaagtccccaggcattctcctctcaatttcgagcgcgtggccaccggtttcgcttcaatcagacgttccagtcaaaagttatcgccttccgtaattttacgaaaacaccgcgaaaaccctgcacccccattttttggtgccactggtcacgcccagaactgggcatgactggtcacgcccagaaccaggcgtgactacccccctagtcacgcctggttctgggcgtgaccagtcatgcccagttctgggcgtgaccagttgccccagatttgtaaatagtttgaaaacggcaccaaatgcgtaattttttatttaatttgtatttaattggttcttttgcctctaatttgaacatagtgtttatgttgtgagggagcaatagcaagcaaagaggagagacttttggagctctggagattcaagtgcttcaatttaaaaaaaaattctaaaaaattctaccaacatcttatctaattaaaacccatgtaatagagtgactctcactactgatttcttttttagaatttaataaattccaataaattttaagcaacaagggtaaaaaagtaggtattgttgacaattctaaaaaacaaaccgaaaaaaaaatgtcattaatcaaactttactagataagtgttattctttatgatcttttgtttaagagagttactattgacactacattttgactattagcactacatatgtgggtgccttttagcaatatcctgaaaattttcttttgatagaaacacaataaaatcatgattttattgcttatatggagtaaaaaatcaaaacacaatgaaaatatgatttcgttgtatatttgttcaacgaaaacatgattctgttatatatttttcacccataaataacacaacaaaatcatgatttcattatgtattttttttacccccaaataacataacggaatcatgattccattgtgtattttttcactcaaaaacaatacaacttaatcatgttttcgttgtgtaaatgagagtgtaaaaaatacacaacagaaacatgattccattatgtattttgtcaatgaaatcatgtttttgaaatttgttatacctctttttatacaacaaaaatatgttttcattgtataatttttatgaattttttaaattgattttagatgcaattaccttttttaaagcaaacaaattaattgagatataatttaccatttttaatagtaattaatatctttattttaattaaaattgaattaattagatagaagttaccatttataaacataaccagattaattatatgaattacctttattaacaataatcaattcaatttatgatattaatttgtattataattaatttgattacaattaaaaatggagggaaaaaaatagtttgagagaggatggaagacggtaggggtattatgatggagaagttagacttttgactatcaataaattagtttaacaacttttaactatcaactttcatctaacaattaatttttaagctttcaattactttttccaaacaaaacttatgagcatgcttgggacaattgagatttcacaattttagctatttctgtagaaaataagccgtttaaaaataaaaatgttaagaatataacagtgaaaaaaatacttaatggtccattaattaaatgatcaaaatggaacattttcttcttctaaaacatcaaacaaaaagataatagaaaagttatgggtggagaaaaaaaataattttttgttttaaagttcagaaattaatacaatatttataagaataatgaaaaaaacaatatcattaaaattatacccatatatcgtttccttttatttttaaagatttatcaaatcatataacatttagtaaaatttccactatctttgttctccaaaaccctaccactcaaatgtactattgagaacaaattggaattgctaatgttagtggcatatattttgtttcggagtatcaaaatatggaaataggttttcaatttaaattttgctaaattatcttcctccgacaatacacccacaaattttgctaaaatgttttagctgttaaatgaaaaaaaaaacttaattgtccgaattacagttatttgaattaatatttaaaaataaaaaggataatagatagttagatcttttatttcaaggacgtgcacgtactgatcttcacctaaaatattagattcttttttattaaacttaaagctactaaataaaatatttttgatatatttatttctgcatgtcttcctaatttttattttgattctgattattgattgatgtaggtatcaaattgtctatcgcgattaggccagtggccgacctctcctaatcccctttaaaatagtggtatcaaatcatgttatataaaagcatggattttactttgatagattattatattataacaactagtattttaaaagacctctctaagtgatttgtcaacacacgattcacggtgaaaaaaactttaaacaaggatcaaaattagactcaaactctggcaatggattcagataattgataaactaaatctggtaagtctaaaaggcaaaagttctagtctaattttctgcgctttctacgatccaattgacattaacatcggccaatataattaattacgtgggggtctaactgaaacaacgcctagtatagaagaagtttagaggtttacagagtcttacatagaccaagaagtcgaggacacaacacattattaacacaaaaccaagtatccacaacctcaagaatacagacctcacatcaaatcaaatatctctagtttgccaatgtaactaaaacagtaaaggaagatgaactaacagcaagttagatcttgcactatagtggtccgctggaaataatgtattcaaaaagttgacttttagttattgccaagcagaaaaaaccaaaaacattgaaaacttcctgctgccttgtgtcattgttgtccaagttatttaacattaacttcctcccagatatgctgagatgggaaaaaaatgtatagcatctgtgagttctgaaaattaggacagtattatgcatacgacagaatcttttaaactaaagcctaacataacaaatgagttaaaaccagcattctttggttgcaatttcttcctgcagttttatggcggaaattagggaacttttttgtttctgcaaggaactgaccaggacatgaaaaatttccagaacattcaagcagatgcagccaaaggcacggatctgtagcatgctctctttgcagcacgaacaatatcttcaacctgtacatccacatataccaggaagcaatcaaatttaaatgaaggatagacatgtaccaaaaccttgaacaaattagcatctagtatcagcatacaaaactcatctcttacaaaaccattaactcagggcatttcacccattcaaaatagaaatacatttctggatcaaaataatgaaaacaaatcttccaaatcatgctgacaaaagtcacagaaaacaattaatatttaagaaccattacctgtgggacagccattctttccagatttgctgcataaggcatgggaacatcagccccggcaattctctcaaccggtgcatcaagataaccaaaactctcctcaatgacagatgtgctgtgcaagagaagtacacactcgtatgattgccaagagttaaccagtaagatacattcacacaaaaacacattaatgtaaagagataaaccagatttcagcgccaacgccatgctgaggaaacccttcttcaactgtcaccagcctgttggttttcctgaccgaagtattgattgtggatcgatcaagcggccggattgaacgcaaattaatgacctatgtggataagaacatcacgcaccattatcataacccaaatgatgtttttgcagaaaaggggggaagttcattataaactaaagttttacctcagaactgattccttcctttgccagtgtctcagcagcctaaacaccaagagaagagatatttaagaatgttctctactttggtagtacagaaaggggtcagagatttcaattttttttaaacaaattataaaacaccatataacacatcaacccatccagaaaaaaagttataatcgattcttgtcttatcttattatttaatatttaaattaaatgcaagacaaacctatatctttcacatactttgcagcaaattgaacaaacaagacaagtgaacaacacataatacatattacatatttataatacaaaaggatctcacagtaaacaaaccttgagagcatagccaaccatttttgaataggctgtaatagtcacatcttttccttccctctcaatctgtttagtggtaaaatgaatgaagcaaacaagaagtcaataagaatgtattattgtgtagtaaatatggctccaaaaatcataaggggtatttaatatacgacagataattaactacctttgcttttcctatgggaaggcaaaaactggaatcaagaacttcggctgaaacagggaatgactcaccatatctagaggacataattcatcaaattaaatattttttgaaacaagaactgatgacaaaatctatgactactcattttcatgtacaaatcaagcagcacaagtgtcttttttggggcgggagaatcaagcagcacaacttacaacaattcattttcaaggaaaacaacaggatcagggtcccttatagcagctttaagcaaaccacgagcatcttcagatgaatatggtgacaagactttcaacccagggcatgaaccataccaagatgcataacactgcataaaggcaaagttgtggggcatacaaagacgaaacctgaattatttatcagttctcaaatggttaaataaagtttgtctttaaaagaaagcagctaggagaaccgtacttgagaatgctgagcaccaaccccagcagcagcaccattgggtcctctaaagacaataggtacggatattttcccagcagacatgtagtttgattttgcagcagagttaataatatgatccattgcctgcaacaaaggttaaaactgaacaattaatctgccattacacatgttcacaaaatattcttcacagtttattagtatttcaacattcaagctaccaaagctcaatattaagattgtaaacataaaggcttacttcatgcagaagaaagagatttcatcttccaatataattcatacttaagaataatacttgaacatagaagcaataggagttgacaagtaacaaaattccagcaaaaaggcctgcctggcgtctaacaaactagattgatttgtatggcatcaatgtgatgttcaaactaatagttaacaataaactgaatcccaaccacaaatccttagttttatatctttaataacagggtagtcaatcacagaaattcacagcattttgtttgttgcccccacaatgcacaaagaatcacattggattttgatagagcaaacatcacaagcccaaaacgtgtcaaatcacgaccactattggggatttcgtcatgtgcccggctgatttacattgtcatatccaccatgcctccccctctagcttgagcttcatcattttttttctggccaaaggacccagcagcatgccatttactgcgatgcattgttttccatcacgccccctccactctctagtttgaggttcaccattttccgttgctgtcattttccagcaacctgttggtgttctacatagcaactcccatcctgtcacctcagtgagcccttggagacaccctctgttttgtttagttgttttgtactttttttctttttgtgtggtgtagctagcacttcatagtccacatggcattattcctccaaaaccttagaggctcaaacttattaaggtttggcactgtactttttatatccttatgatcctttgttgttattaacttgttaattatgcctaacatttgcaatttttgatgattgtatatctagactatatcactataacttttgattatcaatgacgaaatgtttttcattgagtaatttttatttttgagcatttatgtatcaactgtaaattaattatctcatttatcttgtatgtataatcttcagaatagttgctatcgtgctaaaacatttctggggttggccacacacatctatatccttgattgataactgtgattatcaacacagcctaacagggaagtcaacatttttccttgtgaagtgaatcatcatgtgttgaaaacctcataaccctggtattcttatcacacagaaaacaaaactcatacaatgccatctaatatcttcatgggcagcaagctttacataacattgtacatatacataaattaagtggcactgctgtaaaaaatatatcacttaagttcacactcaatttaagaaagaaaggatgcaatcaagataaactccaacctgcatggagaagttaaaagtcataaactccacaacaggccttagaccatagtaagcagcgccaactccaatcccagcaaacccagcctgtattatatttcacaaaaaaaataagtcaatccaacagctgcatccaactataaataaatcctgttcttattttcctatcaattttaaagtgagaagctgaaacaaagtaaattttggcgttcaataagcaatctattatggaaagttagaagcagctgctaagcatgaagaacaacacagttcgaaggaatgcatcccaaagccatcaccattaataaatcaagtgaagagatgcaaataaagtatgaagtaagaaaagccacctcagtgattggagtatcaagaaccctctcggggccatacttttggagcagccccttggatatctagaatgaaagaaggaagaaagttaagttaatgaagttcttaaaaggagaggttggcaagacaactaaactaaccaaccaaccttgtatgcaccctgatattccccaacctcttcacccatcaagaacactttaggatcagctgacatttcctcgtcgagtgcggagttgagagcctccctgacagtaatctgcatcgaaacaacaatggcgagtttgatatttgatagtaagagattaagagattagagatgagaacaataatgaatacctctttagatgcagaagagaagtgtctgattgcggagaaagcagggcgaatactctgcaaataaaataaatcatatgaaatgtaattggaataggaatcagacttcagacacagacagtaccttgtgccttataacacccaacatcttgcttccttccttgatcttcaatcaagcaaaccaaaactagttagtcacaaaacccgtagtaatccatcaacaaatttcttctttttcaataataatattcgacaatgaaatcaaccaaaccaaatcaagcaacctttattctttttctttttttattattcatatatctaacaagttaaggacatgtgtcagcaaatgaagatatgtcaattaagaaattttcctaggtcaattaagtaaaaattaaagttttaaagactaaagaggttccttgggagattcggttcgtttagcatccaattatccaaacaacttcaacataatttcttactattatttatataatagaatcttacgctatattttttttcataaaaataatcttaccttgtttatgatgatgttaagcgcgtgtatacaaaatataaggaaataattttaattttttgtagagtattaaataaaaaaaaacgaagaatatagtggtgtcaccttagaagtttttttatgagataaatgaggatatataaaaaaaagtcagaagatagaaatgggtaccaattaaaagaattatcctcaaaatagtcaaattaatataaaaaatcttaacaatatggatcaaaataaaaaataaaacgaagaatagagtggtgacacgaatttccatattaacgtgaagttaacatgacaaactgaatcagcaagcaaaggtgagtgagtgcgaagtgcgcgacaaggcgtaatttggcgcatttagatgaaactcacaacttcaataacttggcactatttttacaagaatcgttaaagcagcatttctgcgccaactctgtctcgttagtttccatcgccaatacgacaccgctaatgcaagtcctcgtcgtcgtttaacgcttacgttttctgttccctgagaaggtaaaaagcgttcaaacgcagcatctcaaacacgcgattccgaagcttttctgcgatcaatggagttcgacccgatcccaatcggttcgtgctccaaagaacaccagacgatctataaggagtggttcaattgcgctgattcaggtacagcacagcatacgtcatctttcagtattttttttttgttccaattttatattgtctgttccttttcatatccaaaaatttcaccgtgcacttcgttttccagatagcgatggccgcattacagggagtgatgccaccaagtttttcgccatgtccaatttgtcccgcgaagatcttaagcaggttttctgttttcccgttttttttttccattttctttctttattgtcgttcttttgtattgtactgaatgaatgcagataggagttggaggtaatcggaatcatgtgccaaaattctaagatatgattgcttggttaggggatgaagttaaaagtgataaaagttgggcattattaacatggcctaccttttccttcttattggttttcctcgttagtgaggtgaaccactgattgcctgaatcaattgacatatggttgtttccaacttaattagtgttctcaaatttgagtcctgactattcaattgcattaaatattcatgttaaattttctgccgatagtaattctatctagctcaatcaggactaccttacatgaaggatgtctgttgtctctgccaaaatatataaataaataaataaaatgcggtgaaattgaagtgtacatgcaattgtagaaaagagataacactgggattctatggttttacaaattggccaattttggtttaatgttcatttatttttatctcattcatttcaaacaatataaaacaaaatgttgtttactttcattttttatttgtttccttctctgcctttgctatcaagcatgcaatagtgaactgtgaacttcctttatccttcctatcttaaatccctcttcaatttcactttgcctagtcaaacttagttgctggtcttgaatcgggttgtcctttgatttgggtaatgcctcttatattatccagtagctacattggttttgatttttgcaattcagattcaaatctgatgcattgttggtatagagaattttatcatgttattgaagcatattgtcaactatttttgcaaatgaaatattttttaattacacttatgatgtgacactttatggtttcctgatattgtttattttatactgataatggactaattttgaactcttacaatatatctcatgtagaagttgcctttggtactgtattatctataacaactgaaatggtttgggcatttcatggttgtgtacttgtgttgttaatataatttgttgtccttgcttataagtatctctgttggcttctttctttctgctaactaaagtgtttctttgtttgcttctgttaccaaaataaggtgtgggctattgcagattcaaagcgacaaggatatcttggtttcactgaatttatcattgctatgcaggtaaaaatatgttatgctttttttgaacttcaatgctgataaatttccaaaatcttacacatctgaagtgtagctagtttctttggctcaatctgggcactcaataacacccgatctgctgactagtgatggtaagtaatgtatgtttaggtttgtcttctattactttgtttgaataacttcttataattgtagcacattcttgttgttgtgcctgcttacatattttgatttgattgtgaatgtcttcttataaatttaatctaatggaagcttaacttttatttcagttgattttacaaatgtgaaacctccctcaatggagggtttggacgtattactagctgtaagtatttctttttaaggtctattttttacagtgttaacatttttatgcttatttagtgaaagttctgaccatttgacgttatttacccagaagaaaaagcataaacaaaaagaggttgatgcaaatggtaatatatttatcgttttactcaatatggtgtttcatattgattttattttatttgttcttttcttctaaaaatctaagttcagcagttagcaataatgcaggtagctctcaattgcagccatcaacgtcaagtaattggttttcttcaaagtcaacaaaaaaggcaagcattctgttactgttactttgattgatttcgtgtgcattatccttaccatccagtccactagaaaacttactgaatattcatttcaagttttcaactaatgggtaatggccaacttgattgtcattctttactggctttaggttgttctggtttcgtttagtgttttcttttgatcttgcagagtatatttgagagatttctggttatgttgttctctgtcttttataagatgatgaaacaaatgtgtttaagtaattattaggggcctgaaaccagccttattatttaatttcaatgcgtgtgtaactgatattattagccaataatagtaatgtgcctgatactacacatgtgaatattgttgtgtcaatctagaattggtattatctaatttcttctttttgacttaacaaaatgtgcattttgtctcgtgtcaatctaaatatctaattttgtctctaatgttatatgaatcaagttaatgttaccctaaaggtcatcctatagatatgttctctaggaccttttatctgtatttgttacctctttattattgccagttctttaaaattgtcaaatattatttttgttatgtgtttttacttgtatatgtggtacatatgttcataggtgcctctttcctctgtgacatcaataattgacggcttgaagagactctacattcagaagttgaagccattagaagttacttaccgttttaatgattttgtatccccattactggtcagtaagttattttgtttagaaatgactagctactccagatttactgccacctttctttgtgcactcatgttgttgctatgctttaaatatctacaaagatatacaattagttttgttattgattgtaattctttacatattgtagacaaacagtgactttgatgccaaaccaatggttatgcttttgggtcagtactcaactggtaaaacaacatttatcaaacatctgcttaaaagtagttatccaggcacgtgattctcctttcactatatccatatatgtatttctcacattgcttatatctgttttatgaagaaataattttaaatacatttatttattttatttaatattctttgtaaaattttaggatgatataacattttttaaaataatgttattaatctttgtcttgtttttcccataaatgttgataagagcacatattgggcctgaaccaacaactgataggtttgttgttgtcatggtatgtgtaagccaaatcaatttatctcccacgactctctattaccttcaatgtttccttagttttaaactaataaatcaatttgacttctaattgctggcaagactaacatcttggtggaagctatgaagcatcaacactgctatttcttgcagtgtcggagtgtcagtcatacttccaagttccaacactagcacttctttaacatttgtatgacatgtgttggacgctactaaactggtgtttaattaattttttgttgatggcttggacatacgttacacatggtttggtcattcaactctgtcaactgacacctaaatatggcttgagacttcaaaagacaagactattttataaatttgaaaaaatgttttaactttcagaaatcaacttaaaatataaagaataatataaactatttaaaagatacaaaatgctaaagaaacttctttagggaaaatgtaaaatgatgcttcttaatattttttttgtgtggggctaattatagtagggcataagtaaagcttaacaagttattttgagagggtgaatataaattcagattctcaatttagatattttgtgatgttaatcttttttaattccatttgacatgcaaacgctcatgctcacacatgtttaggacattgccctgtgtttgtgtgtctattcttcataacatgaaaattctaaaacctggcaatggaactcagtagttcgtaccatagcattagtgccaagagttgatggtttaaattattttcttaataatcctttaatctagtagtcatcttgaaaatgagttattgcattagttttatattttaactagcaaaggatgctgatgtacagtctggatctgatgagagaagcgttcctggaaatactgttgctgtccaagcagacatgccatttagtggtcttacaacttttggcacagcatttttgtcaaaatttgtgtgttcacaaatgcctcatcctgtaagttgatctagatctgttcaaaaagtttacgagatttccctttatagcatttagaattgactctttcaattgtccaaagctactggaacacatcacatttgttgacactcctggagttctatctggagaaaagcaacgtacacaacgagcatatgattttacgggtgtaacatcttggtttgctgctaagtgtgatttgatactccttctgtttgatcctcacaaactggacatcagtgatgagttcaatcgtgtgatatcatccttacgggggcatgatgacaaaatccgagtagttttgaacaaggcagaccaagttgatactcaacaagtaagagcttgtgtagtcaaacttctgtttgtttatcttttgaatctttcacaacctagtccggtgaaatcttaacctatattgggctctatgttgcagttgatgagggtttatggagccttaatgtggtcacttgggaaggtgctgaagacacctgaagtaatgcgagtgtatattgggtatgtctccactcaatgttcaagtgttgtctttgttatggagggtgggggagagactgctttgtttctccactctcagtggaagatctcttccacactgccttccccatttgctatgcaattagacataatataactatatttatttccttgtttatgagattgccatgtgctcatttgctcataattaaccttctttatggaagctccttcaatgacaaacctgtaaatgatgctgccactggtccacttgggaaggaactctttgaaaaggaacaggatgatcttctctcggatctgaaagatgtaccaaaagcagcttgtgatcgaagagtgagttatttatttaactaaatttattttctttaataagaatagttttccactaaaatgaggttactttgggtgtgtttggttgtgtttttggtttagtttttaaaaactattttttaaaacatttttcaaaaactaattttcagaaagagtggggaaaatgtgaaagtgcaagaaagaacattagtaatacaaactgaaagtaaaaaattgaaacaacttaaagatggacctaaaaaagagttattagttttgaaaagagtttaaaaaactacccttatataccatagttttttagtgtcattagattgttttctagtgaaactacaagaaagtcagcgtatcgattagattgttttttcttttgtgaaattaaaaattacgaaaactaatgttatcagctcttttagtgtcatccgcactccacacacaagtttgatacaatagtctcctttcctatggtataaattctacaggtgttttttgtaggtgactatctcgtatcttcaatttcagtgcccagtttatatttaaattgttaaagttacttttttgcataattaatttatcatttgtatatattgactgttatagatcaatgagtttgtaaaacgggcccgagcagccaagatacatgcttacattatcagtcatcttaaaaaggagatgcctgctatgatgggcaaagctaaagctcaacaaaagctcatcgataatttggcagctgaatttggaaaggtatgaatctgtgtacatccgttttgcatatctgcttgtctctgacaacacttaaaatgtatacacatgactgacaactttgaaacaggtacaaagggagttccatttacctcctggcgattttccaaatgtagagtttttcagagagagattgagtggttacaatattgataagtttgaaaaattgaaaccaaaaatgatacaagcagttgatgacatgttagcttacgacattccaaatctcttgaagaattttaggaatccctatgattaaatttctgagcaattgagtcagtgctataattagattagttaagagtgacatttgtagcatacaatttttacggggtctttatgcaatgcatgtgcgtcatgagatctttatgtaccatgcgtccgtcgccgttcttttctagtaggaagttttataattccatatatgtttttgtatttatgaatattttgtcatctacaatcaagtgtcaagacagaaaataaagacaaaacacaattacttgtttgcatcaagcccgttgtgtttagtgtagttaaatttaatgattaacaggttggtctagtcgtcaaggaaatgtattgctttggtaagtttgaatcttggattagtacctaatttttctaattaaacctgatatgtgagagtacctccgttagtcagttcactaatttgaaatgatgaccttgggatatttttgtcacataattgaaatattgaaataatccgttgctgcatatatactcattttatgtaagtaccgagtggccaaatgacacaactacctacaagtcgaatttggttaaaatagactttttgggttttgttaaaaccatggatgatgtcgactttcatgtattcttattcccttctaactcacccgagctgctgcaagaataatgtaggaatagagtggacccataatcatgagagttcggatcaaacaatttcatctaaaccattactaaatagtattacctagtgtttttcaactaataagcattattttcgaaaattgctgggaaacattctttgtttgtatgaaacttatcatacatggagtaagacttagtatattctaataaatttcaactaaaacgggtatgaaagtttattagtggccattttttttttgtcataactgaaatatataaaggaaataactagtaagatctatttagatacaagttacaagtgtttttaaaaaaatttctattgaaaatatatattttttttcaataaataaactctcaaaaacacttataacattatatccaaataaaacctaacataatttctaataatttttttaaaactgtatgttttctcctgagatttgactcaatttatagaaaataacaaaattatgggtgagtcattaatagttggtgagacacattattatcttcaatcaacaaacttaaacaaattggagaaccttggttgcaccattgtgcatgaagtggatgttcctaccatgaacaaacacccgctgctccgaaggaaatattttgatcgcactgtcttcaattttccacatgctggttttgtttatggtgaacatgatccgtgccagattgagtaagtttataggaagaacaatactactacaccaaatatggaaaacataaaatgttttataaacacacgttctgagaagatagatggtaagccaaaatggagaaattcacatgacacccaagaatgctcacccttttaataactgagaagtagtgacactgacagaggaagcagagttattcttggttgagaaagtgccattttttagatgggactatccaggttacgtaaataagagagtatccggacccaaatgcaacaaagcttttcgtgttggtgattgtagcacctttaaattttccaaggtgcgtgacatggaatccatgatttcggaggtgccaacatgttcaatttgaaggacaatggagtgctgcagcttgttagtcgtcgtcttcttttaggaaaaacattttcggctctagtgaaagccatgcccatggcccatggtatgctatgttctctaatacacttattcactacaaacactctattctattgttttgaacttttgctttctatcgttgttggataaaatgtagctattactattagtcatgatataattcggtttggttgtgtaaatttaggattttattaaaatatttacctgccattacgattacgatgcatggtagagaaaagggtaagcagagtaattgtttaacatagatgatattcataacaagtgccgttggttaaaaaataaataatcctcctaaaacaaataatcttaaataattctatatttttataaataaattttcattcctaattttgtcaatctctttagagaattttcgttaagtatgttatatgtattatttctttttaaaatagtgatcattataaaaaaaattattcaatcgtttttttttttaaatttgattgtcctcccatgaaaatttgttaatcaatttttttatcccatcttgtttagaatgttattgagattttttatttattcattttcaataaatcttaaacaataataataaatttaatggctatgcagcgagagatatgaataggtgttaattaaagaaaaatgtgctgttaacaatcctcccagactccagttaaaatttggagatgcattgcttaatagaggcgacgtcgtttataatgaatagataacctcaccaatttatgtttttctctctccaccgtgagcacagactttgctgttctcttttctctgtttttgcataaacactctgttctgttattcgacaacttttcttcttcatcgtcctcaacgatgttggttcatagggttttgtcccgtgtttccaccaccattttccgaacctctctcctctctgcttcgcaaacaccccaacacttgtccaccctctccaatattaacttacattcccttcttccccattcacccaacaaggtgctcttccacactttcccaaaatcctttgatttcccctctttttttggttttagggttttgccagggtttaaggaggttgctttttaatttgactgttttagccgtttcgctatttcattcgattggattctgttcattgatttttgaattcagttgtatttttgaataatatattaccctttgagctaagttgcctagaattttgagtgatgaatttttttaattaggggtcatgacagattgtgtatcagaaattcgtaatttatgcagtttggaataggttgcattatagagtgttacccctaattgttacttttgcacctcttttgatgctaatttatctgttttagctattggttttgaattcaaatgttcagaaattttatttatgtcattttagggtttaaaaaaacaaaatcaggatgaaatgacgtctgtcattttgctgctgttcacttgattgtccatttttgccaggtttttatcaggtgtgttgtgttttattacattaaaagagaaaaaatgttataaaaagtgttttctcttgtgtggaaataagtatttaatgaaaaaagtggtcgatgaaatatgagtgtaacttttttttttcttgataaagaacattatgcctgagcttttgtattactatgttatgtcctgtcttctaaattctatccaccttctcattcttgttcactgtcatttttttgaaatatttttcctaagaaataccggtgttttaaattccttgtctgtacgaaggaacaataggttccttaaaattttttgttcttctgatgtagtatatgatactatgaaatctgatttatatggtaattggtgactatcattagcctattttctaggattcaattatttttatctaatgaattttagtgatgcattttaaaattctcattaaggttccaaatatgctttctaatgttccaggtgattcctgttcaactcaatttgttgctgccgccaataaattcattattagctccaaaatttgggttttcttcatcagcttcaaccgaaaataatgacaaggaaaaaggaaataatgtgcataatggagattctacaaatgatgaccctgcaaaagcaaatgaagaggcaaagaataatgatcaggctaaacaagataaatctgcagataaaacagaggaatcaggttctatttcagattctcaatctcaaactgtcaaaagaaggaggagaggttttaaacggactgcattttctgattcagattcagagagtgaaagtgacttatccagggatgatttaattaaacttgtggttgaaaaggaagaacttgtgacgttaaagcacaaggagattgaaaaaatgcaggataaagttctgcgtacttatgcagagatggagaatgtcatggaaaggactagacgtgaagcagataattcaaaaaaatttgctttacaggtctaactttgatcccttttgtcccaaatgatttcctcttcaactgtgttctgagtggtttaaatatgctgtagaattttgcaaagagtttactggatgttgcggacaatttgggaagagcttcctcagttgcaaaggaaaaattttcaaaaattgatacgtctagtgactctgctgaagcggtgaaactcctgaaaacacttctgcaaggtgttgaaatgacagagaaacaattatcagaggtagaattgttatactttatgttttatctgtttaatttcaaaagtcatggctaatctattatcaatattttctttctactcatttttatattaagttttaatccccatttcttttcagctatctaagttcctcatttatatagttttgtttagtaatgatagtcgattgatggttaattgagtgaatgtgagggtacggtaaaagtgatttggagggactaggagtagaggctttatgctcaagtttgaggacatggttgttcaggtggtgcgagattaggggggcttgtttttatttctgtgttaaatgatgtttgtttttttttaaaaaaaaaaaaatcatgaacatgttggaaattattttcttattccaatttctcataactattttatgaattgttattttaaaaaaagaataattattttgtactgaatgcacttgatttacagtggcttgatagtaaattggatatttagtttacctgttgaattttgatgaatagatgggtgtgttgggaactggggaatttggggaatgactttagttccttcatgtttcaaactcaacttataatcatactacaaaagttttttccagttatattttactatgagaagtacactttctaacacactgtcttattggcttaaatttgtcggaaatcacaaaaatgtttaggttccactccatatttaatgaatctcattcatcattttgtagttttcaataaatttttatcaataagagtgagtgtggtgccactcctcattttactatacaatatattattgtatgcttgaaataatatgcttccttagacattaaagtgcttcaggcttttgtaaaactaattgcttccgcttacaggtacttaaaaagtttggtgtagaaaagtttgatcctacaaacgagccctttgatccacacaggcataatgccatcttccaaatccccgatggttctaagcctccaggaactgttgcagctgttctgaaggtaatatacagtggaaggactgtgattcaatttttccaattttaaaatttgttttgacactcaaaactcttgatgtgctctctttgtctatggtgcatgcttacttgaaaattggtggcatatctatatcatattcatattcaacactgttacttttatggtaatattgaattcgtatttttgttgttactatatcttttctactgagattcaaatccaagtcatgctctcaacttctcacccttcaccttccagcaaagcatttctcactcttgctatcttaccatcctcagaatcatcacaaagaataacaactgaataaatttaatttagttacggatataaaaatattaatatatattaccttaatgtattttaatttttttataaaataatcctatttgcttactgggagagctagcaacacttttttaacgtgctttctattattcgatttgtttcatggtgtcattaaaataactctggtccctactttatttagtgggactcgagtgcaactcatctaataataaaaggtgttttgcaaacatttctcttgcatatcatattgaatcgtgttggacatgcaacacagtttggttaattatctatatattttgcagtgcgtcaagttctggttgatctttgtcagtgtttatgacaaagctttttgtttttgtaacccaatcatctgatacttttcctgaaggaatgtggtcttattcttagtgttgttgggcagattatttaggagattgaaaacatgaataaaaggctatcttatggttgtgtctgcaggcaggatatatgcttcatgatcgtgttattcggccagcggaagttggtgtaacccacgcaatcgaggatgaagagaataatggaaaagatagctgagtggggcactttcaaaatgtgtgaaatggaacttttgaagtaagttattgcttacaaatatttgtcgtcaaaaggggtatgagaaaatgaatggtacaaccgtacaatatattatctgacatttttgaacctttcattatttgtttaaattttattttaatactaatatagattttttttttatttggtcaggttagcatgaaatttttttccgtgagactattattttatattagagtaaaatatgtttttcgttgacgtaacattatcaaagtttgtttttgttcctttaaaatttttgtccgttttttggttcttgcaaaattaaaatgtgacttttcttcacctgccccgaccccgattaaaaaagtcgaataattcttgaacctgaattcatattcgatcaacttagatatttcctttcaaagtcggaacgcgtacccacgactatgaatttcattgtgatgcctattcatcatcttagaattattaataacagttctaaattgagaaaagaatcaaatcgaacaatatttaaaagataaaaaatcaaattaaatctaaatgataactttgttaacttttataagattaccttaaaataccaaaaaaacattgttttgtattatcatttcattaccattaaactactatctaattgaggttagagcttcaacaatttttttaagcaactgagagtaatatttttcttcaatattggtatagagtattttgtattatcattttgttaccattaaatttcatcattttttttaatcatgatattgacataaactattttattgatgattatttccgtcaaaaaaattaacttatcacttttaataagtttctcttctcccaatcataaaactccaacttgagaccttacatacactcatgatgtctacttaaacctttatgacatattcctctttttatctccttttatttaattttttatagttatttgttattaaccagataaaattgggtattataaaaaacacgtggaaacctatatatctcaataaacaaaatgttgtacatagagaagaaaagataatggtaaacacgtacgtgccccaaaaaacaaatagcagaaaacttgaatttgatttttattaattactctccaacaaagaagagtaagacattttagattgaaggtgcaactatagctaagcaaatttgttttgtggtcaagatcagaaattgcagggttaacaatatctgcagaacgcaagtcttcctcacatgacaaaggtccatcaccagcaattttggcccaatggttagcaattcgaggatgggattaactttctacaccattcatttttccaatacacccaacatgcacagtgtaataccaattttacccttctcataatccgtaagttgcataccaacatacaccattcaatttcatacggatcggcaatccgtaagagtcatacggatcgacaatccgtatgagtcatatgcaatctatatgactcttatccatatgcttcatacggattgttgatccataagagtcatatagattgcatatgactcatacggattgccgatccgtaagaggcatatggattgacaattcatatgcctcttacggatcggcaatccgtatgagtcatatggattgccaatccatatgactcttacggatcggcaatccgtatgagccttacggattatcaatccgtatgagtgtttccaactacagtaacaacgccagaacttacctccaatgacgattccggccaacgaaacctccacgactgctaacaacgacctccacaccaaaccaacaagccaacaaccaccaagaatccaagctagaaccaagaacaggagtgagaaggaagacgacgcattcagctggtgtatgcgaaaaaaaacaaagcaaaacaaacaagggcaatattggcattttgacaaaagtgttgggtgtatgggaaatttgtccgatgtgagaagttaaacctttcgaggatcgcctttcaacttacccaatgaattcctaaacgaatcaaccgtacttccatagtaaaatgcacatctttcaatagcgggaactttttttgtcgtcgaattcgccaatcccgtaagatccttttcaccttaatattccctttttccagcccaactccaagattgcctctgcaagttcaaaaaaatttgttgcactcgggactttaggatctgctcttagaagattcgtgcatgcaatcttgttcggttggttttcattgcaaatttgggcaattaggacgtaaccattatgaagatctctagcatttgttagcgaaggagactgagcaatgaggaagaagcaaagggtgaacaacagggaacacagtgctaaagaattcattttgtggtaggaagttgttttaatcaattaaagggcaaggtgttgccttcttttatagtcttgctgctaatattccacacttaatgcgttatattatatatattattatcattaaattattaagatttttataagattgatggaatcaaaatgacgatgatttaactctaaaaatgttacacgaaattaaaatcgttgatagaaaatgatcttacgttttatattatatatgtctaatgcagttattacttagaatccaaatatttattgtgttatcatgtaagcaattaaaatgagatttagatagatgtttaactattaaaaaaagagagagaataatatatttgacttgttgaccttatcttttttataatattatatttaactatataaataaaatatccaaagcatttattacttaggatccaaatttttattgtgttatcatgtaagtaattattatgacatttataacatttagatagatgtttgactattaaaaaaaaagagaatgtatttgactcttgagcttgtcttttaattaaaatataatattcaggaaaatattattactttattcatccttaaataaggaatattttgttacattttactatatttataatattcaaggaaatatttctaatcattaaattctatctaatgcatttattacttaaaatccaaatatttattgtggtatgatgtaagcaattaaaatgagatttagatagatgtttgactattaaaaaagagagagaatatttgactttttgagcttatcttttttacttaaaatataatattcaggaaaatattcttactttactcataaacaagatccttaaataagaattattttgttacattttactatatttgtaatattcaaggaaatattcttaaaatactttttttgaatgcataatttctaatccttgaaataaggaaatactttgaaatcgttaaattatattaatatctttataatattatactttaaagctacaaataaaatatctcattgcgttcgtatttattattttagaatacaagtatttaacgtgttttcctatagtttaaccctttttttagtttaattttttctatttacaaaacagaaacggagtgaaacaattttcttaatattatttaatcataattcataaataattgtgtatgataaaatttctgatttttatcataattatttcaaaaattatatttaaaataatttaattaattgataatgtactaaaattatttgaattattgaaaaaatatttttggagtattataaaatgtttcatttaaaataagtcacagtttgtttgttttttcttcttctgatattcacatttattttcacaacacagttcattgcccgattcattttgctttatattttttggtagcaagctatcatcataactttacatattacttacaagatataatattttgttataattctttgaataataagattatggaaccttacggtaacactaatgttatcatcttaattaattactatactcaaaatctatagtaattaacaaatatataatatctctttaattttttttaatatttataaataatctaggcggaagtacaaactgaataaaataacgtaaattaagaaaacagtgaagcaagtaaataactatgtctttgtcagaggatattcttaacctagagaaaaaatcacatcaagattactatatatgtgaatgtgattagtttctttttattttgtactctgtgttaaagaatcatatacttataagtagttttaaaacaattcaaatatttaataatcataacatgattaaaatataaattaagatgttaaaattaaaatcatatatatagtaaaatcatgatcaataagcttaaaaatttacaattcacatatataaataaatataagtatatgaaagattaaataaaaacaaattaaaaaaattatcaacatttaaagatgcttaacatgaaaaataaatatgtaaaaatggtaaatatgtataaaaaaattgcattaatgtgcctaacatgattcatataggtatatatgccttccagtaagctctgcatatgctactcttgtaagttattttaagtgtttatgaaaaaagtgaaaaatatcttagactaataggaagatatatatttgtataattttttaaaatactctcacaaacaatattaatctaaacaatttgtttataagctcttgtaaatgaaatatagataaaaaaagtctcgtgaccttttaaaatagtcatcatgtgtgtaattgtgacacattttttttatatcttgatacgttgtaataaaagttttctcacttgatatgtccttctatatgaattaaaactctcttgttttctttttcttcatttcatatgttttttttaaataaataaaaggaagataatgcacccattataaagactaacaaatattttctttaaaacttgtctatatatgtgtatatatatttatagatgtacagaaaaagaaatagaaaaaatcataatcctttatatatatagatgatatatatcgaatgagaacacttcatattatgaaaataaaaattataaaaattgacacacacacatatatatatatatatatatatatatatatatgttagtattaataatttaataaaataaatatgttgatcgaatgcaaatataaatacgtcaaaagaagattaatcaaagatattattattaatactataaagtatatatatatatatatattagtaaaaatatgtgcaattttgatttttattgaaggtatatatgtatttatataacttatatttatatatgaaaaaaatctattagtgtagtgttgtaagtattttgttttgaattttgatttggaattctaatctttatcttttttattttgtcaattttttttttatattttcactcatcacatcataatgtatttactttataatcaaagcacataccttttaaacatgtcattttcaataataggtaatatataatatttatatattaaaatttatcactatattaattacacttacaaaaacatgtcaatgccaataaattttattttgtgacatatttcattatcagacatggcaacaggatgggaggggacaaggcagggtagggatgggtattgcctcatcagtcctctatcctgactcacgaacatatcattgtacctgtccttgatatttgataggttaaaatttgtttccccattcccgtacccatttggtatcgagtatccctattcccgccacgtcttcaatttagatttgtaaaataagtttttttaaaaaaattatattaaaaatcaaattttaaaaaaaataaattgattattacacatttatttttaactacttatatatcaacaaattcattaaagggcatttgtctacaaaaaataaattgattgatggtactaggactggtataggtataggcagtggcggatctaggaccctgggtcaatgagaacaatttatttaaaaaaataaaaattgataattatcattatcatacacatgaagataaagacaaaattgaatatttaagttaaatatttaaataaaaaaattgagaatagtggattcaaatatataaaattaaagagtataaaatatgaaaatataaaaacatgagattagtgagttcaaatatataaaattaggggtgaaaaatataatattttaggacagatactagtaattttattgaaataagggggtgcatttgtccatcctcacttccaaataggtccgccgctaggtgcaggcacgaggcgggtagtgccatccccatccttgaccccaaccccaattaaagaagtcggataatccttgaacccgtacctggtcaacttagatattccctgtcaaagtcgggacgagatcccatgggtacgatttcatggccatgcctattcattatcttagaattattaataacaaagttctaaattgagggaagaatcaaatcaaacgaaattttaaagataaaaaaccaaattaaatctaaatggtaagtttgttaatttttataaaattatctcacatgactaagtcaaacaagaaataatacatattctcttactccattttttacatggcaagacaatttgtacaatactatgctaaggtagagtagtaggataagtgatttatagtggatcatatattttgtttataatcatctctgtcgaaaaatcttattgatcatttttagtaggtttctctccttccaattggaactggagacctcatcatgcctacttaatcccatagttattaaaaccggttcggatcggccggtcgaaccagttggaccgggaaccatagcatcaaccgggccgagttggctaatgaaccggccatgcaagtggcccggtttgacccagagaaaatcggacggttttgggaaaaatcgggaacccgaccgatttttaggacccggaccaggttggtgaagaaaaaaaaaccttcagacgcacaaaaatggcgacgttttgggccccagggaaaaaaaaagcttcagacttacaaaacacaaaaaaaagcttcagacgaaaaggaggaaaccgttgtggaggtgtgtgttgttgacggtggcttcaagatttgaggtgttttgcaatggctgtaatagtgtagtttgttgtggaagtgatttgtgcctttgtgaagacaaaatcaccaaagtgaccaaagaaagtagaagagccgtgtgaggctgcggaggagaaggaggctgcggaagagaaggagccaacaacttttagttatatatatatatacacatacggggattaggttttttatttgggccccaaatccaatttacttcctgcaccccccattattgcatccttcactcctttttggttttttttttatattaaaattggacttatgttttaattgaagtagttgttatttacattctttttttattaatacactttacttgtgttatcaattttgatacttcaattgttattttaatttttttattatatttttcttaattaaataatattagttatatatttatatatataatagaattttaaaaattttaatatagactgggccaaaccggaccaattacttatccaccggttggatcactgacccattacctcgatcgggtcaataaccagaccggttttaataacaatgcttaatcctttatgacatattcctctttttatcttctttatttcattttttatatttattttttattaaccaagtaaaattgggtattataaaaaaacacgacgaaatctatatctatatatctcaataaacaaaatgttgtacatagacaagaaaaaataatggtaaacgcgtatccgtaaaccaaatagcagaatacttgaatttgatttttattaattacactccaacaaagaagatgcaaaacccactaagagaccttagattgaaggtgcaactatgccttaataaagtctttctgttgctaagaatgcaatatagctaagcaaatctgtttggtggtcaagagcagaaatctcagggttaacaatatgtgcagcactcaagtctgcctcacatgatttaggtccatcaccggcaatagcggccaaatagttagcaatttgaggatcgtctttcagcttaatcaaagaattcctaaacgaatcaaccgtactttcatagtaaatttcacatcttgcaatggcgggaacatcttttgtcttcaccaatcccttaagaaacttttcaccctctattcccttcttcaagcccaactccaagattgcctctgcaagttcaagaaatttttttgcacccaggactttaggatctgctcttagaatattcgagcactcaatctttttctctgggttttcattgcaaagttgaccaataaggtcggaagtcggaaccatcaccaagatctcaagcatttgttagcgaaggagactgagcaatgagaaacaagcaaagggtgagcaacagggaacacagtgctaaaaaattcattttctggtagggagctgttttaatcaaaaggcacttagttgcagtgtgtggggactggggagtaaataaagtttacaaggtgttgccttcttttatagtcttgctgctaacattccacaattattgcattactcttttaaaattacacctatatatttatatttttaataatattatattttaaaattttaaattaaaatatcaaaagacatttattacttagaatgcaaatatttattctattatcatgtaagcaattaaaatgacatttatgacacttagatagatgtttgactattcaaaaaagagaaaatatatttgattttttgagcttatctttttacttaaaatataatattcaggaaaatattcttactttattcattaacaagatccttaaataaggaatatttcgttacattttaactatatttataatattcaaggaaatattttaaaaatattttttttggaatgcatattttctaatccttgaaataaggaaatatttttgaatcattaagttatattaatatctttataatattgtactttaaagctacaaataaaatatctcaaggctttcgtatttattattttagaatgcaaatatttaatatgttttcctatagtttaacccctttttttagtttaactttttctacttacaaaatagaaactgaatgaaacaattttcttaataataaataattgtgtatgataaaaagtgctgatttttataataattatttcaaaatttatatttaaaataattttaattaattgataatggactaaaattatttgaattattcaaaaaatatttttggagtattataaaatgttttatttaaaataagtcacaattaatttgtttgtttttctctctctaagattcacatttatttacgtgacagaactgagtgcccgattcctttttgtttatatttttggtagcaattgtaaactatcatcacaactttaccaatttcttacaagatataattatattttgttataattctttgaatgatagattatggtaccctgcaataacactaatatgttatcatcttaattaattacctatactcaaaatctatagtaattaacaaatctataatacctctttaaatttttttaatatacataattaaggttgaaataaaaactaaataaaataatataaaataaggaagcaagtatataactatgtcttcttcagaggatatccttaaccaagagaaaaatcacatcaagattactctgcgaatgttattaatttgcttttattctttactctgtgttaaaaaatcatatagctttcagtagttttaaaacaattcagatatttaataatcataacataattaaattaaaatataaattaagatgttaaaattaaaatcatatatatatatatagtatatgaaaggctaaataaaaatgtgtctaacatgatatatatttaatgatcaataagcttaaaaatatacaattcacatgtataaataaatataagtatatgaaaggctaaataaaaacaaaaaaaatatcatcatttaaagatgcttaacgcgaaaaataaatatgtataaaatgataaatatgtataaaaaatacatttatgcctctataaatgtgcctaacatgattcaccagtgtgccttccaataagctacacatatgctactcttgtaagttattttaagagtttatgaaaaaaagttaaaagtatcttagagcagttgaaagatatatatttttataagtttttttttttaaatactctcacaaaaatttataatatgaatctaaataatttgtttataagctattgtaaatgaaatatagatcaataagtcttgtgaacttttaaaatagttgtgtaattgtgatctatttttatatatcttgatacgttataataaaagttatctcacttgatatgtcattttatatgagttagaattctcttattttctttttctccatttcataagttttttgataaataaataaaaggaagataatacacccattacaaacactaatatatatatatatatatatatatgtatatatttatagatgtagagaaaaataaatagaaaaatcatagtcctttatatataaagagaaagaggatatatccaatgaaaccacttcgtattatgaaaataaaaattacaaatattgacatatatatatatattaatattaataatattacagatatatattaacactattattatcagtattatattagaaatttattaataatttaataaatattaatatattgaatgcaaatataaatacgtcaaaagaagattaatcaaaaatattattattaatactataaattatatatatatgtgtgtgcgcgcatgtacacgcacacaattttgatttttttaaggtatatatgtatttatataactttcatttatatatgaaaaaaatctattaggttagtgtcgtaagtaccttttttttttaaattttgtcttgaagttctaatctttatcttttttattttatcaatttttttaatattttcacacataacatcataatctatttgctttataataaaagaagatcttttttaaacacgtcattctcaaaataattgctatatatatatataatatttatatattaaaatttatcactatattaattacacttgaagaaacacatccaagctaataaattttattttgacatatttcattattagacatgacaactgaatcggacagggaatgttttgtctcttaagttctcgactctccaacatatcttcgtaacttgttctcaatatttgatatgttaaaatttgttttctcatttttgtacctgttgggtgtcaagtatccatgttcctaccccatctatggttcatatttataaaatattttttgtaaaaaatatatcaaaaatcttattttagaaaaaataaattcattgttacatatttattttaactacttatttatcaataaattcattataggacatttgtctaaaaaaaataaattgattggtgggtatgaatatgactatcaggcgggtagtgacattctcattcctaaccccaaccttgattaaaaaagttgaataatcctcaaattcgtacccggtcaacttaggtattcattgtcaaaatcggaatgagaatccaccagaacgggtttcattgccatccttattcattttcttagaattattaacaaaatagttgtaaattaagggaagaatcaaattgaacaaaatttaaaaaataaaaaaattaattaaatctaaatgataaatttgttaacttttataagattacatgagaaagtcaaacaagaagtaaatcatattctcttactctgttttttacatgatcagacaatttgtacaatactaatcctaaggtagagtagtagaaaaagtgatttatggtggatcatatattttgtttataatatggaccgttaaacttcctagttgtatgagatgttataatgcacatccgccgactagcccaaaacgaccaagacgttttcgccactgcctcgtccaaactaggaggtgtttcttacggtatctgaatttccatttacgccaccaaacacgttgagattgaagtaattcaaaagatggaaaagggattatcgttcgaaacttggtattataaataatgaacaagttttttttttttttgaacaagctaacattctggaaacttggttgacaccaaaaattcagatcctctgcagttttgagtctcaaactatatgacactgaggagaggaagaacgttggtgcattgatgcagaggtgcatcatagttttgtggacatgagatcaatctaatgatcattatttgtggtgtaccataaatcaccaaggagaatagatgacaaaacaggaaaaaaagaagagaaacttagtcacggatcctaaccggccagcatcaaattttacatctctaattaatgaagcaatatgttagttaattgaaggaagctggatgaaaaatttcggcgttttccattgccattagtagaatgtatatgactcaagagagcagaaaccggaaggtcacaaactcaaaacaaggggcatggagccaacttttggaaatgtatgcacttctagcaaaattgttcatgcataattttttctcacaagtagaatatataaacaccggcgttgttaagaatatacatagacataggtatctaccgtatcgttgtcaaaagtgggacatcataacccaaagttttaggaattatataccgtgtatggaccgtaacgttaataaaagaattactactataaggtatgctcagctttttcttaaaatgttaatcaataacattttaagaattatacactggtgttgacatatgccataaactaacgtacattttttatgagacctcttttcccctctataaggtatgctcagctttttcttaaaatgttaatcaataacattttaagaattatacactggtgttgacttatgccataaactaacgtacattttttatgagacctcttttcccctctcatcatccccttatatctttgcaattcttttgaacgaattaacctcctcaagtttcattttgaaccaaagtttaaagttttatttggagtcatgaatatcatcatccttgggtgcttggtgttggcaataatgccattgtttggtggcatgcataagatatcagctcgaagtggaggtatgatccatgcatgcatgttctttcatgtatttagttggtttgggaaatatatggtacaattgaagtcctgggcgtgacgtatgattggattaatcaatcactaatttgtttgatgggttggtaaaaagacttgtgggaaacacttctcggattaatcagttcataatatatatatatatatatatatatatatatatatatatatatttggatatagcaacacaaattaactttggcagggactcatcagtagagaattcatgttggtaggaacgtttttgtagaagtcttttattatgaactgtatgtcattattcatagttggttagctttgatggggagtttatatgtatatctgatatctcaagtgagaaggggactatgaagtgcacaaaccaattgcttggtctgattcctttcggtacctctttaatgaatttcccttggctggcattttttttactagtatagcttaattaataagatttatactttcaagtaataattaataaagttactttcttaattacgataatccatccattctttcttcgttcaaagcatagcacgatttctgatccgaacaaaagaagcaacacactgatattcatttttttttattataaagttattattttgtttttctttttagttcttaaaaactattttgtaaatcaactgtaaaaatataaaatctgtttcgtaattttattttcaaaatttttttagaaatgagaaaaaaaaaaaaaaatcagtttgttaaatttggttcaaaacttttcatttagatgtaatgtgatgtctattacctatgggttatactatgttaggttcacttaaagagggggaaaaaggaaaaaataatatgttttaataaaaagaaacaaaatctcaatatttctctattaatttttcccccttttcaattcaaattttgtaattttttctcgttcttcgttcaaacacaaacataagattaaatttgtttcacataaattacagaagcaaccaacttccttgtaatttattactatttattacaaaagcaattcaaatttccaaagtatattgtttttcttgttggttttttaacttttttttcttcttggtaaaatagattgtggcgggaaggacatttcatacaccataactgttggtgggcatggcaacgtaacattcggatcaattcaagctgcaattggttcgataagaaacaacaatgatcggtgggtcaagattcatatacaagctggcttatacacgtaagttgaattgaaatgttattattaagtattggtttgttctttccaaagtattgtttaatgtttagtctagacgtgtgcatggttctgtttttttttttttttaataaaaaaatgaaccaaactgtatttcctaatccatttcataatcaatatcacataacatcagtaagccaatatcattatgtataatgctactacatactacataatctcaagctccatgaaatggtggtacaaattcctttagatgttaaagcttgtatatataaatcatacaacacagatgaatacatgaacaaatgcaattaaagcaagcccacttaactataagttgtatttacttaataaggaagtattcaggatttaaatcatacaagaacagtactcatacaataggcagacaacatatctatcggaaatttacttaacggactaaactaaaaacaattaaacaatttaatgtcttgcggaaagtcaaaaagggggcatcaagttaattcacaatttacttatttgcaatgtttacaaatatgaaatactaattatctggtatgtgatggtttgtgtgatgcatccttgtggaatgcatgtatttatacacaatggtgcagcaacaacatagtctcgggtaggggcaaaggagaagagaaatagttacgtgaacttgtgggtattgtttggaatgcagggcaaataccactgcaggggggctttagttctactaattatacaacatgtacttgcctttggtaccctttaaataaaacaccttttattggctgaccaatttttttttttttagaatttctgatcttggaccaaaacaggaccaattccttttcttttctgctaaaaaggcattgatcaaaatcaatttatcagcagttttcattcactagagtccatttcagcttcttcatggctgaaacttcaggaaaatacaacttcgtttatgtagtaacatcatactaccttcttccatttttcaacagcaatacttggtttatttcataatcatttataacaattaagattactcttaattcatcttagtttgctacaaatgactcctcctactaaaacagattcaagaaatccacatacacacaccagacatataattctgaatgtatgcatgttcaacaaactaattgcctagaaaaagaactttcttaactagtcattggatgattttatggctcctttcatgttctaagcctatcatgtttcttttcaaatttggctgggtatttttctttctttctactaatatgaagacaatcctgccttagctaatctggaacattatgaatatgctgccacactagaaaaaaaaaataaaaattaaaaaaacagaaaggatgattgaagggatatcagaaacttgagtttggatttttttcatgtgtacttttttcttgaatttggatcccattttagaaatatactcgcctttccacatgtatattgttattcccatattctaattgtgcagaggaaagatttatattccccaagaaaagccctgcatcattttagaaggagagggcagccagacaacaatcataactttctgggactacaaagtaatggacactagcgctacattcacttcatggccacctaatgtggttgtgactaacattggtttcatggtacataaacaaatgataaaaaaaaatcattttaataacttttcactattaatttcttcttcttcttctttctaatgtatttctatttaactgcagaacacatataacagcatgaataggagaagcaaccctaaaattaatattagaccagcattggcagcaagaatatatggagacaaatccttcttctttagatgtaatttcattggttatcaagacaccttatttgatgcaacgggacgtcattacttcaaagattgttacatcgaaggagaagtggattttatctttggttatggacaatctttttacgaggtaattacataaatatactttttcaaaagtaatcattttgaacatgaaataatagaatatttttaaatttttttttcacttgtagaattgttcgatcaatgctgtggggacaaataggactggaccaggttttgttacagctcatggacgaaagtcactagatgatccaagtggttttgtatttgaaggaggttccctttatggggatgggaaagttaatttaggaagagcttggggtccttactccagaatcgtatttcatggaacatatttttcctctgtggtaactcctcaaggatggaatgcttggctttatgctggcaaggagtaagtttaaatgaatatattatctcttaaaggataatgcaaaagtaatattcataatttttttgaatcatctttgtcattttgtcttattttttaaacaaattcttgtaggagtaacttcacttatgctgaagttgattgcaaaggaccaggagctgatatttcaaagcgtgttaagtggatgaagaagttaaaccaattacagttcaaggaattttctttagcttctttcgttaataaggatggttggatcgacaatttaccaaccatttcctagaaatcgatgtttcctatcagagattttctgtaaggctaagattagttggttgatctcccatcaatatgctctgtatgctcaactaagatataaataaaagttaatgttcagttattctgttgtactactattcttatgttaaatttatttattttttgaatgatgtctttagttgttagataccttccatagattgaacatttttaattctttacgatgcaacagaaagtaaaagtaggacaattcataataataaaaaaagtggttggagctgtagctaaagatttacccataacacttccgaggaagagtttaggctctgtttgagattgggtgatgctagagtttaagagtatttaatattcctaatgggaacccgacgccttcgagattgcttaccattatctgtggttcatctctgagttggtttgggaattttagtgaagaatgccaattgagttcatacgattcaaaaggtatcaagtgtgtagacaagtagagttaatatttggtatttatttcactcggtttataatgcattttgttatatgagctgatttgctaagtataatatttagggaatactatatgatcatatacaagccaatttggtggtagctgatttggggactgatgcaaagcactgcttctgaaaagcaagtgacttattggccgtggttgagtagggtttgaccactgtatgatagtaattgaggtaaataagatcaatatagctcataaatttcataaaagtattttaaactgtcaacttatagcctatttttttatgctaattgcataacatatatttaattgataataaatttatgtcaattgcatattccaacagggaaaaagggttataatcaatccaccacaaacaaagctatatagcaaaacaacagataaatagacaagtgataaagcattgggtatcaaaagaaccaattaaatagagaaaaagaatgagccaacatgcatggaagttgtgagatggtgtttgctcatggtgttcttcggtagtgcagcgttacaaaaaaattgatcaaaggcaaataagacaaaaaaacgtgactaatcatttttttaatcattggtatggtgtatattattgataaccatcttggaaaactcgactaatcaccattaataggtttaaattcaatgacatattcctctttttaacttcttttatttcattttttatgtttattttttattaaccagataaaattggaaattataaaaaacactactaaacatatatatctcaataaacaaaatgttgtacatagacaagaaaagataatggtggcagctagacgcgtacgcaccccacaaacaaatagcagaaaacttgaatttgatttttattaattactctccaacaaagaacatgctaaaccactaagagaccttagattgaaggtgctgcctaactaagtctctctgtggctagaaatgcaatatagctaagcaaatttgtttggtggtcaagagtagaaattgcacggttaacaacatctgcagcacccaagtcttcctcacatgacaaaggtgcatcaccagcaattttggccaaatagttagcaattataggatcgtctttcaacttaatcaaagaattcctaaacgattcaaccgtaatttcatagtaattttcacatcttacaatggcgggaacatgttccaatcccttaagaaagttttcaccctctattcccttcttcaatcccaactccaagattgcctctgcaagttcaagaaaattatttgcaccgaggactttaggatctgctcttagaatattcgtgcattcaatcttgttctgtgggttttcattgcaaatttgggcaattaggtcggaaccatcaccaagcactctagcattagttagcgaaggagactgagaaacaagcaaagggtgagcaacagggaactcagtgataaagaattcattctgtggtagggagttttaatcgaaaggcacttcgttgctaaggtgttggcttcttttatagccttgctgctaatattccacacttaatgccttatattatatatattattatcattaaattatttagatttttataagatgggatcaaaatgaggatgatttaactctaaaaatgttacacgaaattcaaattgttaatagaaaatgatcttacgctttatattatatatatatatatatattaattattcaaaaaaaaatatagtaatttttaaaaaagttgtggcaaatcaaatacttaataataaaatcttttgatttggcttaaatcattaaaatgtctatctgtttttttaaaaaaatattttacccttttaaaattacaccgatatatttatcttttttataatattatattttaaagatataaataaatatcaaagcatttattacttagaatccaaatatttcttatgttatcatgtaagcaattaaaataacatttagatagatgtttgactattcaaaaaaagaaaatatatttgagtttttgagcttatctttttacttaaaatataatattcaggaaaatattcttactttattcattaacaagatccttaaataaggaatattttgttacattttactatatttataatattcaatttcaaggaaacattcttaaattatttttttgaatgcatattttctaatccttgaactacggaaatattttctaatcaatgaattatattcatatcttcgtaatattatactttaaagctacagataaaattaaatatctcaaggcattcgtatttattattttagaatgcaaatatttaatgtgttttcctatagttttttagtttaactttttttacttacaaaagaaaaactgagtgaaacaattttcttaatagtatttaatcataattcataaataattgtgtatgataaaattgctgatttttgtcataactatttcaaaattatattcaaaatcatttaattgattgataatgtactaaaattatttgaattatttaaaaaatatttttggagtattataatgttttatttaaaataagtcacagtttgctgggttttcttttctgggttttacatttatttcattttgttttatatttttttggtaacaagctatcatcataactttaccaattacttgcaagatataattatattttgttataattctttgaatgataagattatggaatcatgcaataacaccaatgttatcatcttaattacctatactcaaaatctatagtaatcaataaatttataatacctctttaaaaaaatttaatatacataaggtggacataaaaactgaataaaataatataaattaagaaatcaactaaacaagtaaatactatgtctttgctttgtcagaggatatccttaacgaagaaaaaaaccacatcaagattacaatgcgaatgctactacaaataaaaacgttatttccgacggacaaaatctgcgctaaactagaaaatcgtcggaaaaacaaaattttcgacgtaattccgacgaacaaaaatctgtcgctaaaactctcgtaggaaatttaaaacgtcggaattttttttgtctgtcggtaatgacccgtaggaaatttccgaccgaaaaatctgtcggaaatacacggtacataactccaaaatggctttctacgtcgattcgaaaaccgtttgtcgtggaaaatcgacaccttctaagacggttatttggaaaaccgtcttagaataaaataaaatttgaagattctaagacggttttttgcagaaccgtcttagaatgtctttttaaaaaaaaaatcaaattcacggatgtcattcaatgcttacacactaatccagattccaagcatgatttaacaatgtttaggataccaattctttatggaatatacacattaaaaaattgttaatagcaaaaccatcggaaaaaataaacataataataagcacatatgttaataaacataataaaaaccatgaatcctttgctgccacatagcagcatcaactgagaacagtgatggcagcaaatagatcctataaaaatggcaaaatctaaaaaagaacaaaactgatatttttcttcaataatttaaatacttaaaaattaaatacctcttaagtttattgaaagtaggcaaggagtatataaagggataccctgcacacatttaaccaaaaatggtgtaagcataaccatagttttaaatagcgccgctttagcgcacaatctcgcaccaggtgcagtttgcggcacccagccgctacgtccgtgccgcaacgcgacggtttccggtggcggcggtgcggtgggtagcaggtgaggcgcgatagcgccgctacttcgttgacgagaaaacagttgcagagaggcttaggtatagggggcagccagttgggaatttgatgaaatttaagggcaaaagggtaaaagtccaacaataagtgagggcagtttggacttttatcctttatttttttttcttaagaggctgtgtggactgggcatttgtccttcttcctcacaaatcccttcgttctttttcactttccctccctctttccctcctgacgccgctacaacatcttctccctctgtctgctgctttctcgccttctttctctcccgacgaagctgctccctcccgacgccgctgcagcatcttctccctctgtctgcagtgctttctcgccctctttctctcccaacgaagctgctcagctgtcctcttctccgctgcctgctgttcattcgtgcttcacacgggttcgtttctttcttcttcttcttttagccttcacagtgttttaattggttagcttcctcctccttgatattagctttgtttctgcctcctagcgaagaaagcgagggtggacaagaagaagactttcaagaaatgtttgatgatgatcttgattagttattttctttcttgactttgaaagagccattgaaaatttctatttgactctacttggatcatttgtcttcctagaatgttattaatttagttactttcaatgaattagtatgttgcttcctttatgttccttgaatccttgttttgaaagtgtagtattgtatttttcattccttatttcctcctattttgggtgatttcttatcttatagcatttatatatgtggtataatttattatataagtatcttatgtactttacagtagcggctttaccgttacccgctataccgctatagcgtttttggggtcagtcgctacccgctatttaaaactatgagcataacaataatatgaagggataccatgatacattgatatggaacaacataagttacttaattaattaatcatcaagacataagactagctcctcccatatattcataccctctatgatccaatgatcaagtgaaattttcaagtagttgactatcaaaaatattgcataagatcatcaaggctaataatagtgttggtcaaaaggcattttttggcacttgattatgtataaatatttattactcaaggaaccacagaaatgaaaagaaatggatttctcattgacagatcttgaataaattctattatcaagtatgcataaataaagtagtataggaaataagtaaaggtgattattttatattattatattattcattaaataagtaaaggtgattatttttagtggaaaaagaaaatcagtgtgataatcccatccatcccatatccagcggatagggatggcaaacgggccggcccgcaaaaaaacggggcgggccgacccggcccgcgaaaaatgcggggcgggctagcccggcccgcttttgcaaagtgggctacaaataccagcccgccccgctttaatgcgggtcagcgggccagcccgcatcaaaattaaaaaaaaaataaaaaaagtcaatttaaaaaataaaatacaaaaaaattataaaaaaatacaaatatgataattaaaaaaatacaaagttaaataaaagtaaataatttaaaattaatgctaaataaatgatgtcatgtgataattcataaaattataccatttgcaaatggaatttacggttataaactgtccaaaagtgtaatatgctagtaataaaaactatttgaaagtatcattatcataaccattttaatattaaaacttagaagttaattatgagagtgcaaaagagtataaattaaaaaaatatacctatttcaaaatatgttaaatatatttatttaattttaatatttaatatttaaataatacaggcccagcgggctggcccgccccgccccgcgtttggcccgcaattttgcggggcgggccagcccggcccgcttttgatttgcgggttgatattatcaacccagcccgcgtttttttacgggctacgcgggccggcccggtgggccaagcccattttgccatccctaccagcggacaacagccatgcataaataaagtaaatgggcccacaatataaattattggcatggcttagcaataacagatatgttattacaaaaagctatggaactctacatatacaaggaccgtgacttgaaattatatcatcttctttggaagaactacctttaacaaatccttgtatattttcttgaatacttttgtcctgttgtgagtcccaaagaaattgaataacatacatttgcattgaagccaaaggaaaggaaaataagaaattgaatgttatttccatcatatctctaaaccacatcttattacacatgctttgagtaaatctaagagcatatgattaacatacaaattattttttatcatatcataaattttaatatatttattaattttcttttttattcattctttaaatattagataacacattacatgtttatcaaacatattcttataattatcctaatgagctgttatataatggtgagtggaatatatatatatatatatatataagtgtaaactgaaattacgcgtggataactataagatataatatttatatagaagttctagtaaatgggcatggcaatgacaacaatgaattaaggatgggtcaatttttgtcacttaaggtcaccatcttagagggggggcattaaaattgatggatggaggaaaacaagatgccccaattgggcacaacaaaactggttagctcagatggacgccgactctggaaaaaaaaataattaaagcttagatgttgtttccgtgacttaatcagcaacaaattaattaaacagaaaaattaattaacaaaaagactacacagttgttattcattcaaggaacttaaagctttttttttcttttttttttaaaaaaaaaaatacaaaccacacaaaaatatattttaaagaaattatattatatcattgatagttgcccatagaacatagtgtcagaaagagggtattgaccaaaaagctagcgtgtgaaataatatatacaaacacacctgagggtcttgagggggaaatgcttgaagtgacgctcccatgttaactgatagcaaattggcacaatgtccacatctaactgtccctatggttagcaaactgctgtatagaacactaatctaccattttccaataaatactataattatttacaaagagaaaaaaaagttatagaaattagaaaccaataactgaaagctagtttggtaagactattttttaaaactattagcagcaaccacgcaagcaaataactatactaagcttccagtcagttactgttaatctataactatcttttacttttaggctgcttcaaaaggcttccacagcatgaattgaatcagggaacaaagcaatatatctgtaactatgagttagaagaaaacaagggtggtgagaaatgaattttaccttcccatagcatcatatgatttttatgtcattatccaatgtggaataatatcaaatgcatactttccataagaggaggaattctagggcccaattgtttctgcttattttgaagaataattgatttttttaattaatagatgtgtttatgttaaaaaaggcttaaaaacttctgaaaatagtttcaatagaagttgttatcacataatccttttttattaatagacaaaaaagcgcttaatgaggaaactgaaatcatgaagatcacatttagaaggatacaatattttctctattgatattcacaccaaatctattattatttcttcttaaattttttatatctaaaactttagcaacataaatttaataccaatctcctctccaattgcaaatgcaaagcctcatttgggtaattctagatttgtgcattgtgcttcaatattccatccaattcaaacaaaaccttcaccaacaacatctctgccttcccatggttctcaatactaaaataggtaatccaagtacacataatataagaaattattttggtgaactgaaagcaggggtttgaatatttattttcaaagctgaaacctctctgcatactgcatgtctaaaacaaaactgggtaccctaactccgtcttgtgagtacgaatttattaataatttgtgtgatggccttagcaagaaagattgaaagccaacttaccccacagatgatgtatccagttcattctttgaaagagttattgttatcattgatacatgccttgtcgtctccaaactaacagatggacaaggataaaaatagagtgtaaggattaagcaagctagcatccacctgattggatggtatgtttaacatttgaaccatttagatttaagatactattaatcagagactgcacttacggaaggaggccttcctctaggggctcccaagtatcagtgatatcagtggatccaattgctatattctggtggaggcccacaattctcctttgcattaaccccaagaagtaaacattaaaataaatcctcatcaaataaaacaaaaatactaagatagtggtcagccaagctaatcgcagaagcaaacataccttgatcaactccacaattgtcacggttttgttgatagctctagagccaatcaatttatcaatggtacctgcaaggaaaggaaaataatggcagaaaacagagagagaaaagccaaataagggttgaagaagaaaaagggtttgagtataacctcagagcagagtacagtcagtacactaccaactcatgaacgacggaacgagcaagggctaaggagcgacgtcgccgatggaccaaggagtgatgccatagcaacgagtaatgcagaccagcctcaccagcaacgccaagacggagggaggaagaagaacgaagcacgaaagtgaagaaatgtgaagaagacgaagagacccaggagccgagccgtagcgggtaaggggggttgattgggattggggttgggtcatggagtgagaagaagatgaggagggggctgttgtgctttactattaggtttccacaaataaattaattaattaatataagaaaaaatcagttacccatggaatattcatgtttcggaaatatgtcatcggaaataggcctttttgttgtaagactcatatacttattttttattttttgctataactgttaaaaaaatcatatacttatcagtagttttaaaacaattcaaatatttaataatcataacatgattaaaatataaattaagatgttaaattaaaatcgtgtatatagtaaaatcatgatcaatcaacttaaaaatttacaattcacttgtataaataaataatataagtatatgaaaaatcaaataaaaacaaaaaaaaatatcagcatttaaagatcgatgcttaacatgaaaaataaatatgtaaaaaagataatatgtaaaaaaaatacatttatgcctctataaatgtgtctaacatgattcataggtgtgccttccaataagctgctcctatatatgctactctagtaaattattttaaaagtttatgaaaaaaaagttaagaaatatcttagaccaattggaatatatttttataagttttttaaaatactctcaaacacttttaaatatggatctaaatgaaaatataggtaaaaaaaagtcatgtgacgttctaaaatagtcatgtgtaattgtgatttgtgatccatttttatatatcttgatatgttttcataaaagttctttcactagatgtgtctttttattagttaggactcttgttttcttttcctccatttcataagttttttggtaaataaataaataaatgaaagataattcacccattataaagactaacatatattttcttaaaaacttgtatatttatgtatatatatttatagatgtagagaaaatctgttaatccttttatgtatagaaagagagagaggatgtatcaaataattccaaatatattgatatatatatatatatatatatataaatttaagtggtgaagattaaaaaaactgcacatattttttaagtggttttgtgaccacaaattgaattataattttggccatttatatttggttgagtaatatatttatacttttcaaattcttaaaatgagaactattcttatttgatacgctgccatttgtgtgctcttgcaactatgaactataaggagcttaacagaaaataatgatgtgtggttaattagaggcttgttctaaataattaagaatttaagttgaatgataacattggagtcaaaattggttggagttgtagctaaagatttacccataagccttccgacgaagagtttaggctttgagaagtgggaatttacctatgaagtcttctgacgatttaggcactgtttgagattggcaggtctggtgtggttttatttagtatttagtttctcacatttttgaaaaggttatccggttatacaacttcatgaaataataatgttatctcttcgaggctataaaaatatatttatccttaaattgcagatgctacagtttaagagtatttaatattcctcatggggacccgacgccttcgagattgcttaccattatctgtggtttatctctgagttggtttgcgaattttagtgaagaattccaattgtgttcatacgattgaaaaggtatcgagtgtgtagacaattggagttaatatttggtatttatttcactcggtttataatgcattttgttatatgagctgatttgctaagtttaatatttagggaatactatatgatcatatacaagccaatttggtggtaggtgatttggggactgatgcaaagcactgcttgaaaagcaagtgacttattggccgtggttgagtagggtttgaccactgtatgatagtaattgaggtaaataagatcaatataactcataaagttcataaaactattttaaactgtgaacttatagcctattttttatgctaattgcataacatacatttaattggtaatgaatttatatcaattgcatcattccaacaaggaaaaagggttataatcaatccaccacaaacaaagctatatagcaaaacaacagatagatagacaagtgataaagcattgggtatcaaaagaatcaattaaatagagtaaaagaatgagtcaacatgcatggaagtattgagatggtgtttgttcacggtgttcttcggtggtgctgcgttacaaacaattgaacaaaagcaaataagacaaaaacacatgtgactcgtcattttttttaatcatcatagtagtgtagtatggagtaatttattgacaatcatctccatcaaaaaacttgactaatcaccattaataagttcaaattcaaacccgagacctcatcatacctaattggtaattgcataacaaacatttaattggtaatcaatttatatcaattgcatcattccaacccgtaaatagggttataatcaatccaccacaaacaaagctatatagcaaaacaacatatagatagacaagtgataggcattgggtatcaaaagaaccaattaagtagagtaaaagaataggtcaacatgcatggaagttgtgagatgttatctgttggtgttcttcagtgcggcattaccaacaattgatcaaaggcaaataagataaaaacaaatgtgactagttattattttttaaaacgatgataattgatatgaaagtattttattgataattgtatccatcaaaaacatctgactaataacttttaataggtttattttctctcaatcataaaattcgaacccaagactttaaaaacacttatcatgcttacttaaatctttgtgacatattcctctttttatctccttttatttcattttttatatttattttctattaaccagataaaattgggtattataaaaaacacgacgaatcctatataatggtacatagacaagaaaagataatggtaaacacgtacgtaccccaaaatcaaatagaagaaaaacttgaatttgatttttattaatttctctccaacaaagaagatgcaaaaccactaagagaccttagattgaaggtgcaactatgccttaataaagtctatgtgtggctagggatgcaatatagctaagcaaatttgtttggtggtcaagagcagaaattgcagggttaacaatatgtgcagcacccaagtcttcctcacatgacaaaggtccatcaccagcagttttggccaaatagttagcaattcgaggatcgtctttcaactcactcaaagaattcctaaacgaatcaatcgtactttcatagtaaattgcacatcttgcaatggcgggaacatcttttgtcttcaccaatcccttaagaaacttttcaccgtctattcccttcttcaagcccaactccaagattgcctctgcaagttcaagaaatttttttgtacccacgactttaggatctgctcttagaatattcgtgcattcactcttgttctgtgggttttcattgcaaatttgggcaattaggtcggaaccatcaccaagcactctagcattagttagcgaaggagagtgagcaatgaggaagaggaaaaaaaaaaaattaaaatattgtaattttaataaaaaaattatgaatatattgcagtttgaaaagtatttatatatgtagagcaatcagtcacaacctcactaggacgcaatcagtcgcgcccccaccaggcgtgactgaggcttagtcacttcccagccaggcgcgactctgcagatggtgacacgtgtcattttgaggcgtaatgcgtaaaaacttcgaaatgtcataacttttgactggaatgtccgattgaaacgaaaccggtggccacgcgctcgcaattgagaggagaaaccctagacaattcccaaaggggacttggtcaaatttttttctaaaaaatgcctctaagtatctcaaaattacgatttaatcttcgaacctctaaaaaatttcttgttttctaattttttatttattcaattagtgaactgaatgctattttttatttttttgattacatgtattaatttcaaatgttttgacataaagtatgcctacatcggacatttctatcaaaaattatgattgtttgaagtttatatgcatcaccaattttacaatataattttattcaatttttgaaattagtgttgcgaccacaatattgtcattttttaatttattaaactcaaatcatttaaaaatctacaatataattttagtaaataaatataccaaaaaaacattactaaattttgataggaatacccgacggagacgtattttatatcaaaatacttgaaattaagagatgtaattagacaaataaaaaatagcatgcaattcactaattaaataaataaaaaatcagaaaacaagaaattttttggaggtttgaagattaaatcgtaattttgaggtacttagaggcattttttagaaaaaaaatttgaccaagtcctctttgagaagtgcatagggtttctcctctcaattgcgagcgcgtggccaccggtttcgtttcaatcggacattccagtcaaaagttatgacatttcgaagtttttacgcattacgcctcaaaatgacacgtgtcaccatctgcagagtcgcgcctggttgggaagtgactaagcctcagtcacgcctggtgggggcgcgactgattgcgtcctgctgaggttgtgactgattgctatacatgtgtaaatacttttcaaactacaatatatttataattttttattaaaattataatattttaatttttttggcatgaggaagaagcaaagggtgagcaacaagggaacaccgtgctaaagaattcattttgtggtagggagttgttttaatcaaaaggcacttaggttgcattgggtgggggagtaaattaagtttccgaggtgttgccttcttttatagtcttgctgctaacatttccacatttaatgcattatattatatatattataatcattaaattactaagatttttataagattgatgggatcaaaatgacgatgatctaactctaaaaatgttacacgaaatttaaatagttaatagaaaatgatcttacgtttttatatatatatatatatatatattatatctaatgcatttattacttagaatccaattatttattgtgttataattaccatgtaagcaattaaaatgagatttacatagatgtttgactattaaaaaaagagagaatatttttgactttttgagcttatctttttacttaatataatattcaggaaaatattcttactttactcatcaacatgatccttaaataagaaatattttgttacattttactatatttatagtattcaagaaatattcttaaaatactttctttgaatgcataatttctaatccttgaaataaggaaatactttctaatcattaaattatattaatatctttataatattataatttaaagctataaataaaatatctcaaggcattcgtatttattatattttagaatgcaaatatttaatgtgttttcctatagtttaaacctttttttagtttaaacttttttacttacaaaacagaaactgagtgaaacaattttcttaatattatttaatcataattcataaataattgtgtatagtaaaattgctgatttttaccataattattcaaaattatatttaaaatcatttaattaattgataatgtactaaaattatttgaattattcaaaagacacttttggagtattataaaatgttttatttaaaataagtcacattttgtttgttttatcttcttctgggattcacatttatcttcccaacacggttcattgcccgattcattttgttttatattttttggtagcaagctatcatcataattttacgaattacttataagatataattatattttgttataattctttgaatgataagattatggaactctgcaataacattaatgttatcatcttaattacgtatactcaaaatctatagtaattaacaaatctataatatctctttaatctttttaatatacataattacggtagaagtaaaaacagaataaaataatgtaaattaaggaaacaatgaagtaagtgtgagataaactaaataatctaatcatgtttatacacaaacaacataagcaattagatcaaatgcgaaaaaattaatatcataaatatttttcgtcattgctattcttttctttcttcgaagatgagtgacaattgtccatgagttaagtaatctgtgaatactttgtaaatcttctaagctctagctctaatgcacagatgatgtattgcatatatttcagagtgagctcagggaccccaaacatacactatatatagaactaactcaaaccaccagaaagtcagttgttacgtgcacaaaacatgagttgttataaaaaatactgaaatattgaaactgttgtaataatgggataatgggattttcagtttaagttagtgaaccactttatgagttagtcttggttggttatcaagattataggaactaacattctcccacttgtccacatatctcgtcatatgctatagtgagaaataaaatacatgaattatgacgatagttcctctagtatatacgagtactatcttccatgtattacattacattctatttcttaaacccatacaacttaatgaataaacccaatgtttattcttggtccaaacttaattgatgtttctcagaataaaaaattgtagatgcgcataaactgaatgaaaaacatcacaatagagtttcttaatatcattcttacaatgaaaatcacatatggaaaccaagtcccatcctttccaaatgatcattaaatttaaatggtggcatgcccttagttaaaggatcgacaatcattaattcaatgctaatgtattcaataactactgtattatctttggcacgttctcttatgactagatacttaatatcgatgtccttacttcaactacaacttttgttattctgtatatcttcaatggcctaaaaatggaatccataactctaagacaagacatgaaactcctcattcatacaccatgttaggtagcctcaaaataagaaatgaactcggcctccataatggaagtagcagtcaataaggtttgcctgatacttctccaagacacaactccactggataacataaaaatatatcccgaagtcgattttctcgaatcagcacagtcagcatagtctgaatctgaatagccaatcacttccaagttgtcagtccgtctgtacataagcatgtagtctccttaacaatccaaccacaaaagcaatatcaggtattgtgtagaactgaacatacataaggctttcaacatacacaatgggagctacacttggtgaacaatcactcattctaagtttttttcaaaactttgttaatataggtctcttgagacaaaccaagaacacatcttactgtctctatgtatcttgataccaataatgtaagaggcatcacccatatcctttatatcaaagttcttagagagaaattgttcacctcatatagtaaacccttgtcattggttacaagtaaaatatcatctacatataaaataaggaaacaaattttgctcccactgaccttcgtggtatatacagtgattaataacattttctacgaaatcgaatgaagaaataacatcatgaaattttaagtaccactgacgggaggcttgttttatatataaatttcttaagcttgaataccaattgctcatccttagtagaggagaatccttcatgttgtttcatataaacctcttcctctatgtctccattgaaaaaagttgttttcacatccatttgttgcaaccaaggttgtcagaatcgcgattctacgtagactcgtggagacctcgtagaatcgaatcgtagaatcgtaagagtctacttcaaaaaaaattacctataaaaattaacctttgattaagaaaatatattcaatggttaaaaatagtaaaaataaattttacttgtgcaccatagccatccagcccatcccaccaaattgtgcaccatagccatccggcccatcccaccaaatacatatgactgatataagttttctcctttcggcatattggtttttgagacatgtgcaagtaagatcaaatctcagcccttaatctaaatacattcagctgatcataattttatttcttcctctttcacattgtgattcgtgaagcatttttttttctttccctttctcagtcacagactcacagtccttccccaatcctcaaatcacccctcctctcgtcgaaacccgaccccatctccattcaaaatcatggccttgtatgtggactgaaactaccactaccagcgaagcagcaatagcgaaacgaaagaaagcaaagccatgggactgatcatgatcaagcttgaagtggcacggaagcacgaaagaaagacaaagccatcgacaaaacggtgccgttttgaatttattcagactcgcggactcgcaatcaaactcgcgattctaagtggaatcgggcaagtctacgtagaatcatacgattctactccgtttccaagtttgcttccgattcaactcgccggggggtgctggactcgtaaaatagtccgagtctgccagttaactcgcgattttgataaccatggttgcaactctaagtcaaaatgtgcaaccagtgtcagaatgatgcgaagagaatctttcttagataaaagagagaaggtctccttgtagtcgatttccttccttttgattaaatcccttggctatgagtattgctttatatctctcaatgttgcctaatgagtctttcttagttttgaatactcatgtacattcgatggcttttgcaccatcagacaactgaacaagatcccagactccatttgatgccatagaattcatttcatcttttataacattataccacaagtttgattccttagaactcatggcttgtgaaaacgtttcagaatcattttcaactccaatagtataatcagattcctgtagatacaaaatcactcggtatcgctgatttctttattctgatagatctccttaatgttgtttcattatcttcttgcgaaacttgttgttcaattggttgatcaataatttattcttgttcctcgtgaacaacttgatctactagattatcagcagattgtggatcttgaatgataggttgcacaacacccggttgagctggaagggtattgttaagagcaacaaatctaagatttgaagtagattgttgagtaactgaatgatctttctcagaaacaaaatctatggattgatcgttcccactaatcaagtcattctcaagaaattcaatatttcttgattccacaatcattgtactatgaaattgatagtaaaaattgtatcccttagacctttcagcatatctaatgaagtatccactgatggtccttgggccgagcttcttttctggtgggttataaattttcacttccgaccggcatccccaaatgcgtacatgtctcaaacttgattttcaactcttaaattactcaaatggtgtctttgggacaaccttagttgtaactcggttcaatatgtacattttcatctttaatgcttcagtccacaatgagttaggaagcttgaaactactaagcttactttgcaccatgtccattaatgctcggtttcttccttttgtcacaccattctgatctagagaactagacatagtgtactaggcaacaatcccatgttcttgaagaaacttcgcaaatagaccaggtgtttgtccattcttcgtgtatctaccatagtattcaccacctctgtcggatttcacgatcttaatttgctttccacattgtttctccacttcggccttaaaaactttaaaagcatctaaagcttcatctttagaacaaagtaagtagagatatatatcgtcaataatcgtctatgaaggtgataaagtatttcagactacttgggtccatgtatggacacaaaatatttgtatgtatgatttctaatagatttgagctcctctttgtaaccttcttagacttgttagtttgcttacccttaatgcaatctatacaagtatcaaaatcaacaaaatccaaagcactaagtaccccttcatttaccaatctcttaattttatcgatagagatgtgtgtcctaatcttaggtaccacaacatagaggaatcatcattcataacacattgttttgtgtcaacattaacatgcataacatcataagtggtatcattttgcaaattaatgtaaacaaaataaaaacatgttgcaaatcaatccaccatatgttatgattaatcatattagattcacaacaaactaaagaggtagacatatctttcttttccaaacaatagcttgaacttaggacagtttttcttcatgtgtccttccttgttccaactgcaacctctcctcttcccgaacacacatgatcatgagttcattaatataccatttgtctttgtgtgtgttgtcggatattttaaagggaccatatggtgggagagtattcagaaaaaaaatgcaccagaaaggagtcaaacatgtccacctctagagtttttagttgagctgtaatgtccctcatatgcatgatgtactcacgcacacccctcagagtattgagttttatagaagaaaatttcattattaaggtattggtcaatgccttccctgaagtctcaaattgttcatcaatgtatttcaggaacacttttacattgtcatattattcaactgagcccttaatatcagcctatattttagtcttaatgaacatcacacagagtcagttggatctttctcaattttcatacagatccatctcctctggtttactattctttgtaattgctagtgactcaactttcctaatagcataatcaatgtccatatacactaatgtcaatagaatcatttcttttcatatagaaaaataatctcctctcaatttcgggacatcaattgtattaataggttgtatagttacaaaataattcaacatatatgcttatcattaaaatttgaggcaaaataatgtaccatgttttaccaatgtaagtcatgcttataaaattatgaatttagcgacataaaatttgtctatgggctaaaattttaattcaattaaattcacataaatattatgataaaactatcaagttatatttctttatccttataggcaaatcaaaaaaatataatttaatattttatcctaattaatcatacaaaaatataataaaattttttatgggataatatttactatattatattatgattaattataattaatatcatataccttatgtgatctaaagagtcttaatatataatttaaataattaaagttgttgtggctagactttaattaactaattataaagatcactaaatattatataatttccaaaattaattttattgtaattaatcataaacaataaaattaaataatcaatcattcagattaataaacttaatattacattataggaaaacataaattaatacatgtaatgacataataacaatagatcatgtgaacatatattacaaaattgtcattagttcaattggtaaaatgctttaaagttatttatttggttatgggttcaattcctatctaatgcattttattttattttattttaaattcttgaattgtcaagtcatgatagcataaatcatgaaatgacatagtaacaataaattacaatattatacataattccttatatgatctttatacaacttaatatataattttaattaaattataggtattgagactaatccataattaattaaaattataaagatcacctggacataaaacttaatcatatgagaataaatcatattatgcacttcaagattaagatataatataatgataaataaaattctcatatataattacataattaaaacataatattatgcatttgatttaatatatatgaataaaataaacttttttataatatattcatgcataaaataaataaaaactctacaaattctaaaattaaacaggaacgcataagcatataatagatagaaaaaacaaataactattagttaatcttaaatagcttagtagtttgtgcaagttttactaaatggatggatgtggggttgagacccagcaagagcaaaatattttattattataattattgttgttgttgttgttgttgttattgttcatcatcttcaaccttgagctgggtcactttgacccggttgtgacccacgaacctgaaataaaaatctggtaatttttcagccattttacaacaccgaaattcatgttttaatttgtaaaaagcttaaaaactcaatttgcatataatttcagtttaagttaatatatcactttataacttaatcttgattggttaccaagattataggaactaacaacaagtaaataactatttcttccccataagatatccttaacctagagaaaaatccagatgtgagtgttcttagtttgtttttattttttactctgtgttaaaaaatcatatacttataagtatatttaaatcaattcaaatatttaacaatcataacatgattaaaataaaaattaagatgttaaaattaaaatcatatatatagtaaaatcaggatcaataagcttaaaaatttgcaattcacatgtataaataaatataagtatattaaagattaaataaaaagaaaaaataatatcagcatttaaattaagatgcttaacatgaaaaataaatatgtaaaaaatgttaaatatgtgtaaaacaacatttatgcctctataaatgtgtctaacatgattcataggtatatatgcagtgttgtgaaaaccagttcggaccggtcggtccgaccggttgaaccgggaatcggtcccttaaccggtcatgcagttgacccggtcaaaaaccggtcaaactcggtcaaaccagccaaaaccggccaaaaccggtcgatcggaccggtctgagtttttttttttaaatgtgtttttcttaaattttttttggcttttttttttaatttaagattattatccataattattttagattttgaagtatgaatgaatttttttattcaaataatgttagttatatacttatatataacagatacatatataattttaaatttttaatatataccggttcaaaccggtttaattactaaaccaccggttgaaccactaaaccactaacccactacctcgatcggttaaatgaccgaaccggttttcacaattgtatatatgccttccaataaactcggcatatgctactctccacaacaatctgtaagtatttcgaaacaaggattctcgacatgctatgcaaggcggcaagtgctacttcctgttagactaagcttaatacgacatttatgcctttataaatgtgcctaacacatgattcataggtgtatatatatatatatatatatatatatatatatatatatatatatatatatatatatatatgccttccaataaactccgcatatgctactcttgtaagttattttaagagtttatgaaaaaagtgaaaaatatcttagaccaatcggaagatatatatttatataacttttttaaatactatttgtttataagctcttgtaactgaaatatagatcaaaaagtcttgtgaccttttaaaatagtcatcatgtgtgaccccttttttatatcttgatacgttctaataaaagttctcacttgaaatgtccttttatatgagttagaactcttgtttttttttttctctatttcataagttttttaaataaataaagtaagataatgcacccattatgaagactaacatatattttctttaaaacttgtatatgtgtatatatatttatagatgtagagaaaaaggaatagagaaaatcctaatcatagagagatgatgtatcgaatgaaaacatttgaaaataaaaattacaaatattgacacacacacacacatatatatatatatatataattattaataatactacagatatatattaagacttttattatcagtattatcttggaaatttattaataatttaataaaaataaatatattgaatgcaaatataaatacgtcaaaagaaaattaattaaagatattattattaatcctctatatatatatgtgtgtgcaatcttgatttttattgaagatacatatgtatttatataacttacattttatatgaaaaaaatctattagtttagtgtggtaagtatttttttttaattttgatttggaattctaatctttatcttttttattttatcaaattgttttttatattttcacacatcacatcataatctatttactttataatcaaagaagaaatcttttaagtacaagtcattctctaaataattggtaatatataatatttatatattaaaatttatcactatattaattacacttgcatacacacgtcaatgccattaaattttattttgtgacatatttcattattaaacatggcaacagggcgaggcaagggtgggatgagtattgcctcctcaatccttgatcccgactcaccaacatatcattgttcttgctcgacgggttaaaatttgtttcctcactcctatactcatttggtatcgagtatccctgtccctgccccatctccttttcagatttgtaaaataagtttttttattaaaaaattatattaaaaattagattttagaaaaaaaaattaattgttacacatttatttttaactacttatatatcaataaattcattatagggcatttgtccacaaaaaataaattgattaacagtacaaggactggtatgggtacgggcacgtgacgggtagtgacatctcatccttgaccccaatcccgattaaaaaagtcgaataatcctcaaacccatacccgatcaacttagatattcttagtcaaagttgggacgaaaactcacaggtacgtttcattgtcatgcctatttattattttatagatttattaataacataattctaaattgagggaagaatcaaatcgaacaaaatttaaaagataaaaaaccaaattaaatctaaatgataattttattaaattttataagattaccatgaaagagtcagacaagaagtaatacatattctcttaccccattttttacacggcaagacaatttgtacaatactatgctaaggtagagtagtaggacaagtgatttatgatggatcatatattttgtttataatcatctccgtaaaaaatctgatcatttttagtagattttttccatccaatcataaaatttgaacccaaaacctcatcacacctacttaaacctgtctgacatatttctctttttatctccttttatttcattttttatatttattttttattaaccaggtaaaattgggtattataaaaaacacgacgaaacctatatatttctcaataaacaaaatgttggacatagacaagaaaagataatggtaaacacgtacgtaccccaaaagcaaatagcaaaatacttgaattttatttttattaatcactctccagcaaagaagatgcaaaaccactacgagaccatagattgaaggtgcaactatgccttaaaaaagtctccctgtggcaaagaatgcaagatagctaaggaaatctgtttggtggtcaaaatcagaaatcttacgcgtgacaatatgtgcagcactcaagtctgcctgacataatttaggtccatcaccagcaatagcggccaaatagttagcaattcgaggatcgtctttcaacttaatcaaagaattactaaacgattcaaccgtacttttatagtgattttcacaacttacaatggtattctttaattcgttaacatacttttcaccctcttttcccttcgtcaatcccaactccaagattgcctctgcaagttcaaaaaaattttttgcactcaggactttaggttctgctcctagaacattcatgcactcaatctttttctctgggttttcattgcaaagttgaccaataaggtcggaatcatcatcaagcactctagcatttgttagcgaaggagagtgagcaatgaggaagaagcaaagggtgagcaacagggaacacagtgctaaagaattcatcttctggtagggagttgttttaggttgcattgggtggggagtaaattaagtttccaaggtgttgccttcttttatagtattgctgctaacattcccacattcaatgcattatattatatatattataatcattaaattattaagatttttataagattggtgggatcaaaatgacgatgatttaactctaaaaatgttacacgaaattcaaatcgttaatagaaaatgatcttacgttttatattatatataaatatatattaattattcaaaaatatatagtaattttagcaaattttgtgacaaatcaaataattaattttaaaatcatttgatttggcttaaatcattaaaatatctatctctttttttaagaaaaatttagtctttaaaaattacaccgatatatttatcttttttataatattatattttaaagatataaataaaatatctaaagcatttattactcagaatccaaatatttattgttttatcatgtaagcaattaaaaatgagatttagatagatgtttgactactattaaaagaaaagagaatgtatttgactcttgagcttgtctttttacttaaaatataatattcaggaaaatattattactttattcatccttaaataaagaatatttcgttacattttactctatttgtaatattcaaggaaatattcttaaaatactttttttgaatgcataatttctaatccttgaaataaggaaatactttctaatcattaaattatattaacatctttataatattatactttaaagctataaataaaatatctcaaggcattcgtatttattattttagaatgcaaatatttaatgtgttttcctttagtttaaccgttgtttttagtttaacttttttttacttacaaaagagaaactgagtgaagcaattttcttaatattatttaatcataattataaatatataattgtgtatgaaaaaattgctgatttttaccataattatttcaaaaattatatttaaaatcattgaactaattgataatgtactaaaattatttgaattattgaaaaagtatttttggagtattataaaatgttttatttaaaataagtcacaatttgtttgttttttcttcttatgggattcacatttattttcccgacacgattcatggaatcatggcccgattcattttgttttatatattttggtagcaagctatcatcataaatttaccaattacttacaagatataattatattttgttataattctttgaatgataatattatggaaccctgcaatgacactaatgttatcatcttaattacctatactcaaaatctatagtttaacaaatctataatatctctttaattttttttagtatacataattaaggtggaagtaaaaactgaataaaataatataaattaaggaagcaatgaagcaagtaaagaactatgtcttcgccagaggatatccttaaccaagagaaaaaaccacatcaagattactatatatgtgaatgttattagtttgtttttattttgtactctttattataaatcatacacttatcagttgttttagaacaattcaatcataacatgattaaaatataaattaagatgttaaaattaaaatcatatatatagtaaaatcgttatcaataacacttataatatgaatctaaataatttgtttataagttcttgtaaatgaaatttagatcaaaaagttttgtgaacttttaagataatcatgtttaattatgacccattattatatatctttgatatgttataataaaagtcctgtcaattgatatgtccttttacaccagttaggactctcttgttttcttttcctccatttcatatgttttttggtaaataaataaaaggaagataatacactcattataaagtctaacatatctttttacttaaaatataatattcaggaaaatattcttactttattcattaacaaatccttaagtaaggtatattttgttacattttactatatttataatattcaatttcaaggaaacattcttaaattatttttttgaatgcatattttctaatccttgaactaaggaaatattttctaatcattaaattatattcatatcttcgtaatattatactttaaagctacagatgaaattaaatatctcaaggctttcgtatttattattttagaatgcaaatatttaatgtgttttcctatagttttttagtttaactttttttacttacaaaagaaaaacagctgagtgaaacaattttcttaatagtatttaatcataattcataaataattgtgtatgataaaattgctgatttttgtcataactatttcaaaattatatatattcaaaatcatttaattgattgataatgtactaaaattatttgaattatttaaaaaatatttttggagtattataatgttttatttaaaataattcacagtttgttgggttttcttttctgggttttacatttatttacctgacatggctcatggcctgattcattttgttttatatttttttggtaacaagctatcatcataactttaccaattacttacaagatataattatattttgttataattctttgaatgataagattatggaatcatgcaataacactaatgttatcatcttaattacctatactcaaaatttatagtaatcaataaattataatacctctttaaaaaaatttaatatacataaggtggacataaaaactgaataaaataatataaattaagaaatcaactaagcaagtaaattaaataactatgtctttgctttgtcagaggatatccttaacaaagagaaaaaccacatcaagattacaatgcgaatgctattagtctgtttttattttttgctataagtgttaaaaaaaatcatatacttatcagtagttttaaaacaattcaaatatttaataatcataacatgattaaaatataaattaagatgttaaattaaaatcgtatatatagtaaaatcatgatcaatcagcttaaaaatttacaattcacttgtataaataaataatataagtatatgaaaaatcaaatagaaacaaaaaaaaaaacagcatttaaagatcgatgcttaacttgaaaaataaatatgtaaaaacagataacatgtataaaataaatacatttatgcctctataaatgtgtctaacatgattcataggtgtgcttccaataagctgctcctatgctactctagtaaattattttaaaattttatgaaaaaaagttaagaaatatcttagaccaattggaagatatttttataagttttttaaaatactctcacaaacactttttaatatgaatctaaatgaaaatataggttaaaaaaaagtcatgtgaccttctaaaatagtcatgtgtaattgtgatttgtgatccatttttatatatcttgatatgttttcataaaagttctttcactagatatgtctttttattagttaggattctcttgttttcttttccaccatttcataagttttttggtaaataaataaatgaaagataattcacccattataaagactaacatatattttcttaaaaacttgtatatttatgtatatatatttatagatgtagagaaaaaaaatagagaaaatccgttaatccttttatgtatagaaagagagaggatgtatcaaatgagaacacttcatattatgaaaataaaaattccaaatattgatatatatatatatatatatatatatatatatatatatttaagtggtgaagattaaaaaactgcacatgattttttaagtggttttgtgaccacaaattgaattataaatttggccatttatatttggttgagtaatatatatttatgcttttcaaattattaaaatgagagctatttttatttgatacgctgccatttgtgtgttcttgcaactatgaactataaggagcttaacagaaaataatgatgtgtggttaattagaggcttgttctaaataattaagaatttaagttgaatgataacattggagtcaaaattggtgaattattttaattaaatcttatatggaaataggtccattaaaaaaattgggttgttgagtaggaaatgcttttaataatctactgaaaatcatactctagttatagatgggcaccctaacattaggcatatgcaaaatagtctgcgctttcatcaacacgatggtacgatacgacgaacagagcacattcatctaaactataaaaaaaataaaaaatcaatgaggcaattaacattaaacatttaatttactactactataataataataataataataataataataataataataataataataatatactaaatcaacaaaatagaataatatatatatatatatatatataatcacgtttcttcttaacttagcttcttttttaagatgaaaaataataaatcaacaaaatagaataataatagagatttacttaaaaatttctaaataatccaaagaccaactagtaatttaattattgaactagttaaaacgtatggcaaactttaccgcacgtgaaaaatgtagaaaaaattaatgaataaataattggacccgagctcaattaattaatttaaaccaatgccgtgcccctacgtgtaaggaatccaaatataaacatcaattaatttaaatattttcttaattctggtgaattaaataattgaatcatataaataagaataaaattagtacttactatggacccatttataaacaaaaaattatcttatataatagacttaaatataagtaaatttaattaattttattatatttaatattattattctaaaacatgctttatttaattttaattttatttttgatgactctttttatgatgtaaactaatttttttaattaatataaaattaattattttaacttatatacgagttaaaaaattattatttaaaatatttaatttaattgagagtgttaaatttctcttaaattattttttaacttctctggtgataaaaacttacaaacatcaatcagttatatgtatattttttctcacttttacatcattcaagcattgattttaattaagaatattttgtgaaaaacaattaatgcaagtaacatattagattggatcttttaaaaatgatttaatttagactttataataaaaattagctagaggtagtattatttaaacataaattattataaatttatcaattttataatattattttaaatatcatataaatattgatttttgattagttggtccattcgataaattttatatatacgatattgtttttctttttgtaatataatgatgattttacacactcacacacacacacacacatataaccccagacccagacccacaccatacgtatgatactctttttcccattagatttttaatatcacgttaattaaaattacctttaattttttcctcatgaaattagccgaggaaaaggtgaggaaacatatcctttcagctttgggttaaaagaaagtgaaatattgaattaatcacactttaataactcccttctgtttcttctatatatatatatatatatgatgagtgtgtgatcccaactccacaattgtaagcatatataatttaatcatccattgaagtggttagtgtgagtgtgaggatgcagggtattagattagtgttttcaataatgttggtggttgctggcattgtaggtgtgccacgcatatatcggctcaactctgcaatggtaattttttagatattcaacgggaatgcgagaggtactatgaacccgaagggccaattatggatccatctccagcctgctgcaacaccctgaaaaatgttgatatcccctgcatgtgcagaatggctggcaattttcagtcagaattcagcggggaaaaagttgtctatgtcctcaggtattgtggaagaacagttcctgccggactccgctgcggaagtatgtatatatctatctatctctcttttcttaattaattcttcaaaaatactagctagtatctttattgtattagttcaagaattaaacaaatatatttttattgcaatgtataaaatatttttatgattttttatgctcttttatgaactttttaataaatattttttctttcaattttttaatcattgttctaacaacacctttagttcttatgcatgtatgtcacgtaccttctcctagctatttgacttcatgcacgtaacaaatttcaccttaaacatacatacaactttttaggctttattagtatgcacttcttcttgtgatattttgatccttcattaactataccgatgatgtgacaacgcctgaaattgatatgaggctgatgttattaaatgcttaattatatgtttgtaatttgtaacatgacatgtaaaaaaataagaggataattttttttttcaaaatatccaagatgagtttagaattatccccaaccctaagctccaatagtacgtaataccaaactactaaactaatattttttttttaatatatagatgagagtactttaaatgaaatcaagtttgcacatatatttattgttactaaacaaaaatgttatatatactaaatatattagtattatattagacatttattaataaattaataaatataaatatattgaatgcaaatataaatacgtcaatagaagattaatcaaagatattattattaatactagaaattatataattgtatatagttatatatataagtaatatatgtgcgattttgatttttattgaaggtatatgtgtatttatataactttcatttatatatgaaaaaatctattaatttattgtggtaagtattattttttttggaattttgattgagagttataatctttatccttttcattttgtcagttttttttatattttcacacatcacatcatcataccatgttatcaattatcatgtcaaaattgagaaatcaaatcacataattataatatttgagataaaaatgtatttaaatctaaattttaactggctccaacaaaagaaattgactattccatcacaaatttacaatcatatttaatttttaaagtaattattataaatattaataatttaatcatattcgacaatttatgttaatcgaatgatggcataattttttttacttcttataatatatacccagatcataaacaacaatattctcggcttattttcaaagctttgcagtatgcaagctaatttcttgttttttattattattgagacgactaatactattaagccatgtttttcagtttacactgctacttctcgtctggtgtgaacgtcaacattgaagacgtatgcatacaacttcccttacctcgggatccataaataactagataagccaaacatggcctgcatgcgtcattgcgtcctatatattatgtttttctttttcggtttataataaataaatatatttcactggtttatgtatgacaccgagttcaatgttaattcagatagcagtgatatatcatcccatgatgtttaattttctttgaaattattatataaaaaataaattgaatatttaatacaattctatttaattaacattagcatcatttttaatcgaagttaattgggtcagtagtagatgaatctaatgatagataaaaataagataaaaaagaaaaaaaaaagaggagaaaaaagtgtaaataagataaaaaaaaaaataaaataaaatagaagtaaaaagagacaaggaaaatttaagataaaaaaatatacaatactaatgtatttaacctttcaccaaactaattactttttttaatttcattttaagacatatcattcatcaatctatatcacattccattaatttattcagataataattactcagagaatgttaatgtatggagtattttaaaatattgatcttatccaaatatttgtttcaaggagctagatattcttgttatatactaaatgttttctaagttatttattaaaagaactttttttctctcatgtataaatccaacatctgcactacttttcaatttgcacaccgagactaagctcatgcaacccttcaccctaatttctatcagcaccaatagatattaaatatataaaaccgaaaataaattaaataacaaccaaagaggttaattgtttatccaagattcttttttcttatcactttattcaagattcttaaaatttctcctttcgtgtttaattataagatactttttaaaattttatttgtctagatatatttattatttcaagatatatttactattttcatgagatccttttctaatttcaagatatatttattattttttctttacatactttttatttaattattctcttttcaaacattaataaaaataattaagtagataaaaaataagaaaaaaataaatttaaaatgataataaaagtataattgacacgattaactactttttctaatgaatataatctagttgaaatcatcttataattagtaatggaggaaatatattcattgcctttacttttgttaaggttaacttgccgaagtctttgtttcattttttctcccattttctttttcatccacaggaaataattataaaaggtacgattttttactgttaaattgatcatattcgcctcatgtattcttggacacaaacccaattacgtacatctcatatccttacacataaccaataataaacttacaattagttaataaaataaaaacaaataatttcaacctgtaaaataaaaaaacactaatattttcaataaataaataaatgaaacccacaattttctcttgatatttttcttccgtaaccgtcttcttcatcttatttatgtattaatactttattacatttatattcataatattcaccatagcaatggagtattggccggctaatataggctatatatatgttatatggaacagtgaaggctttatgcctaattggaattccctatctaaagattaaatggtagtacgtagattattaatttgtctatgaaatgtaaatgatggccatcgttgcaaatggcgtagcgataaatttatatattgctattagcgtttttgagaaacgaaagttgttttcagggatttatgattcagagacaatggttaatcgcagaatcatcgataattttcaaaacatgcagtacacgtttaacgttttcttattggggtaatacggcgcgtcaaagtatttatgactgaaattttatttctctcatccaaggaggacggttaatctttagtggtagatcttaaattaagattttagattactttttagtggactctatagtactacataggattaaagatctctcaagatctctctaattttttctttaatagtaaatctcattttgagatattagggagagagaaagagagaaaatttattcttttttaaacaatgtgcagatcttgaaaaattttgtacaagaacccattctccatattggagatctctctacttcctttattgggagatcttgtgaagatcagatcttgaactcaagatctttgcttaagatctaccactaaagatgttaaggcgctcatgtaagttaagtgatgatatagacaaattttttgggtttgtgcataaactagaaacttgtgtattaaattatctagtatttttttggaataattgaaaaaatatgtatatcaaagtaaactttgtaacgaaattatatagatttaacttaaaattattattcatacaaattatactcagttcaaagatacacataatttaatcaaataatttcatgcatgtaatagtaattaattgtgataaatattgggactaattttttttatgtgaataatagaggggcatagggattagagtaataaggaggtcatagtttcatggtttcaaatcattctactaatataacatattaattattatcatttatcgattaaaaaattacctgcagtacatacgttgctttaaatccaaagattggaaattaattgtgcgctaagtatcttatttgagtttttgaatttaccgtaattaaagattaaatgtgcattctaattctatgtttattattctctttttagttattgttgctcctgttcctaatttcactactcaaattaataaaatcccaaaattgcatgtacaaattttaatgtttggaaggagtctcttgagattgttctcaattgcatgaaattaattgtatgactctacccattttaactataaaaggtatatctaataaggctttttttatgactctagctagatcaaactaagtcaatattttgtgatgctagaaccaactaaaccattctttattatgactttgaatcaaactaagtcgttcacaaaataaaattaataaaaaaaagcgagactcaaattccaaaattgcatgtacaaattgtaaagtttggaagggatcagttgagattgttttcaattgcatgaaattagacaaatcaacccattctaactatgaaaaactcaaatagaaatttattttcatgatgttaaatcaaatcatgtcatttgtaatgttagatcaaattaggtcattattttttcttatgacactctgaataaaatcaagtcattcaaaaaataaaagaagcaagacacttgaggatattgtgaaaggttgttctcgttcgaaaaaaatataaaagagcaagatgaggaatttatttgtgcacatgtaaaaaggttgacatttttcccaagtacaccaactagcgtgtgaagaaggatcaactctttatttttgtttgttatgaaattaattagtttatatacccaaggacaataatgggtagattcttgtggtaatgtgtatataaggttacttgtgaaatcatgtataaacgataaagtttggaagaaatcagttgaaattgttttcaattacatgaaattagacaaattaacccattctaactatgaaaaattcaaataaaacttaatttttcctgatgttctatcaaatcatgtcattttttttttgtaatcctagatcaaattaagccattttttcttatgacattctgaatcaaaccagatcattcaaaaaataaaaaaaacaaaagacacttgagaatattttgaaagattgttcttgttcaaaaaaaaatataaattcgagttcaaaatatttccatattattttataatttatataaaaaatgccagttgacgtctatttaaagtattatcaatatatataattattggaatatatatatcaacattcatgatcttatatatatataaatcatgaatgttgatatatattccaataattatatatttacaaatatatatcttatagcttactttatttaaatgtgtgtatgcaagaaatattagtttaattttatcaatatagttatgcattcaaaatatatatatatatatatatatatatgtatgtataaaagagtaagatgaggaatttatttgttgcaccagtaaaaaggttaattagtaccaaggattgtactaagtacaccaactagtatgtgaagaaaggtacgttctttattttgttagttatgaaattaattagtttgtatacccaaggaaaataatgggtagatttttgtgttactatataaataaggaggttgcttatggagtcatttgtcaaaagttgaaagagattcattgatgtgagcgatggcagtaaagatttaataaaaactataagaacttttaagttactttttttaaaaaaaattatatatatatatatatataaatattacacatataactatatttattttttgaatgcataactatattgataaaaactaatatttcttgcatacacacatttaaataaagtaagctatataagatatatatttgtagatatataattatttgaatatatatcaacattcatgatcgtatatatatattttgataattctttaaatagacatcaactagcattttctatacaaattataaaataatatagaaattattcaacccgaagctcaattaaagaagtttaaaccatatgccgtgcccgtgcaaggaattcaaattcaaacatgggtgtcttaattaaaatgtgacttcaataaaataaaggttaatatataattttggtatctttataatttgtgatttttattttttattttttttgcttatttaaatatcaagcaataaactttaaaaatactttgttttatttatttaaatatataaatactattttacatgtatcattaatgaagagttattaatttttttgaattataattttttaaattaaaataaaatatttaatatttaaatacatcatgcatttaatttcatatgtctttacttataataaaatttattttaatataaattaataaattataatatataaaaatttgttcttatttaattataattttaaaacaattacacaaactaatgtatggattattcaaaaaaaattattttatgtaatttataaaaattttgtaaatttaaaataatctaaaaattaagattaaaaatgtattacttttataattaaaataaaaacttgtttttatttatatataaaaatgaattctcatgatttttctgtataaaataatttatgtaaataatttacttattaatttatgtaattttattaatttatataattggtagtaaaaaattattaactaaataatttttatagttaaaataaaaatattaatatgtaagtttcctaaaaaattaaatattaaaattttaatcatttatataattagaataaaaataatttacatattaaaataaatttatgtgagttgtataatttacatattaattgatttaattatatcaatttatataattagaataaaaataatttttattaaaacaaatttacaaaataatttgtatattaatttatgaaatttaattataaattggtaaaattaaaattaaaatatttaaattattcaaaataaaaaatataaaatgaattaaaataaaattaaaaatatttatatattaaatattttaattcataaattatcttaattcaaaaaattaatatctcttaactaattatgggaaaatagtgtttataaaattaaactaaataaaacaaatattttaatgatttaataccttatatttaaaataaaaggttataagtttaatttctgtcaaaatcttttttatttttattttatttaattgtttatcacataattatgtcaattatttacataaacatcacctaaacatcaatataacacatcaaaatcaatgtttgatttagatgattaattaacgatcaatttggtggaaagactaaaattacttattttaaagaataaaaaattaaatgtcttgatttaaagataaaaaaactaaaatcaagaattttaaattataccatatcaaaataattggtgatttgtcaataaagacaataagaaacccgatgtaaaatattggcaaaaaaattaaattattgcagtttaaataagaatttacgtaaacactgtgcttccaaaacaaattacaaaactatagcagttcttcacgtggtagcagggcgtgttgaatcacgtccaccatggacgtgattcaaacacgtcgtaccagggcgcaattgaggtcggggacacgtctaagcaaggcgcgactgggtcctaaacacgtcctgcatggacgtgatctagcttctaagggcgtcatccaaagctgtgtgcatggctcgtgaatttgtacgtaaagtgccgaggtgctgcggtccatataaacagaattgcagaggtgaacaggtgtagtagtgagtgatgatgtagctgaaagtgccgagtaccgagataagtgtgtaacccgaaatgaggaagtgccgagatgtcagaactgtgggtttcgtcgagttgcatgggtgccggggtatgcccatggccggtttcacataggagttgaggtatagtcgaactcggacctgccgaggtgattacatgggtgccgggtacagcatacgagatagccggccatgcatgcatggttgccgagatggctttgcatgctacgtgaaattgtccgatgtgcagggatgggtaactgttcttgtaaaggtgccgggttggtgagtataactgaaccggcataggtgccgagctaaagctataaagtttgcaggggtgccgggatgagtgcaggccgggataggtgcaggccgggatagcttgcaagtggcattccggcagtgccgaggtggttgtggacggacttgtagaggtgttgttggagttacaaggtggccgagataacagatggctactggtataaccgggcttcatgggtgccggggtgtgtctcggttttgtatgattaccagtatatataaagatttggtggttgttggcaacgtgtgctcacactgttgagagctctaaagaaacttcttcattctatactttgtggaggcttgcagctgatttttgtctgactaaaattagtcacaaacagcttcaatcaaagtgcacaacttgactttcatttcattctctagctaagagaatggatatgcttcatcagcatgtttggcttggcatcaagtctcgcaaaatccacattgaagtctcacatcaatataaaagctactctatatatagcttcagattttcccgttgctttttggttctgctgaactaaacatgcactccatgcccaaggtgctgggtgaaatgtgactttaacatcaggaacatcttgttatcatcaatgtacaaaaatttaaattacaataaaaataaatcaaattggtaactttgttatatctttgtatttcacgttgaccacattatctataattattatttcaatttctgtcttaatgtaaagactttttcccatatttttaaatctattttcactatatttaaacacaaaaaattaacaaaactttttcatgtacaaaatttgaaataattctaaaaaatgaagttaaattttttttttaatttgtttccatattatatttattttaaattattatattttaatacaaaatattaactcttataacttaatttaaatgaaatgattttttgacccaacttaaagatcttttttcgaaattgttatttgtttttattatatttggacacggaattataatttttgattcatatgcactaacatttttattgtattaaatatatatatatatatatatatatatatataaaagtgttattactgtggttttaatgaaatttaagcttcatacatgcagacgtgtcagcgttcagcatgcagtcatgcagcatgcacctcaaaagtcgaatgctatttgcattgaaggaatggactataaagttataatcttcgccctagcagtgatcaaattgaatgtagcttcccaaatataattaccaatttaccacggtagattcgaaattgtttacaacgattggtatctttaattcgattgtttgggagcaaaatgatgaaattgtatatggtggttcctaccaacttttgtaattttatataccagacaaaagaatgttatggtccgtgtatctgtctaatgtacaaggaagagcacaaaattccactgtacatgcgccaaggttcctgctgctgatactttgagcactgcatgaagggtacaactacaagcaacacaaatccaactacgaaaatttttcatgcaaataaattaacaggcacaacgttacactttcctacttaaaccaaaaaaattctcaaacatcctaatagcctatggaacccaaactcaatcaagattgggtaaagacagcctcacagtgaaaactcatgaattaactggaatgcagaaggaggagctgagaggcggtggcaaaacacaaaccagatgtggcccagcctatgccggttcagttatactcaccaacccggcacctttacaagaacagttacccatccctgcacttcggacaatttcacgtagcatgcaaagccatctcggcaaccatgcatgcatggccggctatctcgtatgctgtacccggcacccatgtaatcacctcggcaggtccgagttcgactatacctcaactcctatgtgaaaccggccatgggcataccccggcacccatgcaactcgacgaaacccacagttctgacatctcggcacttcctcatttcgggttacacacttatctcggtactcggcactttcagctacatcatcactcactactacacctgttcacctctgcaattctgtttatatggaccgcaacacctcggcactttacgtacaaattcacgagccatgcacacagctttggatgacgcccttagaagctagatcacgtccatgcaggacgtgtttaggacccagtcgcgccttgcctagacgtgtccccgacctcaattgcgccctggtgcgacgtgtttgaattacgtccatggtggacgtgattcaacacgccctgctaccacgtgaaggactgctatagttttgtaatttgttttggaagcacagtgtttacgtaaattcttatttaaactgcaataatttaatttttttgccgtaaaatattgttttcattagagctataaaactcatatccataatttatagtaataaagtgacataacttttcatagaaactttgtagttgaatacaaacttttttttcacctcataaagtagtagataaatgagaattacttctaattccaacatgatgaaaaaaagtaaaatgttttacgaaatatttttatttgactactatgcattgctataatttgtattctctagtaactttattacaatttattctaatatatatatatatatatatataatataagtatatgttattttatcacgttacctttttttcttcataaaattggccgtcgaaaaggtgagaaagaaagggagtaaaaagaatcccaaattgaaacgtatcgggtcaggtatggttaaaaagaaagtcaactatttaattaatcacattttaataaccataaggaaatgaacttggagtttggttaacgccacaagttattttattttattaaaaaatggcttccttttgtttcttgtataaatacgtgatgtcaattgtagggttgttagcataataagttgattttggattagaaagaagttgaaattaagtgtgaggatgggaattagagggagcttagtgtttgcagtgttggtgcttggtggcatctcagctgaaacagaaactgaacgcatgttattaggatcaccgacaccatttgaatgcggtgataatatggcaattggattcaattgtgtcaggtttgtgtcacacattgggccaagccctagaaggtgctgacattccctgcctatgccaatattttactatgctcttttcttcagcattgaaaaaggtgtctatgtgctcaataactgtagaatcccagttccacccggaaccccctgccgaagtaagttttctatcatccatactccttagtccttactctgctttcttaattagtaatatagaaaattctattaacttagaaaaggtgcatgcatgcgttaaaagaattaattaatatattcaacaagtcttttgaacaatattcttcaacggaatgcacccagcagcagtggcggaactaggaattttattgagagggggcgaacataaaaaaaattatatcataaataaaaatgcttcgaaaacaatacaaaactaatattaaaaaaaactattacagaaattaaaatcactttacttgattcttaccctacgtgttttcatattattaaaatatctataattgaatccgtgctaaaactcaataagagggtaaatgatggactttccagttcttgctagcccttgacataattcaaatgtagttgataaattaatcaaatatgaatgtttagtaatattaagctcaaaatgttgtaactccatcttcaaataaatctctagaataaaatttatcaacaagtttgcaaatatcatcagtgttaaatgacttgtacttgtttcttggatctaaagacatgctcaaagcaagtaattcaacagtattatcattgaacatgctatttattttttgtaattgataatcaattgtagcacaaaagatatttatcctataaaatttttcagtagaaaaatcaccttgttcatttcgagcacgacctctccttccaacatattgatagagtattttattttattttagaaacaaggggctcaaataacagcttattttattttagaagaataacaacaggaagaagaaagagaaaaagagaaaaaaagaaagaaagaaggagatacctgaaactcttttctttcactaatttaccaaatgaaacaacttttttgactccttctgttctattgggatttgtatttcttttttctcctttgtctttacatctctccattttatagtgttctttctccctctttctctttattattttcctttttattattattttttttcgttttatcatcttcctttcctttttttctttttctgttatcttttttttttcgttttattttattacattttctttcctttcttatatatatatatatatatatatatattttcctcttttatgttttttttcctttttatgattttaatatttttctttttttactacgttttctttatatatttttctttccctttttatttttttaatattttttctttttttctttttttttctttcatttttcttttttttattaatttttttggggaggcgggggcccaccctagcccccctagttccgcctctgcccagcaggacgacctattaggttagtgatagagcacgcctgcccctgataactgtgtcattggatagatagtttaatgtgctcaccgacactatcatgagatgtgaatcatccatgacacattagtacttctcctgattgaactttcaatgatttggtgtatggaagcttatttcctgaatttttgttttttttgtttttggtattgagaggactcatactatgaagccgtgcttttcaggatacacttttcctcctgctcctgctcctcctcgtccggagtgaacgacaacatggaagacgttcccttgggatccctaactcacttaataagtccaacatgcatggcctgcatgccgcatgcgtcattgcgtttcactatttttctttttaatggtttttaattatatttcactggtttatgttagatcctgagttcaacgttaattgagacaacagtgatttataacaacagtgatttatatttcactggtttgtaatgatactcgtgttgctcatattcggtacactggtgcctttcttctaataataattttcgcttataaaaaaacattttagggtaaatagtcattttcgtccctgaatgtgtaaggcgctgacaaatttatccctgaaagatggaaattcaaatttttgtccctgaaagtgaaaaaagtgtgacaaatatatccctccgttaactttcatccgttaccgttaatatcagggacgaatttgtcagcgcactacacattcaaggacgaatttgtcagctatttacctaaaatataatttaatcttcatattatctcttttttaattattgcaagcataacattacaataaacacttaaaaattaggaaaacaagcataaattaaaacaaacataataataagtataatttgtttgttgttctgaaatttctattataacaacattagataatgacaaaatcaaactgagtcttattttttttaagaattaatttaatgactgtgcattttaatttgtttgagtctcatattttgggtaagtattatctcatatttttgctttgaaatttctaatgtgacagtactttataaaaaatatgagatccaaacaaaaatacacaatcattaaattaattcttacaaaaaaatgagacctaatttgattttgtcattacctaatattattataatagaaatttcgaaataacaaacaaattatgcttattaattaatattatgcttattattatgtttgtttttacttataatgtttacccaaaatatgaggctcgaacaaattaaaatgcacagtcattaaattaatcattacaaaaaatgagactcaacttgattttattattatctaaaattattataatagaaattttagaacaacaatcaaattatgtttattaatcaatattatacttattattatgcttgttttaacttatgtttgttttcctaatttttaagtgtttattgtaatgttatgcttgtaataattaaaaaagagataatatgaagattaaattatattttggatagagagctgacaaattcatccctaaatgtgtagtgcactgacaaattcgtccctgatattaacggtaacggacgaaagttaacggagggatatatttgtcacacttttttcactttcagggacaaaaatttgaatttccatttttcagggacagatttgtcagcgccttacacattcagggataaaaatggctatttacccaacattttatttaataattcggacaattacttagacaatgttacttttaaaggaggattttaaaatattaatctaatcgaaatacttgtttttaaggaactcttcgtgttgcagagtatttaaaaagaaaacatttttcatctatatatcaaacaaaagttaattaaatcaattccatgttcggataaatctaaactcaaagtgaattttttaaagaaaaaaaactcaatataaaggcataaaatatcctaaaaatttaaagaacacaatatttcttaatcttgttttgttcaaaaagtacatgagactttataagggagataaaaagagctaggcgaaaaaaaaattgaacagtctgcttggaaaattaatttaatgtattcaaaattaatgtcttgccacttaactaattcatcttagcggaggagaaaacattcctaatttaaatatttgaaagataaacaaatagtataatacaataatataagattacttttgtacgtattctcattactttttattctatgtttggtaagaataaaagtagaaagtttttttgtttttgtttttgttgaatgaataaaaatagaaagagtggaaaaaagaaaaaagaaagaaagaaaaagatgcatgcttcttttgtttgattgttccgtacgagtagaagaaattaaccattagttttgatagcccgtgttaaaaggtctttatgctcaatttaggagaaatgtaggaggtagaacacgaatttggaataaaaatttgtttcaaaataaattttattttaattttttaatgtaatattaattattattatttttatttatatcctttataatattaataatggacaataaaaattataaatgaagtaataataatataaggttaattttataaattattattctcttttaattatttattattttttattgatctacttaaaatataagactataattattttggaatggaagagagtaatgtattcctttcttattatcaaagtcaaatatttagttaacgctcttgctaaaaatctgttacacgtataaatataaatatgtcaatcacatattattagtgtctaatgaaatttaccaataaaaatatcttttttatttttatcaagatcaaattaacataatttttttaaaaaaacaaaattaatatcatattttatcgtaacctcaaatatattgtatcctttattatattatacattagaaaatgtacacaatttttaatgtacttattactttttgtcttctaaaaaaacttcctcgcatggttatccgacagttgacacattctataactgtaaagtgtaaactctgaaacttgggaccaccagaaaattactgaaattgttacattttgattttaaaataaacacttaaaaagacaatatctatattttatccgatcaacaggctctgtgtcgtgtctgtctgctgtgagtgctgagagacaatggaggtgtgcactcaaaccttcacaaatttccttcttttcaacccttcttcctcttcaaactctcttcttcttcgtgctaatgccaacactaaaacacccttcaaattcaattcccttaaactctcatctttttcgcctcatattcacctcttccaacccttcctctctcctcacacttcttctcccttcacactctcagctgctgcttcttcttcttcttcagtttcagttggcacagaacaggaccgtcttccagcagaattgaaggtcactgaaacagcggaacccaattccagagtatgttctttttttttttttttcctttatctttatttctcagtttggttcaactcaacaatcatatgtgaatcatatgtagtttgctatataatttataaagggtgatgataattgtgaaatatatgccaggtgtatttttctcttcaacatgaccatatcttgttacttaaacaataggagaagattcaaattccatgcaagcattattaatcaattgcaaaagaaagccttaaaaataagataatggtaagcaagtgagcacatattctggaccagaattcatatcactgaatatgtacttttgcatctctttccctttgcaggttagattgcatgtggacgtgccatcattggtatgtgaggattgttacaagagggtcatagcagagtttatgaagcaagcaaaggtgctatggggttacacttatgctttatataattatataatgtaatgtctttcttatattctggctcaaagaaaatatatgcatcaaattattgttgtctgtgaatacggtgcactttattttgtctgtcaagactcaagaggattcccagtttctaaatttgaaactataactaaaacctctcattgaaaatttcggattactaaacctcacaatcttaagggatgtgctctatcctatcatatatgaatttacttgagattgtcatggatcccaggtttcagcatccaaaggactgcatgttatctttatgagctaatttacgattgttttaagtcaacagatccctggatttcgccctggaaagaaagttccagaaagcattcttattagttatgttgggagtcaaaatgttcagaaggctactattgaatctatattgaggaggacactctcacatgctatggcatcggtatgttacaatatagtttctattttcttattttttatgtccttatttttttctcttgatgttagttctttttacacttttggattcattgtgtttacttgcaattatatctgttaataattctctgatcttgaaattttacttcattattgaaagacaagcttattggttcatgacctttcctcattacctaagtctatttaacagtgctatctaatagtgcatttatttaaaatctgtgccactgaaatgcctttgatctgaggacttgatactgatcaacagattaaaaaaaatcgttataatttcctgatcatttctccaaggttattactgaataaagtggattattagatcaagtattattctgatcttacacttgagcatttcttaattaactttgtttataggttactggaagggctttgcaggactcagtacgaatagtgactaagttttctgagatggaggagacatattcttctcttgggtctcttaggtaatctataggttaagctttttgaaatatattttccattagagttgttatttttctcttcctttgctgcatctgtaatactaaaactatattctgacataatatagagaaaaggaagactatcattaagaatgctaatattgtcagaatgtcagccaaagccaacgacttctacatgcagattatattaactattctcacttatttaacttctccaatctccagatatgatgtccttgttgatattgcaccagaaatcaaatggattcccgataataatgaatacaaaaatttaaagattgttgttgagatagatagtgatatagatgctcacagagcatctgaacaagaatttagaagacgttataagtccattggtgcactgaaagtggttactgacagagggctacaggtgactaaatttaatttataccagtctgctggcatacaaccatttgcttttttatttttatttttttaatgattatttactagaaatgctattcatttgaaactctcatgaatcattttagtcataaaacttccaagttctttaaagcaagcacaaactatatagatttcatcatgtatgttttatatttagttgtgactgatacaatgaaggatatttactgattattttttatgttatctttactatctcatactaataaataactgtcatacagacacttttattatcttgataattaatatctgtattaataattttgactagtctacccaaaattagccagctgctacaatttttttgctgttcacaggttggagatgttgttgtcctcgacatctcagcaacaaccattgatcaagatgaatcaaatgttaaaagtattccttctgctgaaagtaaaggttgggtgatgtgcttgaaggatgataataaactgataagcgatacaagtctttttctttttgtagtacatcatgaacatatttcctctaaatctatattggatatgcaggctttaattttgatacagaatatggtgaaaaagtattaccaggtttccttgattctataattggaattcaacaaggtgaatcaaagtcttttcctcttgtatttcctgaaacatggaagcaagaaaatcttcgaggtgttcatgctcagtttactgtaagtttctaatgctgaatcaaagaagtttaattgttttagggacatgatctgacatgatagtttttttcttttggtcctttggataccaaattcttcataataaatactttttggccatatgtctcatgcaatttatggtgctttttcatctccttatgatagagttattgtcttcgatttataaaagagggggtaacactttattttcttacattagtatgtttatggtcctagctttgttgctccatcagattttaataccagcttttatctttgcatttacctccaagaaagaggatgaaagcaagaaatgaagctttacctttcttgttcagcttgtgtagtcgtgccccatcatacagtaaccgtgacctagctagaagtcttctagtgttttccatacatgatcctaaaatcaaaaatcaaatccctacagataaatataaaatgattgtgcaatgattcgagtagctgctgtattttattatgaaaaattctatttcttgtgatgatgcttttgcttggtaatataaaaataataataaagttataaatctttgtttgaatatctacttttctaataatctagatgatcttgagagtttcatccagtttgctagtcaagctagtaatccctttcagttcataaaccagattgtgcatatctcagcgactataggttggttgaggaaaggaagtgaagttttcacctatcctgtatatttttagaagtctgtaggcagaatagctgcccctaggcaaaagactccaaaatcagtgattcattagatagagaagttgtgaaaagtttttggcgtgaaactactcctctctagccaagcaccctttacctcaaacttgagaacaggcatctcagaaggaaagtttttgaactttcaggcaatgttgtctaaattgccttcttgctttccattggaggggataatttatccctctgccaaaattaaactatattttctctcaataggaataggattcaaactctggattttctaaatagtgtacacagtgctcaactcattttcatgaatacaacattaggtgcatgtttggatctcatcatttccttttagcttgcttaaacacacctttggctgcatatataactgatcttgattattgtaaataccttttattataacaggttgaatgcaaagaacttttttacagagatttaccagagctggatgattctattgctgataagcttctccctggatgcaccacagtggagcaggtgacttttttacccttaagtacgattgtcaagtaaattaaggaattattttttagttgactttagagtaaaattctctagcatgaatttccaggtcaaagacttgttgttacagaaatgtcaagaggtggagcaaacagctagagaacaagcaactgataatgctatcttagatcagatttctaaggtaacattacattaagtagatgtattggattgattttgtctcgtcttctagattagaacataccttgccacatgttttcaatatgcatgcttatacattgtgcataattatgtgcatctgacatggatacactagagttgttattatgattttctggtaggcatataatgattatcaaggacttcaattttctgtaataagatgacaagacctacctttccttatgaacctcatggttgattttgaatcataacgtatcttgtaaatcatctatgtcatatcaagtatggtggtaagtatatccttcgaaaaaatctgattctgacatttatgaaacaagttacctttaaatttggattccctctctttggccctttcctacaaataattcttttaatgaattttatgctgcaagaaaacattggagtatgtaaattttatcacaaaatatctgtgcatcttgtcattttcagatggtagaaattgatatacctcaatccttgtttgaggaacaaggaaggcagctttacggagccaacctattagaaatacaggtattggttgcaagttgcatcattttcaggccaatcaggcgacttagattccaaatttttacatttattcgtgatttaatgcaaaaaaagaaaaattaataataactcctctctcaggcaaaaatgaaactaaatgagcagcagctggcgactctgtcaagttcgaaggctgtgaacgaatttcttgagcatcagaaggaaaatataacaaatttgataaaacagagtctggcagttggtgatatatataggcgtgaaaatctgcaggtagcatgtttgattaagatacgtttccattctaaatatttgctcaggtcacgctgacaacaaaatctttcccacttataaaaagattacaagggtattagggccaccacaattctgtgattgagaaataatattttgctttgcacatatcacttgctttataaattataattaaactgcctaattggtgagtgttttttcttattggaatgatttgtgcatgtatgttttgtagtttgctactgaggaccttgtcaaagaggttgagaattccattgctgaattcaaacgtcaaaatcaagaatatgatgaggaacgggtgaagggacaggtttgtgccatacttctgagtttgttgactgttgtttattgttttggctgcttcattgtttcctatatgcatatacaacagtcaacaaactctctttcctaatttgtggtttgggccaaactctctttcctaattttgcggattaattgatctgatctttttttactttcgtgaaggttcaagaaatactagaaggagctaaagtgcttgaatggttgagagaacatgcaaaggttcagtatataactaagtgagggatgagcactagccaaaacaaatcaggaaaatgaaattgcatgttcatttgaatgtgtgttgtttcagcggatgtaaattgtgagaaaatttcttgattgaattttgaagaaagaatattaagaatagaataatgcattacaagtttgtatattgagactttgatgataaattaatagtagataacactaataaaaagcagtattgaaaaacaccaatatatttctcaatacaaatctgctttaaagtgtcaatgttaagccctaaaggaaaagaaggaatgtcacttgcaaggatcgctacactctacttaacatagttcagcagctaaaaagaggtctaaaaagattgtttactaatctccaccacttgttccaacagggtcttcttctacaaataaaacaccaactgaagcattctctattaattgtatagtgaacttatcataaatgcctttcttgcaatatcttcccgagttttgtgtagagagatagctgctcctctgaaccaaggttcctcattatctacataaataaaacacttgagcgttacacctatgggtaatgaccataatgaaatgtatccagtttgatttatgtgtgtaatattggaactgaaagaaaacagaatcctctaattttcacatgaatgaaagttagccaataaattgcttaaactagagactcacctgatccaataacatctcaactgaatagtcttggcctacaacaaatgattgatggtaaatgtagacgaaaacagccattaccatctgcagaggatgcatcacagtataaaacacaacagtcacagactcacaatagctgcagagttatttgtgtactttatggcatagaaagccgctcatgatttatggtgaaattgaaagcgctgagcattgaaacaaggtgtatatagcgatggcgtattggcgtataaattttattagtaatgaatcaatttcactttaacatgtcaagacaatgggatatcttagctcatcgataacaaaacggtagatataaaacagagaaaatacccccaaatacttaaagcaagatcaatcatagcagttactgattattgactaactataatgccataaaaaatttgaaaagtgtattctgaattaagtaatagcctattcagatataaaccaaggataattctagtacataaatatctatctatgagcaaacctggcagtccattctgtctgtaaatccaccatgtccaggtatactatcaccaaagtcctgtaatcattcaaagagatcaatgctattgctatgtttgggagtttcaaagtgaatggaaaaaggtgatggatgcaaaataaatgtctagtataaagagcaagaacatactttgattttaaaagctcttttgaagccactagcaaaaaaacctccaaatggtgctatgattgacgcaaatagtcccatccacaaggcatgccactgtactggcaaaactgctatctctttccatggaagctacaaaatgttgcaaaatgaaaaactttagtcttaaattcttaatcttaagcttagtggcaaaaatgctatctctttgtaattattaggatagatttaattttttggtacttacccaatgagaaatcagtcctggcaatggaatgtaatctggcttaaaaattgggtcagggtcacactgaagccaaccagttgataaatcctgaatttatttcaccatcattaggaacagcataaatatttcctcatagatgactgcacccaatcaagattgttaccttccttggacatgttagccactggaagcgacccaagaagtttgcaaactgcacaaacataagtgacatcatcatgcaaagcaaaaatactgaaaaatatcattaaatcaactgaaagtggaggttgtgagttaaacacaaggtgtaaattttgaaagctttttgggaattgggatggtagttgatgtcagtcatgtcactaactgatgtttaccgtaaatgcagcaatcatagtggcaacagacgctccaatgaaaccttcccatgttttctttggagaaagcttgatcagaggtgttctcccaaaatagaaaccgaaaaaatatgcaccaacatcattcatagcaatgaggattgcagggaaaagaaaccttgcatgattatattaatatgttaggttgtaactagaaaaaataaaatcaattaaagcatgaaaaacatagtggttggcaataccaaagcagttactcgtattagaacccagaatttccattgagtgaggatacacgcagatggtagttttgcaggaaagtgaacctctttgggagcaaaaacaatagacatattgtaaatttcatgaatcatgatgccatgtttataaagagtcccgttatttgtgttcttttcttcctcttctttaataatgagaaatctttgtacaagtcaatcaaaccacaaatttaatagaaacatttttaatatttttgagcaacaacatagttaattcaaagaccactaaaattccacttattatatctgattatccttttactcatgtccataacaatatcaaagtcaacatataaaaaattgaacatatttttttcaatacattaaatgtatgcaaaaatataatttttccacaaccatacagtaagttggaatgaaaacaagaattagagaaaggcagaaagctaacagaaaaaaaaaaaagatgcaaattattaaaaagaatttgttaagagactatttcttgacttcttgtttattgatttaatgtatccttttctgtaagtaactatgttctacaattttctgatcaaatgtaaatgaagctagattgcgtagaatcatatttggaaagatgtttaagtaagctaaaatcacatataataggaaaaaataaaccaaaagaaggaattagatgatggagttttcatcatcaagtaatataacagaagtcatgtgttaccagaatatccctgcaaatatgttggctacagtgaacgcagactgggtaaacacaacaataagtatcatatgtgtccatgcatactggccaaactgatacttgtaatatctcttcttcaatgaaagaataaaccatacaaaacctgaaatcacagatgaaatgacttattcaagaatgaaagattatttttttgaaattacaggcagcaaacacttgaacctgcagaagactaggttaacaggatattagataaaattaagttacgtaacaggattgattcagatttatgacgaatatgcccaacaaagacaggacctaaaggtatctttattataattattcatgttttctctcttaccaaatttggtgacaattatgaataaaacatttggaagtactaacctgcaatatataaaaagtagcatataaccatctgatacttgatcaggttgctcacaaatctatacaagaatttatctgaagtcactgtattcacaagttgttgactgagaatacggccatatacgaatagcattgctgtgaagaaataatgcctggacattgcattcagaatcatatctttgtgaaacactatatattaaactaaacatttctcatatgcatataatcatttagaaattaccgtacatgaatgcttaccagttcaagagcttaaacttagggagacgtttatcttgagttgctcttctgagtagattgaagagctcactggccataaatatttggataaccacaaccatggcccagatgtaaagatgacccaagtatatgattagtgagacactcgctagcatccacagagatgagtatgcacggatccacattgatttgtatttggattcatcattgacaagcaaattgtttccatttgatttgcttatctctgcaggaatctgacacaaaaaccatcagtttcaaattctttaaaatgattttttcttcttctatttccccggcccattttctacagtatttgattaatgataaataatgtatacataagttaatgggaagttcatattcaataatgacttcatcaactacatgtaatgtatcttataagaaaaaaaaaatagcatttgaaatgccaaccaaatggatcaataataataagctttggaaacatataaagctagattaaattaggataccacaacaataaagtcttatcccactaagtgaggtcggttacatggattacatgatgtaattcgacacggttaaaaatcaaaattttataaatattattaagtttaagatcttttttgatgatttcctccaactttcttttcaatctccctcttctttttctcggactaaatatcatgaaaaattcgttcttctaactaacacctcttgtgaccttctttgtacatgccaaaccaccttaactgattttctatcatttttccccattggatactaaatcaatcttctctcgtataacatcattctgtattctatcttttcttatgtgaccacacatccatcttaatattctcatttttgctactttcatttttctctcatgtccctttaatacccaacattcactatcatatagtatagctggacatctaactatatgacaaaacttgcctttgattttggtaggtactttgcgatcacaaacaacctctaaaacttttctccatttaagccatcttgctaatgtaatatcctcattaatttcaccaccattttgtacgatagatcccaaatatttaaaattagaaacatatggtatgacatcctctcccaattttacttctgagccaaaatcctcgtgtctcttgctaaaattgtagtgcatatgctttgtcttcctcctactaagtgaaaatcctttgtttccaaagtctacctcaagcttattgttaactgttttccttgattcttcaatcaagattatatcatccacaaaaagcatgcaattagggataattttttgtatgtccttgataagcacatccaaaactatgttaaacaagaacttaaagctgagccgtgatataatcctaccccaataggaaagttcttggtttcatctcttggagttctcacactcgtaattatctcttcatacatgtcttgtatagctcggatataatatagataagaaatcatgtgtagaggagtgaataataattttgtgcatattgtcataatcaaatggtttctgaattgacagaatctatagataactggtcttgcagcagcataaattcactaaaaaacttgatatttgaaataaatgtatccccgatcacaaacaagcatacatgttattatactacaccaacctcatttgagcgtcttctttgtcgaacatttggcgttcttggtgaactacagttaatatcaacctcatttgagcgtcttctttgtcgaacatttggcgttcttggtgaactacagttagtatccgtatgtatatctctcattgttgaagtgatagttcaaatatttttggagtgatatacatgcacggactgagacctcccctgagacattagaaggcaaaagttataaaagcaaacgacacatccctaataggattcatattaatgtatcaaaatggctgtatcctcaaaattcagcactcatactaaatatacataatcactttcataattgggaaagttaaatacacaacaatatagtataataagcaatgaaattagtggacactaggtacaaaatgatattgatgatgtatgtatgcatgcatgcgtccgtcaacaaaaaatttaacaatgtgacctattagtttgagcctcgatggttgattcaaggttttttgaaacaataagcatgtgcccaacatatagttattaaagttacataaaaatagatcattgattgtcacacactcgcaaaatcgaaacccttttttcttgtaaggcacaagtttcatgtgctcaaaacagaaatgggataatgattctaacatcgaaataatggaaactatatatacaagaaaaaagaaataacaatggagaatggagaagcagattgaaatttaagagtacatacttggatttaagaggtaaaaaatgacaaaaggatcaatacgaattgagaaatttttttatgatgttagatgtggctttgctatgtttcagggaaacgagaattaacagcacaagacatagtaggagagagaacaaactacgagagatacgtaatggtccacattgaccagtaataatcgtgggttactttattatactaagtgacgggtccagaccccataaggttactgaaaacactaataaatataaaaactttatgatataaatctattattaatatcataaaatgtactataaaagataaaagtaacacgacatgtttaacagatgaacaataattaattaccttcatggaatttaaaacaaaaaaaactagtcaattctatagttgtccggtacaataataccctccttctcgatgccaatgagcaatgtcgttaaaataagtcttaggacattgagtttgaataagtggatcaataattaatctgatatgatttaatatatattaaaaaataatataactaatataatttaatttaatgaatttacatttcaaattttaataaaaatatactataatatatattattattgtataaatatatattattattactattatttttaatctatactatatacagcggaaaatgtttttgaaaaggaaatttacacatgatatcttcgtaatttctacaaattatattattttaaaaaataatgtttctaataactatgagaacctacgtgtaactttaattgatttgattgaaataactttttaacataattcatgttattattatataaatcaattgagataaggcaaaaattaaataatatgaattttaatattaaatcacactacactaacaaaaaatacaatctataatatatattttcataatatataatttaatcatcattaacgttaatatattttaaaataataataaataaatctaaacttaaaaaatatataaaaatactattgttagaaataagtaatataattttcattcatatctaaaaattctcattttcacacgtaatttataataattgtaaattaccttttatcctttttatatgtaatttcaatgtttgaaattagccatgggaggataaatcacaattttttttaaaagggaatgaaatgtctaaattaaaaaataagagaactaaaatcataaattttttaaaagtggatgatggaaattatattttagcctaaatatttttatatgattacaatttataataaatatttataattgtggtttaaaataaactatttttaaaatgtggataatggctatgattatgaacatttagatatccaaaaaaaaacggcatgatattaaagttattattcacgcgatcgagtatgaatataaatataagaatttttctaaaagacaagtttagggtgtatattatagtatcatactcgaagcctatttattgattgccatccctaattataggaaataaaatttaacattataatatattatacaaatgaaatattaatcataatttaatatttttgtgttttatttaaaataaaataagtgatagtgttaatcatactacaattaattacataaatattactatactttatgatacatgattaatatgtagcacaaacttcttattatttttagttcataattcctaattcaaattttcacaaatttttaactgttaaaaatttaatatattttatagtattttcctcaatatatttcatacataacattcatatatttaatttagattttaatttaaaaatatataattaaaaatttaatttcataaaatcgtcgtctatcaaatatataattaacttatatctattatgaacaacaaaaattaataattaaaatattatactttaatcgttaataattcttcatacaaaataaaaaattataaaaatatttataaaatattttataataatataattttactttttatagataaaaattatttatctataaaaatcaatatcatattaagaataatataaactataatttatattatattttattaaaaaaaattgatgttagtttagttgttggtaaacatttaaaacaccccacgatattggggtcaagtctcctcaacttccttttaagaaaattcatccgtagattaataaagctataacctcaattagatagtaatttaatggtaatctactaataatataaaataattttatattatcatacaatttacatattttttaaggtaattttataaaagttaaagaatttattatttaaatttaacttgattttttatctttaaaattttgttgaatttggttcttcccacaatttacgattatgttcttaataattcttagataatgaaatatgatacaaaataatatttattggcttggtcatgtttttgtacgtgcaattaattaatatagtaatgatttttaatatatcaaaactttttttaggcaaagattaacttttcaattaatattagaactgggtacaagaagtaaccaaacagtttagagggacaatacaacgccatcaacatccaaaaggagtcaaggcatgagtaacccaattccatatagagaattctcgtctgaaatctgaatggttacctagatttcaccaaaaaattaactgtgatcttttttcagtataattggttatgcgactatgacactttttttttttttttctctctttctttagtgtgtttgtttacacgtctatgacattattttttaaaatttgtagacaaattaccaattgcatgtaaattgaattttttcttttggctaatttatcaatttttctgtgtttgtaacgtgtgtctaaagacacgattttcctaattattacagttttgtttttttttaaatggttggaaataacttattctttctaaaatgcagagatactacaattaattgtcagcaacgtaaaattaaggattaattgttattttggtcctctaatttatttttaaaatttaatttgatcatcttagtattaaattttttaattaggttctctaatttttttaaatatttcaattaggtcgttttgtttttagaagttaagtctcttattttttttaaaaatggattcaatttgatcctatttaaaatcaaatttgatcttattttaaaaaaaaaaaatattggagtaggcaaaagaaaattaggataaaattgaatttattttaaataataaaggacctaaatatttttttttaaaaaaagatctaattgaattatttctaaaaattagaggatcaaaacctaaaattaaaaaataagtaataaaataaaaaagccctaactaatcaaaagttctattaaactataattagaacgaacattaattccattcagttggcgtaacaacaattgtggcaaaccaaagaattgggtccacgatgacgatatatttaatcatcaaggaagtaggtataattcgacaagaaagaaagtaggtatgatacgagagagaacaagaacagggcttacaaagatttgtgcctataataaaatacaatcacatgagagatgatgccattataattaacccacactgtttaattttagctaagatggccactttggtcgatgattagcaaataattgaaaatacaaatgcatgtgagttgtgactgcgttagaaattgtgctttgggctggtcaaatgcaactatgcaaattctcaagttccagatcttattatattaattccctgcgtaggtcacatgttgcatggccccaacccacatgtgtcttccattgttggcatcttgattattgattttcggacaggacataacgtgtgttggaaaaaatctaaacccaccatgtattgagcaacaagcatgaaactgtgctatctaaagaatagtagtagataagtacaaaaaacacagagttgttaggtggagggagggggacgaacttagagtgtcatggtcccctcaggcttttaattctctttggaaatactttgttcttactagtatatacttcacttccacaaaagaattatataaaatttacatttagtctcttctcttagttataaaatacatttattcatattttattctagataaagcacaactttaccaattactaaagcataaaataattcatacttaaataaagtaaatataaaattagaaaaattaatattcataatcaaatcttacgagtttacaaaaaggaaggaagctgttcataccaaacaaatttggatttcataattacttttaactaatttgctggtatttttattgagtaatataatgtcttttccgttaatagaatagtaaagatcagtagttgtttcacaacaaagttatatattactgggttaattttggttttgctttgagtgatgatattttataattgtttgaaattaatgaagttaagccatggagtttgacttcagtaaagagaatgagtttaaccattaatttaattagctatttataaattataaccatgggtaacactactagaaaaatgcaatttgctttattataaattataaccatgggtaacagctggataataatttatttattttgctttattatatttagatgaccattgttggtaacattcgtgctaataagtgataacccaggtagtgtaagtcgtctatttgggaaatggaagacgacttttcccacttaagttttattttttgcttttctaattgtacagcgccattagaatttagaactattaggtcataaacaccctaaaataaataaagtaaaatacatggtctaaatagaaacttttggcggcaggtaaataaaataccacacccttaattcataacatatcagaataaaatgataatgattcttaaccagaaaattatcgtagacctcagaaaatttaaaccaggtactgtatagagaaaaaaagagaatttgtgaaaaagagaaaaataaataatgatagatttgtataaaacatgtaaggaaatatgtttgtaacaccatctaaaatattgtaattacgatagagttgtctaacttggaacaaattaaaataatacctcacaagatttcatgtaattatataaatattttttatatttttaactattacattcatatttctaagagaaagtgttggtttaagatttaaggaaatgttagggagtatcagaataatattatccaacatatataagatgatagtagtataatatttttaaatataaagagagtaatgtaggaaaataaaaaagggtaagattatatgtaatttaataaaagctcaatgagtattgttgtaatttactctttaacttattttgtaagatttggtttctctaaagttagagactgtacgttagttgagctaaatcttattttttaggaggagacgcttgataaagaagaagtttttagtttttagaaccttgcgtaacatttttagaagaaaaaaatgttgtccgtgaataaattttgctaagttttccataaagttgtttccacgggaaattagaaatctaacttactctagttataaaaaaattaatgtgataaaaatattaattattcttattaaattatttaatgtgataaataattaaaatttataataaaaatattatatttttcttaaaaaaaactcataaatatctataatcaactaaaaagaattatttatatatatacgcatatgtaccaaacacctccttagtgggttttagaagattacatgagattgaagaatttcaacaatttcacttgtacaatttttaaaaatttaaaattaattatacatttgtctcacaattcttaagacctgttaagaatgagttgtttataaaaatacgaatgcttgtgtaagaattgcaatatcaactattctaatgttgaagctacataataattaattcttaaatttaaaaatccttaaatatcattatctagaataaagaaaaacaaaaaggataaaatatttttcttagactctccttttttttttaagtttcagtttgatcttatttaaaaagttttactttagcttgttaaagtgtatttattagattaaattggtcttttagtttatttaaaggaatcgacaattaccacatcaaccatgattaataatattaatgtggtaaattgtcagaaatattaatttaatataacaaaaatactttataaaaaaactaaaataaaactttttaaaaaactaaaaacataaatgaggaatgaaaggattactttatcaaataaatcctaaactatggagcgatccccgtgagaccttaaagagtgacacaacttttgtgtcttttaagttcatattcaagttaattagttaactgattcgacagacattggtgagagtgggaggttggatgataaaagagctcataatttattactcgtacttttttctaactaaaactgtactctctcatctacttattcacacagttggtcaaattaaaaagcttacggcttacctcagttatgtacttgatgatcatgtaaccaatttttaatttcatgattgccacatcgaaaaaggatagtattattattgatatacaagcaataatttgtttttctactctgtaaatgaaatgagatttgaaagccactctgtctctgccctttcattttgtcttaaattaaaaggaagaaaataagagaaaatatacaagtggaaaaaatgatggacgaagtgtgacgtctctaccattatgcatgcataaatgaatcattgcctgatttttatttttagcttttcatttagttaattttttataacgttaatttagttagtttgatcacatacatatatgaaatagcgttagatctacggagtatttattgataaaattattttttattaaggaatttaactgatcatttttaatgattttttttaattatgttatttcattcatagattcaaacataagatcttactaataaaattaaattcaatatcattttaaccaatgatttattaatatcattaaataagcttattatcaaaccagttaattatacaccgattcatgttttaaaccattcaattaattggtaaattcgaattttacaccaggggtagtagttttggggtcatatcatatgcacttcatgcaatgatagatacataatatattactgaataaaataaaaggcctgaaacgtaggccatcccaaatgcagcaattatatttatatgtagggatatagaggctatcccgcgcatgatcaattgatgataaaattataattattctcataatggatggcttacgtagaataatgagaatgcaagttatggtccaaggaaagtgatgaaatgaaaatgttgtcacgctgcagaagggttatatattatacactaaacagaaatataggtagcttcacattgatgctgtcattactcatttggacagagacgtgttggattcgtgatgacaaccctatccctgaccgcgacctttgcctttgcccatctatggagttttcctatcctctgctttttttcaggttaaataattatttacaattttttttagaaaaagggtaacattcccccatttgttgctagcaattgcccctgcccttaaattttataacgatattggcctttattgcactccatggacgtattctagcctgcaattccacgttcttatgctttgactacccattctcacacatccaacatatggtttcaaaatccctaaaaaataagcatatggtttcaaaacaaaataataaatcattattgcaggtagagtatcatagaagattgagtctagtgagggagataatctttcataaaatattaatcaatctttattttttttttataaaaatgtttatgattaatatttgatcatatctcgaacataattaactatttacacttttacgatttctaatttaattgtttgcaaatttttttatcaattccattatgttttctatggttttctaactatttgctggcttttgatagtaatttttacaagcatttcatattatttttgcattttattttctttcttttttaattagacccacggaaattgaatagtagctcaatgcttagttgccttgtaatgtgataaaatggcaatttgaggtgcatgctcattaattgcttttccgtaaacaacttaccctgtacttagaagtgaatgatggattcttttggtaatgtgtttaggtggatggaaataaacgatttctctcttgtttaagcccgtgtttgtttttctgttgggaatatcccaaacagaccttttcctaactttagaaaatagaaatactttcttctcacaaaacagaatatgagaggccgcactttttgactttagccgatatatgcaaatacacacttagattttggcagttataagaaggtggtatgttattaatatgaaaaaaatattaaaagatagtagtaataaatttagaaaggttatttacttgatgcattggttaaaaaattaaaaactaaatttttactaaatttaaaatacacaaaaatgtattgtttatgattttttatatttttcaatggtttttacaaataaatattctcttcttttaattttttaaacaatgtcataaaaatactgattaataagaccctaataaattatagtaagataattattataaataacaataatagtaattaaaatacattgatagtgtaaatttttaaacattgtcttttaattgttgaatgcgaatcatactcacttgtggctttggatcttattaatcatgatcaacctccttggcattcgtatgctggtttgatatactctattcaatctttcaagaatagaatttgggtcctaagttttaaccatgtctatcgagaagaggagcaatgcgtatataaatcgattagttcatatgggatcatcatcatcagatatattcactgttttagattcttctcctcacccattgacagctttcttgttatgcgagtttctttttctaggctttagttatgtttgtatgaaggatttattaatttttataataactatccttaaaaacatatatatttttttaattggtagactgtataaaaatctttataccgacaacacataaaagttaaattctaataattatctataaattttccatgaatacacaactttttgaattgagagtaaatttaaatcttaaataaaattcattagacagaccaagagtcaaagtcaaagtttttatggtaacatttgaaaaaaatgaagagtgagggagactttagacacagtgtcatgatcgtaaataagggggaagagttggggcaagaaacgaattgacttggaactagacaagggaaaagatagatcatagatagtcattgtgggtccattttgttttcctacactaacactgtactctgtcttttgtatcatctaagttcgttctaataaatctcatcatctaatcttattcttattatatgcacactctacacaacacaacctcactctctctttctctctctttcacgaactcactcgctcacgctctgtttcagatctgaagccacataaccctaaccttcaaacggtacgcattcttctctccagcgacttcttcttcttcttcttcttcttcttcttcgtctgatctccgcatcccccaagatctgcttcttcctcgttgctctgtgaatgcaagtgagctccgtctcaacttcttgttctacactgcgtttctttctttctttcgtctattcttttcaagcttcgttcttttctttagcttgacggtgaacatttccctctcttttttctcgatcatcgcattttcttgctacttgttgctgatcattgggttattatagcttccgtttcgtcgactcatttcattctgttgtgatcgttagcttaattagcttacctctgcattggattatgatcatgtcatatgtaatgaacaaaatccgacttctttacagatgcaattaaaaaactttttactttttaacaataattaattaattattatttttattaatattaagaattttttttttttttggcttatctcttcaaagatccttatttgaattcgttagtttagttgttgggatgggtaattttgggttaccggaattcaacatttacccacgatggattacggctttgcatttaattatgctttaattgcatttgcattgtcttatagcagatgtcttctactttcttgatcttcatggaagagaagaaatgtttctctatgcgtttggtggaagcagaaagaattttcatgtcatttttatattttgaggtgcaggctaggtgtcgctgggacttcaatggcagtgaccgaagctcaaaatcctcttcttggagaaaacacatgtggttccttgttaaaaaagcttcaggtaactaacttcattcaactgttcatctgtgtcacttaagatgcgaatgctctacagaataatgggattaagtaattacattttctttattcgctgtaggaaatatgggatgaggttggtgagagcgacgagcaacgagacaagatgcttcttcagttagagcaggagtgcttggatgtgtacaagagaaaggttgagcaggctgccaagtcaagggcgcagctacttcaagctctgtctgatgctaagcttgagctttccactcttctatcagcacttggagaaaagagcattgctggaattgttagtaactacttgactatgtcttatattgttagtaaagtggcaaactaatttcctatgcatattttttattctttcacagccagagaatacttctggaactatcaaagaacagcttgcagctatagcaccggtacttgaacagttatggcaacaaaaggaagaaagaattaaggagttctcggatgtacagtcacagatacaacaaatatgtggagagatagccggaaacttgaaccttaatgatgtttcacctgcagtcgatgagtctgacctgtccctgaagaagttagaagaatatcaatctgagctccaagaacttcaaaaggaaaaggtaattctgttataatattcaataatgtgtcagttcagtttgtcactaatttggaaaattccatttgatttcattcactaaacagctcattgagagttttgttgcattgccttgtttggcagagcgagaggttgcacaaggttcttgaatttgtgagtactgtgcatgatctatgtgctgtccttggtatggacttcttcagtactgtaactgaggttcatccaagtctaaatgactctactggtgttcaatcgaagagcataagtaatgacaccctagcaaggctggctaagactgtcttaacgctgaaagaagataaaaaacagaggctgcacaaggtaatgcatttagaacatttcttccccttaatttttatttatgcaatagctgttaactgtataagctctcaaattttaggatttttgatatactgtggtttttgtcttgctaatcatgtgtatgttttcaagaaatcaccatcaattctgactttgataccccagagcgatattacctacaaaatgttttgcattcattacttgcttgacttttaatctaataccattttctttactttgacctggatatttcatgcagctccaagaattagcttctcagttgattgatctttggaatctaatggatactcatcccgaggaaaggagactatttgatcatgttacctgtaatatgtcagctgctgttgatgaagtcactgttcctggtgcccttgctctggatctgattgagcaggtactaaagaacttctgaagtttacagattcgagctccaagtatgttattaacttttttttttttttttgtttaataataaaggctgaagtggaagttgagagacttgatcagctgaaagccagcaggatgaaggaaattgctttcaagaagcaagcagagctcgaagagatatttgcccgtgctcatatagaagtagatccagatgctgcccgggagaagattatggcaatgattgattcaggaaacattgaaccaactgaattactggctgacatggacaatcagatagcaaaagcaaaagaagaggctttaagccgaaaagatatattggacaaggttgagaaatggatgtcagcatgtgaagaagagagttggcttgaagactataaccgggtacttaaaatctcgcttctgctttatttctctttctgagtttgaatgattggttgtgcacagccgtggatagagaggtgaagtagtagtattatgatcagaacatttactatcatgttaacaaaaattgtaaatcctttagccagagttaatctgtatccgtctttattatatagtctgctagttttcagtttaagtgatttgttatttgacacgataattgaaatgtttctttccctgtttccggaaatatttagatttttagcattagctttgctgcaagttatgatctttaaatggttgcctaatcctcctcatttggattataatgttacactctgacacaaccttgtaaaacaggatgagaacaggtataatgcaagcagaggtgcacacataaacctcaaacgtgcagagaaagctcggatattggtcaacaaaattccaggtatttgttgaatgagattacaatcaccatcagatactgttattattaattcaatctgctgtcagtgtaagcaaaacaagatgatgccacattattggaataattttgtttctgttggtgaaaatgcagctttggttgatacattggttgctaaaactcgtgcatgggaagaagatcatggcatgtcatttacatatgatggcgttcctcttcttgccatgttagatgaatatgccatgctcagacatgaacgggaagaggaaaaacggaggatgagggtaattttcactaataagatgattaggattactcattttcagcttgatttgagcaattgctaatagtaataagaccacaactctgcgaggaaattaaaactatcagcttggcctatttctgttctgttcactactattctatatttgttatacatactgtggtacggagaggtcataacatatggactttgcactttgtaggatcagaaaaagcatcacgagcagcgaaacacagaacaagaaaccatctttggttcaagacccagccctgctaggccagttagttccagtaagtcaggaggttctcgtgctaatggaggagccaatggtactcctaaccgacggctatcgcttaatgctcatcaaaatggaaacaagtccacatcaaaagatggaaaaagggaaaacagactatctgctcccgtgaattatgtggccatgtcaaaagaagatgctgcttcccatgtttctggtactgaacccatcccggcatcaccctaataacgagatcttcattttcaacccatttatttcatctttgtagcattgtcaaattactagtgctttaggaattataatatgggagtgacaagtaattagagaggaactgttctgagctgtgtatgttcaatttgccatttggaggttttctcaatagatatgccctataatatgaaaatatacagtcttcagtgctagtcttgcctttttccaaaccctagcttctattcattggtttgtttcactttcagtgtttgaaatggtgttacatactcttaaaaaaatgatgttacatatgcacgtctaccctgcaatttcacgtcaaagaatggaaaaaatgcagaagcaacaaatagttgctcacggtgtccggctttatgctgtcaaatgcaaatttccgaacacacattttctccttgtgagatgtttcagttttcagcatcatgtccatggcaattgggttttcataaatatttaagtcacagggcatagtggcggatctccaacatagtgagggtgtatataccctcttctcactttaatattatatataattatttaatatttttatattttgcttccctaattttatatatttgaatttactactcttatgtttttatatttttatatattgtattatttaattttatatatttgaacccactattcttaattgttcttactgatccagggtcttagatctgccactgacggtgcaagcaataaaatggtcctaatcgcgtagcatttttcaagcatggggtattattaatcaaatgttacttattattcaagttgtataaaattaattacctacaaaaatgaaaagggtataaagggttttttcttttagaaattccatgtatttttcatgtgacatgtgattcatgagtattaaatggagaaatactaatgattcaaactcaagatcggttgttaatatgagacaattttgcactagttaaaccatgtccttagtggcgagatttggttatttagagttttgagtgatgtgcaaagttcaattgacgatacaaaataatcttcataacaataattatttttgtttacctgcttaatgcattgaaaatggtagagttgatactaagatacttatatctgcattcttatccgtcaaaatttgttcgtattgcttgtatctaaatcctaaatatcattctcgttaagtgggtaattacttatcaatcaagagtaatttttgtactacccattgggaatcatcaacatattagtggtatttgaacttattttacttatactttaaaacctctaaaacatttaataacagtttagtttgtatgaatggtatgtttatttttcttaggattttttattatctttgtaccggttaaacttagttttggtccttgtacattcaaattgattagcccttcaactttagaaaatatataaattaatactaaatgttaaatttaaacaagaagagggattaaattttcattttttaaagttgaaggaataaattcatcaatttaaaagtatagagactaaaataaagtttaactaaatacggtgattaaaatatatgtttctcatttttattattattgaaaaagtaaaaaaccttttcagacatgtcaatgataaaataattttttatattgttaatgcataaattatttaaatatttcctcttaatactaactcctaaataatccaattaaacctttaatagtaaaatgttcttgtcctctttagccccctaaatttatttattgagttccattgatttgtatttgaagaagagaaaattttaatttttcatctatttttctcatattctagtagctaagcatatcgtaaatgaagatctaattacttgaagaataatgctaactacattctctctctctctctctctctcacattttttataggattctctctataatttgttagaatgtattagaaattaccatttttaataggttttatttatcatttaattattttttcttctaatttatattgaatgagtaacaaaacctattaaaattaatgatttttaataaattctaagcaatcagaatcattgatggagaatatcaaagaaaacgtgtagcattccctcttaactgaattcatgaaattaaattgtatgcttctaaaagtcatccttttcatcaatgatcttgcaaatgactaaattgataatttaaaataaaaaatagcacgaacatatgaattgattatttttaaatataacataatatattatttataatttcttattcagttttaaattatcacagcaattattttttcttagctgagaagtttttttttttttttcccttaattgttgctttggcagggaaagacggtcgaaggcataagtttggaataaagccaacaatcgacgtcgtgtggtttccaataccttctgcgttttgaatttttgcgagaattgagatggcgaacgagaacgaacccgcgaagctgctgttaccataccttcaacgcgctgatgaattgcaaaagcacgaaccactcgtcgcttattactgtaattctctcttttattttaattttagatcgatacctatttttcattatggcaatttttgttgtttcactgatctgaaatactctaatcgtcgttataaattatcacgatgaaatattttttttggtaaaattaggtcgattatatgctatggaacgggggctgaagattccgcaaagtgagcgcacgaagaccactaatgctcttctggtttccctcatgaagcagcttgaaaaggttctaaagtaaaccttgttgtttttttatgctgactgtaatcacaattaactgaaactcaaaggtgatccgcaaataaataaatataaaagtgatttttaattaatctcgtggatccctttgtgttgttttttaaaataagaagggaatctactcatgttaaatggaagtgtctgaatctgaataataatgaattaatgatactatggcatgtttcagtggcaatctgcagttttctttcctttgaaagatgttagtggttgacatgtttgattgggtatgattatggaatttttatttactcaattgatgtatctgaaatatgttgtttttacaggataaaaagtcaattcagttggggcctgaagacaatttatatctcgagggatttgcttcgaatgtgtttggaaaagcagacaagcaagatcgtgccggaagagcagatttgtataataaaatcactctttttattttaatgctagcttgaaataaataaataagcctttaagcttgtatgttggttctgttgcatcagctgtgatccctatggtctcagactctcagtaaagtttacaagggttttttgtatcttcttgtttctttgtcttgaagatagtagctcactctctttacataccaagcatctgtcttttgccaaacatttgctatagtattattaaaaaaaccctttgcataactatcttgcttgtaagaatttttcatctgtgataagtttttaacgtatattctttgacactttgcaggaatacagcgaaaacattttatgctgccagcatcttttttgagattcttaatcaatttggagcagttcagcctgatgtgtgtatttcatgcatagaattgaaccttccttttttatgcatgtctcattgcatttgcatgttttccacaaagcctttcttatttggaaacaatttgcagcaagaatacaacttcctgtaactgtatgtttaatgcttttttgagtttcttttacagctggagcagaaacagaaatatgcagtgtggaaagcagctgaaataagaaaagctttgaaagaaggaaggaagcccactgctggcccccctgatggtgatgaggacctctcagttcctttgagttcttcaagtgatagatatgtatgattcaaaacttcacctggtgtcttctgggtttgatcagttagaaaaacatataaataaattcattaataaatataaacaattaacattgagctgtttattcttgcaggaccttgggactaccgaaactactgtttccagtcctggaccagaatctgattcatcacgtagttatcatagccctgtcaactaccagaatctgccaagcattcatcctgctcctaaatttcatgatactgttaacgaccaacattctgcaaatattccaccatctatgccttttcatgacagagtagataataacaagcattcttccattgtttctccatcatctcactcttacacacctggagtttatccttcccaagactaccatcccaccccaccttcccaagattatcattctcctccaccttcccaagactatcattctcctccaccttcccaagactatcatcctcctccaccttcccaagattatcatcctcctccaccttcccaagattatcatcctcctccaccttcccaagattaccatcctccacctgccagatcagaaagttcttatcctgagccctacaaccatcagcaatactcaccagagaattcacagcatttagatcctaattacccttctcatgaaacttcctctttttcttatccccattttcagtcttatccaagttttacagaaagcagccttccctctgtcccatcaaattatacttattatcaagggtcagatgcttcatattcttcccagtcggctccgctaactacaaaccattcatcaagtgctcaacacagttccagcagcagaaatggaactgttgtggaacctaagtcaactactcagacataccagtatgacagtaactaccagccagcacctgaaaaaatagcagaagcacacaaggctgcaagatttgctgttggggcactggcatttgatgatgtctcaattgcagtagactacttgaagaaatcccttgagttgttgacaaatccatcagctggccagtaagatgttatgtaaatcgaaatgtggatttcaatggtttttctacctattatttgcatgtcttgttttgtatattacatacatcatgcattttaagtgtgaagaaatttggggaagatgaatggaaatcataaaatctgctgggactgcaatctttcttgtttatctggtagttattgagattggcttgtttgtcaaggaattgtaatacatataagagatgtctgcttgatgaatttcagttctgtctgggacaattctctttttctttttttgttttggtcttgcactcaaattcaggttagcgttcattcacccattgaccctgaggatttgaatctcagttgtgaaattccttagtacatcataataacttgttgcttaagttccatttcagagattagtacaatttggtttggcataaaaatctattacatttttaatgatttttttttagaagatagtgatgagttctggcagctgtatagcagggccacattgtattgacggaaattgtcagatgaaaactaaattggaataagtttggtaggtttaaccatattatccttaaactcccgtttcctttcaagcaaggagcgggagtgtggattaagttagggtatttgggttatcatctgaaaagatccaacagttgaatcttcttatggctatgccaagaaatgttattctgatctgttttaacttttaacctaccgtgattgtgtcgtcactgggacattaacagagacttgacaagaaaccaaaaaaccatcttatccttcgaactccgatatcagtcacagtgagccttcaacgcttgatcatcttattgaaccatttaaacaaacagatccatagaatgattccacatcttaacttaaatctaccatattacataacttttttacccttgacatttctgttggggaacattgcttagaaactgttgtgtctggacctgcaaaagaaagctgcagctaacctaacagagaaacaagtaaccctttttatggtccttaaagcgtagttgccttgcattacatgaggatctttttttttttttgccatactggaatgaaaagatttatgcctctgggaaatccatccagttatcggacaactatgctgctgcttgtacgagaaaataggcgcacgaagcataagatctatgttgcagtgtttttaaaaataaatgttgattaaaataacagcgatgctatacagtgcgatttttttttttttttttactacgaatctacttgtttaaatataattggatagatattgaatttttttttaaaaaaaaaaactaggcttttgactcaattcaggaggagatagttattgtatggataatccgtgcggtacgaattcgcacaaatggtattttccttaaaataatttaaaaaatataaagaaaaattaggcagaaaacacctttcgtgtgtttgttacgaaatctattcgtaacatttagtattggtcttcaatacaagtggaaaagggccacaaaagcccaagagaaaaagcagtggtccaacggtatagaaatgaaaaacaatctcacctcacattgtttttctttttgggtcttttccactctgaggatgatagcgtcatttacctcttctgtatggtacatgttgggctttgattattgtttagcgaaaaatgtatattttttaaaaacaaatctccatgaaaaatttaattataagtaatttttgaacacggtaaaatgcaagtctgaattttcatgactcctctaaaatgagtaggggaaaagtaagtaatttcagttgttaataagaaatttcgcagttgatatttcaacgcatttaatttgttatgcgtgcaccataaacataatattaaccaacgaccgatattactttatcttctaaggtgagttgtttactttaaaagagacaaatccaaagctccaaggacgagttatcttaattttaagtattatcataatttgtatagctgattcaatgtttattagggggaaaaattgagagccacaccctttatgttgaatctgttacctgtccaaaccatccaactgatagttaatttgaactacattagcaataaagtaatatgttgcatgtccttcaataaatgaattttagttaaaagttacttttttttggaaaatttaaataaataatacttttttaataaataattcaaaaaatgggcatttttaaaataatttgaaatccggattgtcaaacgcccaaatcacttccgtcgttaatttggtcgttaaatgtttgcgaccacaatttccgtcgctaaatgtttgcgaacatgattccgttgcaaaatgtattatagactaaaatagagactgaaattagcatatgactttaaaatcaatttttaaatttacattataattttttcaatttttgaaattagtgttgcggccacaatattgtaattttttaatttttttaaactgaaatcatttaaaaatttacagtataattttaataaatagatataccaaaatcacataccttatttgggttatttggcaaaaacagaatgtgtataaaaaaaaaaactttcatttctcattttctgctaatatgtagaggaaacctaaaattatggtagtcctatttgcgaaatctattatctcctctgtctaacctaaaccttaatatataaatctagttcttaaatagataggagaaaaattgataatgtgaaagggaaaaatacgatcaaaatttcatccctttaatttttaacttttgttttctttttaggatttaattttctttgtctctcttattttcgctttgactaaacaaatacacactactctaatctcaaaccaatactgataataactacaaattaaggtggagcttcatttaagtattttttttattttcatttcaaagaaaataaaaaataagagtaaaaattatttacttaaaatttagaaaacattttttctaaaaatatttttaaaaagaggtccaaaatcgaaaacaacaaatctaacaaataatttatatatatatatatatattggattaaaataccccctatgctcctttataaaatttctatttattgataaaagaaataaataagagaccaaagaaaaaagatgtcgtcatcttaatatgggacaaaactttcgtacattaacacggtactattgttggtttgatttgcaaacaaaattggtaatagatttcaaattggtttgtaacgcatgcataaattttgagttcaagtgaatttcgagcgtataaactttaaacggtcataattttttatagaaatatccgatggaggtgtacgatatgtcaaaatgctcgaaattaagagaattaattaaaaaaatagaaaataacattaaattaactaattaaataattaagaaagtaaactgtttgaaaatttttgactgattgaatcctaaatcgtaattttgagacacttagaggcattttttggaaaaaatagttgaccaatttccctttggggagttgtccaagccttctcctctgaatttcagcgttttgatatatcgtacgcctcaatcggacatttctatcaaaagttatgatcgttcgaagttcgctcgacactgcgcgtgcatgacacgtgtcacaactagctgaaacacgcctaaattggacgtgtttaaactcgtctattttgagcgtgttacacagtcccagatttcaaaatattttcaaaactgtcccatttttcaaattatttatttaatttatattatttatttaaatttatcctttcttgatcgattcatgggatatggcataggaacaactttatctgctcgttgtaatgatagaggaacagttgaacacaaagcgatcatataattggagtctcaggcttttgcttcactgtttgtcagtcttgcaattttgtcttcactccaacatagtttagtttaggatgctgtcttcaacttggatattcattcatgaatattgtttataaattcctgctccaatggtactgctagcttgattttagggttaccttttacaggagcaatttggtagtttggtagatgcaaccaaggcaaatagttctcagccgcaacgttaactgtgtttcttcaagttaacaatgtctttatgtgtttgattgggaagccttgtcttcaccgccaaactaaatgtcactgcctaagacttatcctgacaaataagctaagaattttgtcttcatttttatcatagcaattgttgtgcaatcgataagataaacatcagaaaatttacacagatagaccttgagcacaccacataaacgaacttacatcacatttcaactcaaaaccctcaaatttatgaattttcctattacttatgtgatactcaatctttcaatttctaactaatataaaatttcacctaacactttacttcaacaaatataaacattgaacgaccactagtactctctaatatatatgcatataattataaataagtggctgagatattcagaattactagttgtggtcgtgatattttatttatcaaaagtgataagaagaagaaataaactgcaaaaggttttattcatgcttatttaatctgtaaaaaataaattaaggttatccattcatcaattatgttccttagtttcttcttgatattaacaaaggcatggagtgtaatattcttaactcttggataatacgtcttagatgtcctatataatagacttagcagtctataccacgatccttatgacccttcccatttgcaattaaacaaacggaatgggaattaacttttcattctgttgttctgaggcttattttaggcgccaaagattacctaaggaagactcatgttttgtaaaggccagttcagtagtatggattgtcaaaaatatcaagcaaacttactttcttattaagaaggtgatgcaaaagaagaagaataaagaggagcagcatcagaaaatggggaaggagctcacattagaggagtggcttctaaaatcaccaattatggaaaagcatggtaactgcaacggtgatcattgtgatttaaagcatggccctaactgtgattatccctcaatagctagagaaagtgcctatttttctgactgggaggaatatagtttgtctttggagcaactctcaaatggtgatgattattcaaatttgaaagatgaaaagtttgatgtaaaagaaatggggtttaatccattgactagaagccaaagtagtaaggtgaagaaaagggtgagctttagactgccagaagtgtcggagactatcatttttgtatccattagagatggattttaatgagtgttagtgcattaattagtttctatcctcaatctgtttaatgtgaattgtgagtttactagaatgatgtgtgtctctcctatcgtttttggaaagtatgtgctagagatttggagtgcaagaataatggatcaaaatctcagacatagctaagaatccgaattagtgatccacctacaatgtgattgtgactatttgtaaggttctaaactgtcaaataatatgtatattggtgtttgagaatttcttgcttccatgttggtttcattttaaggtggtttcaatatcagttgcttagaacacttttcatccactgataatatcctattctgttttttttttcccttcccagctgttttctgtttgttttaataggattccttttccttcttctctgcattactcatttctttggagaagttttccctttgttcctactaactaaatatgtatatcaggtttggttcttggtcagcagatttaacaatgcatggttggcatggcacaatataatggtagcatccaactactattaaaaatgttataggacaagccagaaaaagccatctttcaacttaaattataacagaacagaattaatcatttatctaccaattagatttgctaatgaaatattaaaaaaaagtgttagattgatgaggacaaggaagaaagcaaactgtgactaaatcaagtggtctatctaacaacccagcttgttaggtacaagttccattcatacgactctcacaagatatggacactataatatgtatgctatgcagagagcaaaattagttcagatccaagggaacacaagtcagaaagcgcataatgcgcagcaagtaactagagtcagcaatatgacacacaaacaacacgcaaaagagggagaaaaaacagtaggttggaagtgttttcaacctctcttttctctttcttttgtgtattctttctgactcctcctatgcaataacacaacacacaaagagttgggggggggggggggagggtggagaaaaagtctttgtcgtctagttatcttcaagtgaccctttttctctcagtctctaatcatttgagcaaaagaaagggatgcaactatgtgaaagaattgtagttgctctaatagttctttggcatgactagtggctcgacgttccactcttagaaaaagttcctcacttagtttgtcaccaatgtgggcatcaacaaggactccagacacagtcctgcagctgttggctagagcccttcctacttcacttgcatcatctggttggttcaccacaagtggacttcctcctttgaatacctcaagcttgtctatggcaaatgaaccattagcctcaaccacctccttgaagtcttgcaggcttgctgcatagactggaatgttaaaattgtctcgtttttcttggctaatcaatccctgaaatcaagaatatgatttactataaaataacatgttcatatcaattcataaaaggatagatagtgaattggtcttgaaattaaatcaagacttctgcttttgaaaaggtaacaaaaaaataaattctaacatcagtaatatatgacaatttagatctaccattctattaataatgtatatatactcaactataatgtgaaattatccttatatctatagtgttaagttggtaagtgagatttaccatgacatatgtttgagtaactgaaaatgttctaaagtactcaacacatcctactatgttggtgtcgttatattctgtacttcattgattacagttttggaatttgtatgtgtaacatggtagaggatgtttcttataagtacatgccttcgactgtgttcaaagacattgttgtgtcccattggcaatgatctttgtatgaaaattgatcagatgaatgcatatccattttgtctatagctttaagacatgatgatcgatgtgattcagtgtttgttctaagctcttaagatatccaaagcctaattgttggtcaacattatggaccacaagacacagccagccggaaattaattatcatttatgccgacatgatgatcaagaaatggacggctagatcaatataggggtggctaatcaacggctgggaccaatttattgtaaacgtggccagagaaaactcatgataagttggggtgatgcctacaacacttgagcatatttgtcttttaatctctacagtgtctcaaacttctttttggtcagccaatgggaaatagaggctatgtgccactgttgacacaagcaagcatgcataaaaatgtttgtgattatgataattacctcttggacaagatcatcccaagcatcctgaaaatgggtcccaaaaagaaggccagccccaccttggtctgtggggtccactgaagttctggccaagcaaactaagaacatggacccctctctcttcatctccactgaccttgccctcagaaagcctgccaagtctgtttggaattgtttcttgtaggcatttgctgtgctctcaccagccccatggataaacacccttcctttgttatatgcacttgacctcttgtccactacactttctggcacctgcaccaaagtaaattattgaaacaaaacgaagagaaaaatatgcactatatttttttttaaagactatgctaattatgctcaaatcgagtaagatctttatgaatgataaagttatcattattaatgtaacaataagctactattaattggtcacatccaattaactaacattcaccttagcaaattcaaatccatgcatttctgcttttttttattttttattttattttatgaagttggggtatcagactatctcttggtcgggaagtccataactaatttcccaaactattcatatatgtttaaggagtcaatctctttctaagatatttttttatatgcattggcatgtgatcaagtcctaactatatatatgtataagagataaaattatcttttaactatgtcacaccatgttggttaatgcaattctcctttagggtagaaaacactgcacacttttactgcaagaaatcagaattttgtatgataaagaacatgttatgtaaatgtgtgtgaccaataagcaccaaatagtacacacttttacagggggaatcccaactccaattgtgtctcttttggtgatcaaattctttgtgctggccccatatattattgaaatttaagatgcatgaaagtagaagaacattgggtgcttaatgcatgcattgaaaattactgtccaaacacgttacttgtttccctgaaacatggtccttttttcaaccctatagaccttgggttttctgcattcactttttgaccataaattatgacttaagcttcaaattaatgatggctttactatcttatcctcgggaagaggcaaatattcctttcattttgtcgtggaaataacagattagacgacaaaaactgcaggaatagagaatctttgattattgatgggtaggttggggagtaaattaaacgactatggcaatatcttgttaacaagaattgctttaaaggatttacgaaattagtgtaatcgtgatccaccaaaagtctccaagaaatgtgtggtaccttaaagttggacttctaatcgaaaggtttataaagatcttgggcaaacaaatgatgaaagatacacataaatgatttgaaataaattatgacttttcgtaataatttaaccggccacttcaattgcaaagagaaataaaccaattaatgaaaattgtagaagtaaaaatgaagttatctattgaacttactccccctccccatcacacacaaaaaagaaaaaaaaaactgcgtaaaataattaattctttaacttgagaatttttatttttagaaacaatcacataaaatataactttatttttaattttaaatatttatacaagacaattttattatgtttgttattctctatacaaaataaaatatttaaaaataagaaagaaaatttaaatgaagtgacaatttgacaactgtttattgaaaacatgaaaaaacaaaatcacaaaccaaaagtcagagttgatattaacaattaaaaaaaagtataaaaagagataagagtaaattacaccattctttgaaatactaccctgtcttttaaattttacataacccccttacaagttacaggatatatatatcaatggtataatgtgttttctttagtataacaaaaatgatagtgtaatatattttaaataaataataaaggtacgtaaccctggaaaaattaaagacaaaagaagtatcttgtgaatttggaagaaataagaggggatatcatgatcagtgtaatatattctaataagaagagagatattatttttacttttattttatgaaaaatacattataacttatttcttgaaaaaaaaaatcctaaaatagtatgtactaataaattaagtgttggttacctgagatagccagtgcaaagagaaggctgagtgaaaaacatcaacggaccttgccggaaaaagcctccggtagaaggaaccaggaactccggcggcgaagtaggagcggtggttgttggcagcgaggcattcctccatgctaacggcgtagttggcgagcggaggaaggaggtggaagagcgtgttgaagtcattgctgggaaggtctgagaagaaagccgagaactctggtggctgccaccccaatgcctcgtaccttttcatcatgtgctttattatcacatccaccacgtttatggtgttgctcccacacgaacaccccaagtccgccaccacaaatgccacctcacgtccctcaacaacttcaactctgtctagtgtctctctcagaagatgaagcatggacctcgcatgtaaggcctgcaatatataaggtggattcgatcattaaggaaaaatatcacatatgcatgttttatctactgaatttagtttttcttagtaaattaagacgtagcgtttgtcagataaataaaaaaaattagtttttgtaaccaacaaacatatgatatatatatatatatatatatatatatatatatatatatatggtacctgtgcttgggaattgttggcatagctggcttctcctttacctcctttcatactaagcaacttctccagttccatattggatacaacaacattgtctcccattggagccatatatatatatatgatccccaatagctgtgagatggatgaatgaatgaatgaaagggaaattgttgtatatgaaaaataaagacaagagaaagagtatttggagatttgagtttggaaaactgagaggctagtggtgatatatatatagacagagaaggggggctagctagctactttttttcttcttctatgtattatgttaagcaaccgggcattattatttttgttgttgttatcattataaaaaaaaaaatagttaactatactacacaatgggaaaagaaaaataataatactaaaaagaaacttgaaaaaaaggttaaaagctaaagtgtgggcctcgtgtgcaacacggaaggcccaaactggcgccggatctttgtattcatataagctacatagaatatcgattttgtttctgaccaaaaccaaaaaaagagtatataatttgttagagaaaataatattgtattcgcttgttgtaacaactaattataccaattctattatagagaatatgtcgtaagattcgacaaaagattaaggtttcgatcatctatagctatttttaatggtagaaggattattttattaaataggtagaaggatcttaatcacacacaaacactaaagtttatgagctatgaagtttactgtgagcagacgatctatattctgaattaaagtttattatagtgtgtataaatgatacagatatcttattgcattaattaatccctatatatttgatatcagaatgccatatcggttatattatctgcaaaaaaaagtactaaatcataagacagtaagtgctatgcaaagttttccatcatggcctttttcactctatatatataaaaaaaaacattgctcgatgcataatgatacagctaattaagcagtttagattaaaatataatgttagattattgagtaatgatacgtattttaaggaatcaattaactagctacctatatagtgaaaaacaaagaaggtgataataatggttcctaaggctacgtaagtttcctttcatttgcccaaagtttgccatgtaaatagcaacttaaattgattactctttactaagcaacttttacaattttttattaattttagtcttgtgaggagattgattacttttgtcggctgtttagggctttattataatataaggagagtcaaagtaatccattaaaagccaaatgatgattaattatttcattattaattaagtcaccaccccagaaatcaaggttcatcagttagtacctaccaaaacgaattcattaaatggaatggtatttcttttcttggatttaaatggaaatcaattaagttataatcaacttcaagctaccataaacatttactccaaggctcaatttacttcttttttttgggttgtgatcgctttattttatattcatataatataactctcatctctttttcgtttgctacttttttcttcttcttaatattccattaatttcctatttttcctaattaaaggcttagaaaattaaaaccctgaatttatggataaaaaaagacggttttcacataacctttttgaagaaaaggtaaattgaaggttttcctaaaagcatatataagagtatattacttttctgaaatcacgattcatgttcatgtgcctcataatcggtctttaattagttggtaaggggaaagaaatgcaacaagaagcttcaaagcagatgccccaaaaattcagttgcttcacaactacaaattaattcagcaatagcatgcattgcatgtcatatattgttaattctttttttacatatggtcaataaagttctcttacatcttaatatgtaaccgtgttctctcgtataatgaagacgttcaaaaacagttgagagaagtaattgttctagagttttatcggtcagaagaaagggtaaaaagtgttcaaattgcaaatggatttccatatatgttaaaataaatgacaaattcttcagcttcatgacctggttttagaaagattaaacaattgatttttatcgctttcttttgtttattaattagttactgttttatttagtttttcctaaaaatagcacgataaagaaacatcgattaatcatattgttaataagtctaacataatattcacagatataatttaataccttaaacatatatattattgatcagccttccacttttgatatttttgtgaatttaaaaaaaaaaatacttgcacttttggttttagtaagtgtaaaaatattttattgagataaaattagtttgctaatctttagaatttaatttttatataatatcaacaagaattttacactacattgtagatcaaccaaacataaattattattagtatgattattaagattttttttaaaataaacttatcacataataattagtaattgaatgacagttacacaaattattcattttaaattttatctttgaaaaaattagacttcaaacattagttaagaaaaatacttgggtcatacttatataaagcaataaattaaattgtagactcataccaatatgtcattagtttgagtagcattgaatttaattttttaaaataaaattttgaattggaattttgtggatgagaaaaatgtgattagaaaaaaatatccaaatacatagccttacatttaaatatttaaaaggttattatccaactttatatcatataaataaatttgttaactatcgtcaatcccaattaactttatattacataaataaactttatatcatatttaaatatttaaaaatgttgatgttgatagagctaaagaaatatttactatataagcacatgcatgtacacataccatctcaaacttcaaaaaatatgaaaataaccgaataaaactataagacatttagtgaaacaaaacaaaataaaaaattgtcaaagtaaatataaaactgatcaataacagaacctagctaatatgaagagatggatctgtcaagaagaaggatgatgcagtaatattctttctcagcttggccagcacacatatatgtctcaacaggtatacagtacagaatcctgaatgtcgttcaaaaggggttagttgaaatgatgaggctaggtctcaacgtggatagctttatttttattttttatggtaaatatgatttttattgtgctgtgtttggactttggactgcattgacgccattaattatgtttagttgtcacacctaggccataattttctttttttatcttttttagagaatttggtggaatttaaatttattatacaaatatgcaattacttatatacctacaatttagtaaacgattcttttaaaataaattcatcgaaccattactttctttatataaatttaagggttaacggtgtttttagccacaactccattaccatgcatgatttcatttttataccaagcggtcaagggaaactcatgctgtaggcaacgaattaatttaaatgaaaatcatggtgcctaaccacgaattaagttgtgataatgaaatcatgaattaattagctaggggtaacgtttgtctttgatccatggcttctccatttatcataaaaaaattgcattaaaaagttgtgagtagatcaccacatcaatgttttcatataagttgtgtttagtgtttatgactttatcaaaaccatttttatatatataaaaaaaagcttattaagttgtgagtaaaataaaaattataataatcttcttaaaagttacacttttttataataacttaaaattaaagttgtaattacgaaacgtaatttcatcacatatataagaaaattaaataaataagtaaaaaaaaaaaaaaaaactgttgaaaaggccatgcatatctatcctcggattcttcattataggggtcaaaatcgtagattacgaaatatataaagagaccgatcgagagtgggggtggggcttcagagatgtcatatagctaggtttgagaaatttatctgtatttttcactaccactatattataattcgtcataaaaattaaaagaaaaaatacaggcattgccatcaactggtttttgaaagtttttcctccgtgtacaattccatctaatgcaaggaaacgtaagaactttgtttttataatttcattaatttttggactatatatataggagtatgctctgaggcttaatttcatatctaggttgaatgatcctagaagtgcatgtaaaattacgcaatctgaattttaaatgatacctaaaaattgtaattaactaactgtatcagttatatattggcccacaatgtatacttattttaacagtttcgtagggtttgacacaaaactatattatatttaagaacaagaaaagagaggattaacttccacagttcaaatctgaacggcgcaaataaatgatgtgattttgattctctcaatctatttttctttgtgcgtctatatatatatatatatatatatatatatatatatatatatcgagaatataactcaattataaattctctgatatatattttcaattcctactaaaaacacacacaagacatagaaatagagccttgcataacacgccccaaaaggttgtgaaaaaggcatcatatataatatgacacttaattctatcctctgaaatttaatttacactggaatccaaaaacttggaatctttgtcatctggctagctaatggccccctccttctttttgagctccttcttcaaagtccaaatccaaaccaccgtgatagtcgccatttacgtgaaacaatgccgaccactttatacattttatattatatttagcatatttgattatctcctgcatattttaattgtcattgtatgaacattataataatctagcatctacttatatctcttaattgtgggtttgttttaccttaatcccgcattttgatacatgttcaacagggagcactgatatatactctctcacaaaggatcagtagtgttggacataactcacgccaattcaaacacaccctaaaacttaattaaaatcaattggttcatattcatttggataaattgaagttttagtttttttacatgtaatactttaatttaattcctatagaagaaattatacattttcatatttatatagaaaaacattaattcatatgaattgatacctatatattatttgccaaagttataatggtatagatttgatccctatatttgatactattttttattttattctctacattaaaaaaaaatcctatattaaaaaatttatattttagtccctactctacatcatttattttgttttagtttctacatgaaaaaaaacttgacatatgtgtgcttgcatgtatgacatgtctcaattcaagataaaaaatgtaggaatttctaacaaagttataactttaataaacattagatattactttgtatataaataatttttcatatgaatatcaaaatatagatttttttcatatagagattaaaacaaataatgtcaaatacaagaactacatttataatttatccttttcgcattcattattctttttattcaacatctatttagattagtggattaggaattatcactactcatatttttggtgaaaccaaaataattacgtttgtgtaggctacctttagtaacttaataagctaggtcattcaaccaaagagaatgggagacttttagccctaagagagatgtcaaagatacggtgggatggtcaaaagtaagttagtagttatttcccttttgcatatatgcttgtgcaacggttcgttgcctagtttttcttgtgtgtggcccttctggttcaaaacatcagatttggacttttgagacaggtggatgcatgaggccttataataaagtagaataaaagttttaatgagaatgcttactcgtgttttgatgttaatttgttactagcttaagatcttttctcccaacagtgtggttgtataattttaaaggaatatattttggttttgcaagtgaagattagtttgtggtacgttaatgtctttgtgtaaatttagctacgcgcatattattttagttcaaaaccactacggttaattaattacctattaactagctagaaccacaacttgatctaaaattatgaacaaattcttctagcttcctttgtccactatgaatttcatcatttttgtctactaccactacgaaagataaaaggagaaaacatgttacgtagaaaagcacatgctcggagaacttttgaggtccaaatccaatgagtaataatataattaatatatatatatatatatatatatataaatatatatatcaaacactttattaataccttttttttctcttcatctctccttttatatcagatcatataacctattatattcatacttgtacttccctctctatttctctttagatgtcttaagacttaggttactataaataatttttcaaatccaatagaatagcttgtgtgcttttgatcttgcgtactagtagctctgagaatttatcatataaatacattaaattggtcctttaaaatatgtatacgtggcatattaatttaataatttattcttttaaatgtcacatagttatgataatctcttgcagcggttataatttgtatacgtggagtattctcttttttattacatcccacgactctcttttttcacatcaattttatctgtaaaaaaatattaaaaaattgtggaattttgattgagaaattatacatttgtaaaaaaaaatcttacaaaaagaaaagtgagaagaaaaagaaaattttgaaatataatatatgttagagaaagataaaaacataaaattatgtataaattggtgtaaaaattgttatatatatatatatatatattatatctcattttcatttgacaaatattaatcaatgtccactgattaaaaaattaaaaaaaaaattattaaaatacataaaattgtgttatacataactttttttatattctcttataacattcataataaatatttttaaattttaactaggatataattttaatttataaataaaacttgtctttcctatatattctctatctagcctataggcatctagctttatgcccacgcaaattctaaaggaacactaatctaaaatatattgatctgtcactctagaaaggagcaacccccagaattattcaaggatagcagttattggtatcaaacttttcaggcaaaaaatacaccttaagagcggtttgtctcgacaaagaagagcgtaaaatatgattttttttttttttcctttcacaaaagggcatttattaggtacataggagtatatctctacatatccacatattgcattgatttttctatatcaagccatgctgattggctaacagcgtagaatttcatctccaattaagtgatcgagtctaaactttgaagaattgccagaattgaggtaagcatccacatgcctatatatcagttatataaaattgataggctattcagaactcagtgtataatttgaagttcttccatgatataggacccggcatggtatctcgaattcaatgatattgggaaagaaggagatgtacatgaaactcaggacttgcaactttgctgctaatcatacatatatctcggttctaacttaatcaaggagtacgtctcgagttaaattcaaggggaatttttttttcgtctgcgatgatagtcccacttgactcaatctagattaatcatactcctatgtctatgtagttaattttaaacccaaaaaaaaatggtcacaaacacgatgctcatgcaaatggtttatcttttccaatgtaagactttagtcaacgtcttgatatcacgaagctacttcaattcctttgtctctatttccgttaaggcgttaactatttgtctatactcacaaacttaggccaccaaatacgcatcaataaatggagatagggatgctacttatagggatcgataaaagaaaatactgtactactaacaacgcttttttagagtggtagataaaaaaaaagattagttaaaaattttatatggaaatttgtcatatttttctcttgataaagattaaataggcggaaccctattaaaattcgtgaacatcaagcgggagataaacaatattttatgaaaatgtaataccccccccccacacacattttatactgtactatttgtaatagcaaatgaatcccatgaagagatctttgttgggccttgtgaatcaaacctcagcagaaagaacatggcccaacaccccctgtttgatattcgcatccccccaccttttcatcataattttcaccaatgtttttcattcgaaaaactaattctggagctgagctagattttttattttattcaagaaagtttaaaagtattactgtaaaaagatgaagtgactgataaaacaatgtttaatactattagtatttagtagtcgtactgtcaagttgtacaaaaacaccctgtcgccttacacaactagtttttttacctgtatgatgcaagaggaatacaaaaagtttgagtgtctttattttgcacgtttatcgatgaattattggacaatttttattttaaatacgtttgaaatgtgccaatcattacaggatcaatatatcagccgtattatctaacctgaactattcaacaatgtgatttattcaattacgaaaataggttagataattgttaaagagtatgaaaaaatttacttataattttattttttttattcaactaacgcctcaattttatcttaaatgttattatttttatttaatgaaaatgaacaattgagtaatatttactaataatatatttgaaatatataaaaccacaataaaactaatactgatacatgttaaaattaaagtataatatttaactcatactattcacccagtataatttatttaagtataaaaatagacatctacaattattaaagagtgtgacaaataataaaataaaaatatctctaatataacaatatgtgataaacaaagcctgtcagtatgtttctttgaaaaaaatagtacctaatgtaatttgtccaatcttatccaaaatgaacaatttaagacacatctttcattcgaaaaactaattctagagctgagttagaatttttttattgagaaagtttaagagtattactatacgaagatgaagcgactgataaaacaatgtttagtactattagtatttagtagtcgtaccgtcaagtcgtacaaaaactccctgttgcattacacacaatacagagtgcaaatgaaatgaatctcgagatcgacccactgcaagagagttttttcatgactaatgatggacgcgaagttagcaggattcaaattcttaacccaaaattcagcattaagaaagtagtttcatgtctgaaaagagaagtgaatatacgtgactcaatcaatatcattttattattaagtggacgatttgaacatattttattaaaacacctcccgtaaacaacccatgaggccatgacccaatactaaagctcagccagcagaatctagaaacaccttggcgatagctagaaaaatcatcacgggtcgccaaattgataacgaaattgccaaggttatgcattttagaagaaatggcttttgtacaaatgaagtatcttacaattcagcaaactaagggaactacactgatctaattcaaagataataatgtaattattgggcctaaagagcctaatgcccaaaaaagaattatacagaatgaatatctatcggaaaaagagctaccaaagcgaaagctaaactaagcagtccacagattcagctacatattttacatcaaaagcaatttatgctgaaatgattgaacattcttgtacgaggaggcaatgttgctgcaatgtgccttataatgggtctcaaatgaatcttaatgcatgctcaattacccatacaataaatatcctgttcgaaaccccaccaaatacctgcatccaaacagaagcacatcaaagatcagcacaggaactgggacggagagaatcaagacccaccaaataccgcttttaacatcccttcatatatgtcttcaaaattattaaggtttaagtgtggatgcatcatatttcaggcaaaaaaggtaaccagatattataaaactgcatcgtccaagtttatctataacaccaaaatgttatgcattcttcaatttacctagttaactattgtttcaggctttatcactaattaggggtggatgcaaataagagaaaagaaggaaatatataaatgaaaagtagattcacaacttaatgtccatgaagctaaaagggctcatgtttgttgcttcctctatattcatctgttcttgctcggttccaagcttgaattcacttctattcaattcaggtatcttctctcaaaaaatatcctcaatgttaagttcaaaacctttaagacagtagtaggctaatttttgcttgaaatgacttgaaagtcctatttgtttgtcatgattgttaatttgatatcccaaatttccaattatttttcccttgtttgttgttccaatttaattgctttatcatagagatgaagaatgtgattatcacattatcatgtttggattctataaattttattattatttttgaaatagtagaaactagcaggtttacaagtctaagcttcagaaataaattcaacccaaattcaggaacataacccccaacccaatgtgcccacgattttactaaggcgcacaagtgctctaaggggatagaaatattcagtagatacattgggtaaaaataagtttcagccgacaatttggacaggtaatgggtcaaatactcaccacgaaaattgcaccatgtaagaatcacaaaacatatacgttcaagacataatcaactgattacaggttgaaataacttcttgaattcatcataaaaccacctgcaaaacaagtcaaatcacttgagacacctcaaaagtcaaaacaaaaagaagaaaaattgaaaaggccaaaatatcaactctgattttattcagactttgtccagattgattaataatagtgtggatataccagtagattataatagctacactggtagtcggatagtgaaggtatgaacctttaaacgatgaattcaatatttgatttcaaaaccagtagttaagcatataaaacacaaaatgatgcaagaaacaaagaaacagcaatgaaatagaatagcatttatttgcattccaagcttatgaaataacttcatcagaacataaataaatagactagaaaagccacgtatttggtaaaacttggactaactgaatgccaaatatggcgaagtatctattgggttagcccatatgtatctctttttgttaatggccagttgaagtaaagtactcagaatagactcatggattatgttggtcttgttagccctgtaatgttttccgagatgagtaggttaaccgatgttgttatcaaaagaggccgttaccaaggtaattaatagtgcaatagcagcagaatggccactgggcattacagccacatccagtgttgttaaatagccactacagcagcactatagtgcttttgctttatggaattctttggatccacaatcatgactccatccactattgcggcagctatgggagttgtggttgaggcatgaaccctgcatcctctagtcatcttcggtgagtctccagccaattgaacttttgaatttataatatgtcaattttaggcatattttttatttgcatgcaacttatttttatgcatatatcataattcaaccactatgtgacttttgttatttgcctgtgacactatccgctaaatgatatagcagattattagctttccgccattttccacaatccgcaattgataacgctagccacattgttgtatggcatttttggggtcacagccaaatcacaaccttttcacgcataatcagagcatgattgttatgggcttcaaaaacccaattttgctcctgcagtagtgttgtttaggaggagggtgggttaagggtgaaaatgacatttactctggtcatgcataaaacaaaaacaaaaacaaaaaaactaccccccagcagcaacgcaccaacaccatcctctttctttctcttgtcaaaagacatcctcttctcttgcccacccacccacaccagagatgacctcttctccgagcgactgcaagtacagtgcagactgctcttctttcttccccacattccgcctgtttccaaggtaattaatacgacaccatagcaccgcagagcagccgctgggcactacagccacatccttgcgtggcattttgggggtcaaatctgtcacaaccaaattgcaagattctcacgtgcaattaaagcacaattgtgatgtgtttcaaaacccaattttgcccctgcagtagtgttgtttaggggagtagggttaagggtgcaaatggcaattaccctggtcatacataaactaacacacacccccccccccccccccaaaaaaaaaaaaaaaaaaaaaattcaacagcaatgacactaacaccctcctcttctataaagacgtcattttctcttttcacttgccccccaccctcactcagcagggacaactcttctgcggtgactgcaattacagttcggcctgctattctttctttgccctttcatttcagtctttggcttccagaatgtgctatcctacccactatagcgtatctggggttggtcgcaagattgattacaagggtttgcgtgagaatgaagggagtttccttcatcatatacatgaaagtccttgtttgtgattgtctgccaggttcaattgacaattaagctttcttgtattcattattttcctgttaaggtaattatctaaaatttacggagtttttcccttttgaaccaaaatttcatcaaatttcatcaaaatagaaaagcatgatatattcttaatgctcagtcatattggcaagcagcatgaaaatgtgtttcaatttccaattttccaccaccaatgacaagcctaaacgataattaaaagcattttatctcccttttcatactcagctatttgtttcatctccctgttttctaccaagaataccatgcgataaattgtaatcatattttctacttgatggctgcattacaaatacgaaaattgtataaaactatagattgaatgaaacaggcacgaagaaaaacaaaacaaaataaaaactctctagaatgatggatgaatataaagaaacaaacctgcaaaggaaaatgggctgcactttagaagtttcctcaattcctaactgacatcgcctgtcattttcttgtttaaatttatcagatgagaggacttcacatggccctcgaatagagttagccatttcagttctatcactattagattcataaaccttcaacaaagaaaacatatgtataagaaaatatccatatatatggttctgaatggtgagcatgtccaagatgtgaagcattatcatttgattggaatatcaaacaaaatagaaattaactgtataggttacaagttcaaaccaataaacagtttatggagtataagagcatgtaagccaatctagctttagataaaaactgatagttaacataccaatgacaaacttccacacttgcatgaatgcatttatatccatctaataaaaaagacatctattttttataattttatatataaagctgtatgtataaaaaaaaaaaaaaaaaaaatacctcgttgacttcagatatacacggatgaccaatattccctggcaaatcatcaggaaagtagcagtttgtcaccttaacccactttaacccagttttgcaatcttcccacatagactgaaaataaaaatggaataaatccctatgttaaaagttctataaatttataaaagtaacattccacacaagggttcaaatcaatcaaaacaaaacagaagcagtaaagtacaccaaaaacaacttttttgttattcatatctacttcacaatttttcagataaatttctacaggtatgacataaccgactgctagactatattggaaagcatgatgatttgcttgcctggagtttagaaggagttagtttcccatggctggtggggaaaagagcataaccctgcagtctatatgttactccatcaatacaacaagattggtaatactttttcttatctactagttgtactacatcaccaatccattctaccgcatgtgaactatctgaagataatgcagagtgctgtctaccatcagtattagttccagaagttccaacaaaatttgcaagtgcagcatcttggtcatcacgcttaatatcataagttaaactttctcctccatgaaattccttctgtttattattcataatattactgtcgacatgcttatctgatgatacttgagcattgtcttgtgacattgtatgttcaacttgaaaatcttgtgatgattgcaaattttcacacttagctggctcagataatttaggaaaagactcagataccgaagtctctttaccagtcaaaaccttagaatttatttgttgaacataattttcacctatcaaacaaggggaaggactagaagctgcactaagagatttcatagagttgtttggatcaggcttcttatcaatagcttcaatggtggatgaaatgtcagtcccttgcatatctttggtatctggtatctttgattcagatgacaactcaacattgtaattgccaccgcaaacagtttgaacagagctcccatttgttgctaacgtctgtgggatggcctttggatctacattctctactttcttctcagaacatggttgaatgcctcctgtattagaaggcaattttggaggtgtgtttgaggatctcatgacacgaccatattttggaggcaaaggctttccaccacttaaactcaagcacctcatacagtgccaatcaactctattatgaattcctctcaagactgatggctgcaggcacttcaagtgaaatcccttttcacaagcatcacagagaagtacagtatcaacctcattgacactgagctcacacatctgacatgtgaaagccttattcatataatcccttgatggaggagtccacgtgggatggacaggaagctttggttgtaacactttctgaacaatcttagcaatgtcagtatgactaggaatcaaaggaggctgaactatgtttgtggcccgcaatggctggtgcacactaggtaaagttccagtggctgtttgagtgataaatggtctaaagctcgggtctgttgttaattgtggccctgcccttgatacagttacatcaggtgttccttcaaccttgacagaattctgaacaggcaccttgttttctgatgcacttctagctaatgaagcagcttgagtctgtatagaccatgttggagcattcaccaaaggttggtttgctgataaatttgctacagttaaaaagttctaacattcagttgccagttccaatttcatgactaaaatgtcataagatacactcatacacattataaagatacaatagagaatagactaccacctttagctggaaaaaaaaaaagagaagaaaatgccaatagatagttaaaaccttaatgccagctttccatgacagttacatacaaataacagagattgaaggaggaaaaagacaaatgaatgtagtttaattccagactctttaaagacaaggaaaagggagcaacatctgctaggagattatatctattcaataacctcacaatagaccaattcgcctagatatacaccaattcagtcaactttcaaaattcatcatgcatcactccatggttaacattgaataaaacctgtaagtattcatccataaaattacagcactttattctgaacattcatttaatgttatgtgttttattgcttcacagtaaaataaaatccatatcagtgtgttcaattcacattctatcattcaatgtaaacatattgcactgtcaatcattcatcaatcataaatgtaactctaccagtccttggaaattggatccagtgaggagcttcagaggacaataccttggacttgcagcatgtaaggagacccatttgatcctccatcaactttgaactgtgggtgttcaactttaggcaatgctaaggaagatgaatttctccccaagtgactgccaggcatcacaccagaaaccactggtggtcttacttcattgccgatcacttgatactgcaatgctgcagaagatcctgcagaaacatggccaggaatagacactacggcacccatagaagggattgatgggtggcttgatttatcagaaggaaaaattcgaacatgtgatggcacacgattgtcaactggtccaccaatgtttgttggcaagggctgagaggtgtgagttgtagaaggtgtagaaggtgcagaaaatttctttgcttcttctatctgttaaccaaaaatgatagtaaataaagagaaaataaaggagaaaaaactaaccaaaagaaatggcatagcatcattcttagcataacatgcatattataaataaattaatgctcttacttgtgcatgaagaaataaaatacttctctaattaacagagttcaacattccaacaaactcaacaaaaagcccacttgacaaggtagtttaagatcaataagagtggcaacacaaaattaaccgaaaaataatccaatactagcttagccaagccaagtaaataaagctcattagtatacaataatctggccaaggattcctttttcctccataaaaaaacatacaaaacaattgcataagaatcaggtgaatttcgtgtgctaggaacactacattcttagtgcatgtttggtaatgcattgactacacacgttacgctcgttttcaggtcaatattgagaaaaagaaaaatgtagaagccacacgtcgttgcttctaaattacacgcgcgggatgcatatccaaacacactgctatcctcattttcctaactcggacacattcacaacaatcacgatagaaataatagtattccttaagcacctatcataacaaataattcaaaacaaccaacacacacattttaacttgagcagctcgcttaacgagatgaaatttcttttaattctacatatatgttcactgaataacaaaatgagcaagtcaaaagcatggtgagtgttaattgagcagagagagagagagggttggttaccttccacttagcatgggaatacctctcggcaatggacatcttgggagttcgaaaccctaatctctggtccttgagcttggagttcaatccgagatcctcaatgacggtgccaatagcttccctggcgacaatatccttcggagccaaaccctggcagaggctggcgagtttggcgcgagcctccctcatgagctcgacctcggcgtcggagggcttcctccccgcgcgcaccgtggccatggtggagagaaccagcacaatctccgccactctcttcaattctgcgccatggtcgaatttaggtttcttggcgcagcgctcgtcggagtccccgttctgaagaggcggaggctgctgctccagctccggctggggatcggagacggcctcctccatgggaggggaaaccctagagagagagagagagaggaagagagggaaaggaaaagaaagaggtttgaattggaagggttaattaaaattttggcgggtaagtgtgtgtgtttgagaaatgagatggaagaaggcgtgtaagtaattaggtagtgagtagtgagtttgtgttgaaagaaagagaacgagttgagtttggatggctgatcagagcgatccctagcgaggagagagagacgcccacagaatacaaaaataaaaagggcttttggctaattaatagtaacctctattttaactcctccccacccaactcgtaacgcgactcaccgagtttccactttccagatcaccatttaatataatgttaattaccattttacttcgtatagaataaatgttaagatataaaatatttttaaatgtataaattgttttcagatttatataacaattaatttaaattgagatataaagttttttttaccaatagtaattcattttgaaaattattaaaatttaattaagataaatagaggtaaaagaagacaaattgaaatgaataaactttttttttcatacaaattaaaatggattaaaaggtcaaaaggtccacatggccttgtggattaatgctacccctactctatttgccttaaatttaaaaattcacctcccccttttttttatgtaaccaaatataaacctttttcttgctaaatcatgtacattatcacgagagttgaaggtggacacacgttcgagttgacttgacaactcaatttgtcaaaattagaggtggtaaaagaattcatttatttgtgatttgttttgtccatccatgtaaaatactctagccgatgacaagttaaaaatattctaacgaaggacaatgaaattactcaaattaacattgagttgaaaatattttgattaatattaaactgaagttactttgatcgagatcaagttaaagttactttcattgaaatcaagttatagatattccagataaggtaaaaggtaatgttagtatgattcatgcaatcaatgttcattcattttttttattatcaaatatctccatataatctagcattttctgaaaaaagataaatctctaattagtaggcaaaagagatatccttaatgcacttctaataaagttggttaaagatgaaattaaaatttattcgtatattcttttgagaatttgagacctaaaaatcttactggtttgagattgcatttaacatgactcaaaagtaaggtttcggagttctaagttaacacacacttggatatcaaagataatccagagcaaacaatgacatcacacatgctaagacatctaatctacgatgccatacaaaatatgaaatcgtaaatataaagtgtatgctaagaagcatttcttattaagctggaacaagattgttttctgtaaatatacacgtggtctataaaagaaaaatgtatctatgttccaacatactgttattatagttgtttcgcacattggatagtagtgaagaaataaatgtttttattttgaaaaactagtttttgttaatacttgggaaaataaaaatattaattatgtatgatgtatccaaacaaaagttaatatattattttcacaaatttacatataaaaataccaatccctgattaaaaaataaagaacctgcagagcattccaaatccaataaggacgtttgactattggcagtttttccatgtaatcttcaggacagcatgatttacaataggtaaaatccagagctacaccaatgttcatgtcattcactcttcatagccatcttgataagttgctcattaccttattaccacttagtacacaaagcagacagatatctgagagcatgtttatgatacataagctggtagttgtttgagatagtagtctcctgagaaagaaacatcactacacacagtaatccatgggggagcatacaatatacgagcactcttaatggcaaaaccattaagaattggcagtggaattcctctcaataactgcgagtttaggtatggtatgacaacggtcttgaggacggttgatgtcactgactgtaaatgtttacacagttaaggagtaagattcaacataatagcctcgatatacaatcactaaggtttaacaatcatatatgtcaaaatataaatggagtggttgtgcacatgagatggagttacatatgtgctaaaccatgtgcagaattttgatttatgaatgaatcagtaaagtgaaatatgaaaggctaaaggttgtaaatgggttgaaaagttcttgatggttggtacacgttatccgcttattaaattattgccaggaaaaaaagatactgcatgtctaccacttccctcaaactatggcagtgttgtcatttgtaatattttggaaatagaccaaaacataaaccggacaccttgaatatatcatatatgtttaacaaatggttggcaactgtgtcactttcgcatttcacatgacaatgaatcaagtttgtataccactgtggtctctctaattgaaacagaaaacactcatgggttgatctagaatagtccctaaaaatagaaggaattatttgttcgtattgttaaatttcatccaattagtagttaaggtaatttggccatacaaataaggccactagaagtagcactggttaggagagtagattgcatggtttttattcctatgaagaagaggggagaagaccaagaaggacattggagaaagttgttcaaaaggatctcatgacgaatgatatctctgaagattttggtctttaactgggccgaatggtgtcatataatacatatagctgactaatgggataaggcttttgttgttcaatttcatatcaaaatacaaagctgaatacatttattccaatatacctgaatcaaattcatgtgcagtttccctattttactccatttcaagtacgtggaaaactttctcaatttaagccaaccagcaagattgtttcctacgatttccacagcacaagaagcactaaaatcctgtaccaataacaaagattaatggacttgttaaacaagataatgatcatgtgtcatggctacctctttaaactctacaaaataaataacttttaagaaatagtataatcttaggcatggacaaaaaaaagtaggcaaatctgaaaatttaatcagaagatcaatacaaggttatgtgtgtgtgtgcgcgcgcgcgcgcgataacatgatgacaaaaatggtagaaagcttgaatttcatatagcttagtcagaatgcagacacagtatattatgagggatggctatttaaacagtgtaagcttcataaaattttaaactatctacttcaatattgactttattaaagcataccaccgagatgcatgcaacaggtatgacttcaccatcttccagaacatcaattgttatgtctatgaaaatgttgacaccgatatctttgtttgtcacttgtatatctggtggagaagatacagagatattaagattcatgtcgtcatttggatattttttgtataattgtggtataaggaacttccattcagcagtgttcaaaagggcctgatcagggagttcatcaacaatccattgcatactatctgcctgagcacaagaacaacaaactatcaaaattatatttcagtttatgataacgtaaaagcttgaagtgcaaaatgtaattggagcaacccaataaatacataaagcctaatcaacatcagcactactatgttaatctttttctcataaagcatcagcccaattaatacataaagtctaatcggcatctgcaatacaaggtctatttgatgtcagtaagtaatacttttttccaaatttagagcaattccaacaaaaggttccatgaccaacctaaacgattaaagaactcagtccactaatatgtatgaataaatgatgcaagaaaacatgcaaactgtggaacaacaaagaaattgtttcttctgcagattctagataatgccaaagcctaaacaaacaagctaatgcattacaattcacttgaaatataacggtggaagaaatgcaacaagtaatatgatgctattatacatcacagatatagcttaaaatgaaaagtggaagggggaaaagagaaaactccatttattggactaagcaatgaaaaaaaaagggtaaaaacttcagaaacttacagtgaaataaaccaaggaaccggatttgaaaacactttcgtgtaatgaaattgttatcatctttggtgaactgtcaccacaggaagcagaaaggtctgatcctctgcggtaagcttgaggtaccaaaacttcatttcttcctgtgaataaaccattaatttctaattcaatagcagaatcactcagcactggattgtccacgaaagaaacatttagagcagcagtttcgtccaatgggattgtttttggaagagattgcaataaaaggtcaagagttgatatcccctcatttattttcttagaaattgcctcttcaactgcagatgctatatttcctgcaaaagcatctactagcctgcaaaaaaatagaaatatagctttatattccccagaatagtttttgttgcagaagataacggaaacactcttatctggcctcccagtttcaggtcccacactaaagattgaagtattggagtaaaattgaaacatagatctgggactatagctgttggccaaaggccttcccatggaattgtgaagccttaatcagcaataaaagaacataattgtctaagatagagcatgtgtaagaattcctaattatcaaaaaccatggcttaagaaggttccttacacttggtaaagccaagctgctccgccatgcaactttatagataaatctctaacatgacatccagaatccaggagaatcaacttaagagttccttcttggttccttaaattcacagtaagtcccacttgcaaatcattaaccttccaacatagcacagcactatagaatgaggaatataattgactaaacaggtataaaaaaaaaatatttgcacaaaagtacattactcagggttttggctatcagatactgaaatacatgtcttttattgtccatctcaagaccacatctttttctttcttttttaatatctccattccctagtttcaattatactgaattggtatgccttaacaagttggtcttactccaattgcaagacgccgaaaatgcaatttcaaccataacctccttatagcttccatagtagtacaaccaggctaactaattttttataaaaataaccaaattcaggaaaacatttattatttagttcaaggtcaaactttcttaattaaaacacaatgcaacaaagcaaattataagccaccaagcaaatcggtgtaacttacaaaaagataaagagtttaatttttacaatcaaccaatcagaaatcatggttaatataatttttaaagtagttattataaaagtcaacaaattttataaaacactttacactattagtatgtaaactatttactcaaagataaaagttatagtatgcagtataaaatgaaagtaacattctaggttcatacctttacagtagcagttccactgtccgaaattccaattggaactaaccaactgctaacagagtacctccacttcaaactcaagtcagctgtggcacctgaaacgacaagagcaatgcctgtctctccagtattaacagatgaagaattaacttggatatcattgatagtgatgtcagaaagaaccactttggcttttccaacaagagggacttgcacagtcttctcaatttgtggcagctgagactgaacaatagaggcaacagcttgatctatcagaatatccttggcaaaatcaaggcctttatcagatatgaccacagagatgaaaccctcttcatcaccacttgtggaggatgaaaggaacagaagggatagaagaagaaaacaaattgagggtgccattcaattttgcaggtgtgagggatcaagccaatatctttaagcagaccaagttattgaatcttgagcaaaacaagttttgactagagcatggttaattcttcatgtttatccagtgaaagatgaaaacttaaacacacccatatgatgaaataccataccaagggaaacagttatacaagttttcttactattttatatgtggaataatgaattatatcgtattggattgaagctgaatttttgcaaacaacgaccaggaacagcaactgtgaatggagacgtagcaagaagtggttggttttggatttttgttaaaaaaatcattattaaattaacatggagatggcatagtagtgatcattgattaatataacgacatgtgagctcgagacccacgcgacctgtaagttttcatttttacttaaatatgtttttgattttgtaagttagtattttttttttatttttgtttcttatgagtttatttttataatttaagttttaagttgtcattttatatttttagtctttataaatttctattttcatttttaatttttataaatttacattttttaattttaatcactttaagattttaattttttatttataattcctataaattcatgcttacatgaactataaataaataacatatcttacatagatcataattaaaaaaatattaatttgcagaaactaaaatttaaaaaaaaaaaaaaagaaccaaaaataaaaaaccactaacttataacaacaaaaatatatttaaatgttctagtttttaacttttgaaaatgcattattttacaatattcccattcttgaacctacatggtttaactttactcttgtacaagtacatacaactcaactaagtaaataaaaaatgttttatatttttgccttaaattaatgttgtatccttctactctatcatcatgctactttatacggtaagtattgaataaaaactaaatacatttaatgtcttgaaaatataaaagagatttaaagcttaccgtaacaagataaaataagaggatataataaccaataattgaaaatacacatgcacctcatatagaggggcgcgaattatttatagcttaaatgtaattttggatttcttcttttattaaattcgcatttttagttttttatatttaaatataaacatttgattctctattttaaaatttttataattttgaacaaatcctcaattttgtctatattaatttcttttatttcttatattttgattaattaaattatttttgacaataccataaataaatatattaagtttatagttcaattaattgtaataaaataaacaaaacataaataaaattgaaaattttaccaaaattataaattttctaaaatagaaaattttaatatctcgattttaaaatatatgatcaaaattgcatattaaataaaatagataaaccaaaatcatattttaattttttatttatttttaaaatattactcaacttttatcacactttaataactcagacttttggctaaaaaaaatacaataactcggatttccaatcccaacgtaatctaatgaaagttaaactttcttgcatgattgaactgggataaatcatcatttagttaagttggctttcatagtcatgagcttttgcattctaggttttctcacacattcttgtctgctcaggcttcaagcattttacacttcagcaaaagctcaataaattactgctaccctttcacacaataaaaatatgtttctcttgtgtattttttaagattttttctaaattaatttaaataaaaaacaagttgtttaacttaagggaaaaataattttaaaaattaaaaatttaattaagatttgataggcaaaattaattttaaatctatcatccaccctaattaacttgaattaaaaatattgatgatgtgctcccatattctttttgtggattagtaacactaaagctcatgaaaatttataaactatggaaagaaacaattccgataaattttaatagagagaggacccttttctttgacaagtgaaccttcaaattcaaattcaaattcaggcatggcaatatttcagtaccaaccaccaggtgtaaaatttgagcaataatacatttacacgtaatagataaattgaagataacaaaattttatggcccaaactttataatcaaaactcaaccagtgggttttttccacagattatatatttggaaagttatttcccaatattccctgattccaatccaatccttcctaatcaagttttcatatatgcaaacgtcattttccctctaaaccctctgtccatcacagcttttgaatgaacaaaggtaataacaacatattgcaaatcacatacaaattcacaatactgctatgatactaaagatggttgaagcagacggatgggatgcagaactcctgcctccagaactgatttgtccttcactgattcctcccgagtcagacataatcatctccttgattcaagtctcccacaataatttgagcatgtagattatagaaacaaagaaatccacttcataaaaagtaatctggtgctggtttcttagcaggtgttcctcttgattcctacattccattaaaattaaaaaaactgaaaatcaattgacaaatttcacaattaaatttccccgagatcatatgttcgcgaagaacaaggaacaccaattgtttgcttaaacatgcaaagatagtgcaatccaaatgaaaacaaactgataagtaaacaaaatgggataaaacacattcttatagtactgaacccaaggtcacatgaaaagcacattcttaaccacatgaatcaatgaatttgacaatagagagattgaagctcgtattgctactatttgagaaaaatggtatagctcactctgcgtacgaattcataatggcaataaatatcaggtgactttgcctacaaacctgtggagcagcttcaaacacccggaactgcttattaagatttccatccaactccagaattgcagctacattgccacatctatgacaaagatgaaaatgtcttactaaaaacatagaacacaaataagaaaaatcattttaatagattagtggattaggtacctgtagcaataatttggagctgaccagacagtaactatctggttattgaacatccatttatatccttccattaccaactgatgtgcacgacatatatagtcaatgttattggagtggttaaaggaagtaacaacactgccaccaaataagtaaccagcaccgcggggactaagaccccagccatccacaatatcttcaggatctgaccataggaggtcacacatggcaccatcatgaggtacttcttgcttccgatcaatagttcgtatctaaatattaacaataaataatataaaaatattgctagtgtacaatctaaacaaaaacaaacaaattagggtaaatttcctgacctgatccagtgtagaaatggcaggagaaagaccaccatgaacactgaaaatcttgttttcaattagagcggacaagctgcagtttgccgttatcgacataggacactattagtggaagagtcaagctataccaattaaatctgtaaatgcagttaggttgtcttacaagcaacttgacacagaatgtttccatttatacctcttgtctcttaatttttggctatttctatgcacgagaaacacttgcattttaacacttttttcaacactcctgaatgttgttaaaatagagattctatctaggatcgagaagtgatgaaagatcataaaccatgtgattgtataggattaaaaaatcctaccaaaaatataaaagtatgataatgtaattaattaagacgcgtaataataccacaagacttcgataacaattcggatatttatcttgtagtaattgctttattagtaataatgcatctcgttttatatttgataatgatatcgggggaggggggaccagaaagtgtactggacttagaagccagtctcaagcccaattcactacttttataagccaaaaaattaaggacagggaagacgatcagattgaaatcagaaatgctctaacaagatgcggagaacagaaccactcaacactgaatcactagccactacaaagatcagaacagagaaacactccaacccaagtcaaaatgggttccaaacaagaacagagactgaagataagtatggttaccaaggtcgaacacaaaaagagaaaacacggaaaattctcaatttcaggtaagccaagccaaaacgagcttgaaatagagaatagatggcagagacaagttcgaatagagggagatcgcttgattggagtgtcacttgaagaaaaaggggagagattagggcaaatatataatcttttccccaccagttcataaaacctaacccacaatttcacggcacactctgcaactcgttgaggatagatcattccacaagctcgtgacctggcactgtaatcccattctcatacaattctacatctaatcaagagcacagaatagccacacaagtagatcatacgatcctacaggtaagattgacaatactgctctctttattattgaattgacattatataatacacggaatttacttaataatggaaagagtgttgagaaaagagtattaaatatttgctagcattttcagtctatacatttattagacaaggttgtcaaaataaccaatcaatggattttaaaagcaccctctcaaacttttttccctttcaaaataaacaaagacaagcgacataaagcatccttaaggagaagtagctcccaatgcaatactcaaatctggtgatctatcagatattagcaaaccttaaatagtcgaatatttcagtacaatatctccagacattgactgaaccgtattttctaaggcattcatcatagaatccatatacctgtcaagtgatggatattgaataagtaatctggagtcataaaatgttgggaaaatttttagtgtctttcccacttttcttcatcatgtttacaaaaaggatttatttcttttttctaatttagctgatagactaacctgggtgatctgacggctttcatggtttcccctaatgagtgttatccgatccggatacctcacctgattgtatgtcattaattagttacaacaatagcgaataaaatgaaagaagcatcattaagagcacaaaaagaatgagtagttcaacatctgacagaacctagtagtcaaaagtaaaaaaaataaaattatcttttgtttttcttctttagttcctttagaaaaatgataagaaaaagaattcatcaagagacaaagtagaaagaatgaggacagtgcatcctctcagaaaatagattaaagaaaacagcatagacaaaataacataagctcaaaaggaaagagtagtccttcatattataaacaaacgagtccctagagcaagcaaataaaatcatgtctgacgagattgaaaggacaaaactgctgagtaaatttcagtctattcaaatccaccaaacaacagccaaaagcaaaaatttcaaaattttattctactttttactgacaaaaccttagtaccagaccagattaataaagcatcaccaataacaaagcatccttacattactcacactatcccatagaaaaaacttgtagaatttcattccaacagtagcaaaatgtgttcccaaaaaagaaaaaaaaaattaaaaagttaacacaaagacaataaatgcagtgaccaccaagcccatggctcgaagaccaaccacatttctgtgataatcatagattaaactgactgggacgtttttttaaattgtcaaaaggcacccaaaacagatctaacatacagaaaaaaaagcataaaataaacacataaaccacagaagatgcttctaacttgcagttttataagagaagaagaataaattatcaccttaagagcgagcagaagcagaaacgtttcaaccgagtaaaaccctctatcaacaaaatcccccagaaacaagtagttagttttggggcaatcccctcctactttgaaaagctccttcatgtcataaaactgaccgtgaatatcaccacatatctacacaaagaccaagacaaccaacaaaactaatcagttgaacacaacaaaaaccagaagcaggatcataaagaagaatgaacacagcagagtagaccccaaatgcacagtaatagaaaaaaatgaaaaaaaaaaaaaaaactttttgtgtgcccccatgacactctggacacagaacaaagcacaaaacaacgttttttttacgtaaataggtcaaaataaagagacacaaaaaacaccaaatcccctcgaaagaatgacacttaagctttctctcatcactatatatgacatttataacaagccctatatagattgaagtcccaagtaaagtagttatcaactaactaatcgtattgaactaaaatccaacgaggtaattttgtttagtacgtgagctgaaatcataagtaaatcgaaacccagaaagaggaaaaagggaaaagagtgacgaacggtgacaggggcgtcgaccctctgaacgttgctctcttcgacaaggatttccatggctttgaggcaaagcgccttcacttcagactccttaagaggctcacacctcttcaactgctctatttgcctgtccaggtctgaagatgacatctctctctctctctctctgcaaccccttctcccccctctcctctcttctcttctcttctctactgcttcaatcttttccctttttgcaatcaccctctttattttctaatatatttccaaattactcacttttcatctttttttttaatagagttctgcatcagatcttatactctttttagttccctctctaccttttttgtttttatttgcatatctctcggccacaaatcaagattaatctctctacttaaaaaatatcaatttatgaccaagaattaggactagtgtctttactatatttcttaacaaatattctttcgtaaaatgaaattgaattcctaatgacgctagtcatatcgcaccatttcgataatattttctttctattacagtaaaaaaaatataactttataatatcttttttaaaataaatcataaatatttgaaataaggtaaaccaatatttataaaatttgatgtaataattaataaatgtttaggttattaaagtcattgttcgaaactgtatttctaatcaaaataattgacaataaaaaaaaaaaacttgatttctttttacacacatgcaactagaaattgaaaaagcagctgtcaataatttataaaatgcaaccaagaatcaaatgttgatagctgagtgtttggttaggcattagtaggtcttaagtacgtctaagtctgatgtttaatataaatggtgtttggtttgatagtaaaaccacaatgaacaaccattatcgtgatgagacctggaaaaaaattgaagtaatttaatgttgtttcacaatcaccataatttttatcacaattatatatgatccataccagagtcaccccagatagtagttttcatgttttttttaatgtattttgatgtgaaattaagaaaaaggcatgtaaaggaagcgcaaacaaacacactttgaaaacatgatatatcaaacaattatttgaagttttaataaaaaaaaactaagaaatgtagatatatcacaataaaattatttaatttgacaacaaattgactaaaattctcatacaaatagatttttaatcatattattattatcccttaaaatcatattattattatattactaaaagaattactttggtagtctaaaaaagttagtggacaatattaagattatacaaattattcaataatattaagaatgcagttattataatacactgaaagtgtaaaaaaattgtcattcaattacgtattattatatatgctaagtttgatcttaaaataattacgttaaaagatatattgattttttaattatagaatagtgtaaaaataaaatatattggtttttattaattatataatagtgtaaaaattatactgataatacatgacagttaaactcaaattatttttctattaatcagggaaaatattattaattgatgtggtaaaaaaatattaacatcacaactacgaagtcgtcaataataaaaaaaaaaaaaaaaacacttccgaattgtttggaattatttaaaccaaatcaataagatgagagataaagtgaattacaaaccttattacatagcctgtacttagcttgtatccatgatttgaaaaagataccaaattaattgaaatcgagtctaataaaatttgaatttcttatggatgagtaacactaaaataataagacaaagttaccaatacattgaaataaaataagctcactaaaataatagaactatatacaggtattttgtctgtcgacatgcccttctcgctgtataagcattagtataaagaaaatgacaatactatcaaatgtatatccaacctttatagcaacttttacacgagcatatataatgacacaatgattgaatttttcttttgataattgaatgaagaacataaataatgattaatagtttaagttgcagtaataaaaaaagatcataaaatatacactaaaatcttaagttctatatcattcgtacttatatattaataaaaaattgctcaagtctttattagattaaaccctcaagttgcagcttagctaaagaaccatacggaactaattaatgacttgaccatgcacatcaatgagaaaatcagaaaacacccacaagaaaaatataactactttccaagtgtgtatatagttccaaatagaaactcttcctttcttctacttagcttccatgcatacaaggtacaaaccgtagagttcaagtaacaaatacatatggggagaaaatggtgtcatctcttgggcattcagagaagaaaatagaagagacgtgagtaattaatgtgatgcaacaaaaaagacaaaagaaatataaaaaatacaaaagaaattagaaatatgtaacaattgtaatctatgtgcgtgtgtgtgtgtttgatggtaattttaagtgttgaggaaatcgtatctcaatacacacgtgtgtgtatttgatagtagtaactttaaagaaaagaaaaataagaaaatggcatgcaaagacaccagcatgtaattttgaagaacttgagaaatagcatgtcaattaaagtttacaaatattaaacgtttaacagtctataatatatatgcgacgtcaaggtttacacacagaaatttaatcacagaaataattaagactcttctgtgtggtgtgtttttttaattttggtttttaaatatgatttttaaaacaaaaatgtttggtaaaaatgaaattgatatctttactcatctttattttcaaaacaaaacaaaaaataatttgtggattttaattttaaaaaatcacacattctctacatttgataatggttattttcattgtgccgccatcatcaccatcagtgtcgttgtgtcatcgtcattactaatattattgttactatggatcaatgtcttcatcattgtcattgatatcaacatgaccaccgctactattattattatcattaatgttaccgttatcacataaaatcaatcttaaattaatattaataggatataaaactttcaaaatgaatttattttaaaatttaaattttgaggaaaaaaacctaaaaataaaacttggtcatttctttttaaaaaaattgaaactaataactaaaaatcatccaaacatgcctaagaaaatttactttgtgatgttactgtatttcttaaacatttttttttacatatttatcatatcaaatacaatattaattacttgatattttaataatgaaattgataaaaatttggctttgagcctacagttaagagagagagagagagagaatctgacaaaattatcatcttgtgaatttttttatagaaaaagtctaagccatgcacttgtttatcaaagaacatagtgattaactaaaatgtggttggtatgagtaaaatttaacttgtaccacttaagcaatgtatttaagtcttgtagataaaattgtgattgaataaagaggttctaataaaggtgataaataagatttattaatataacatagtcatcaacaaaatcaataatattttacactattatcataggaaaaaaataattaatgagtgctagtaacctattttaaaaaacatttattttaaagacaagtgatcattgaatatttgtaattgaccatttttattttttgtaagttttattcatgagattgaataatatttctttttattatgtttttttacttattggacataggtggaataatttaaagttgtgtttatgaagagaaatcttgtaaatgtgtttgaaactgagattgattgccttgtattaagatgaatttataatttgaacttcttgatgcatgtatttttgtggaattttggacctaatgttatgattaattttggtggatataaggaatcagagtactaatgttaatatgagggtgcgttctcaataatgatgaagctagaaaagcattaggttgaagattttgcgatgattgtttggagcatctggcaaggatggaatgaaaaacagtgaagataggatgtgatggaaacctcgatcgaggcagattgtggacaggcgatgatcggaagaaagtagttgaaaatcgagagcatactctggcaaaagaggaactaagagcatgatttgaaatattttttattgaaaaagatattatattttcagtagaaaaattctcaaaaacacttttaacttatatccaaactcatcgttctttgatgaacaaggaggcttcgggtatggtatgtgcccgagagacaatttcggacaactttgcctacccttagtggaatggaaaccaactaatcttcctgtccgtcaaggggactcaattgttgtgcatgcatcaacttgttgcaatatggactccttctggtgatatctttgaatttgacaagttcaattatattattaattcaaccaacaaattaaaatcataacatcttttaatacattcatacattatccaacaattgttttcttttaaatgctaaacattttattagaagacatacttgacacagatagaatgtgttcaagatcaatagatccccacccttacaaaagcctcccaagtcccaaaagtattctaccctgtaaaacctaaaaatctacaactgttctttttcttttttacatttctcttctgcgtaatactgctgctatgcatattaattaataaaaagatattaagtgagttagatgaataaataagtgaaggaatgataatgataatgataatgatgatgaataagtagttatcataattatgatcataaatttaaaatatatttaaacgtgataaattaaaattaaatattcattttctaaaacttataaattttttttttttaaatttaaatttccaaaataaataaataaaacactcaaacatgaactccagaaaaagttacatttatttttaatttttttttttatgtgttcctagttcctaagatagagaaaatgctcgcgaaaatgacaccttaaaacgacgtcgtggtgaatgaattattcgaaacctttcatcttccgcaatcccgtgaggtaaacgacggtgacgattggtgggtggcgccgtacgcctcatcccatccatcgccatcggcaccttcctaaaacgacgtcgcatccatcaccccttttctcttcctcacagtcacagcagtggtagcttcccaaaaaagagggtaatttcttatccgatcgtttcccctctttactctaattccgatcactttcggttatcaacacaattctccttctgaactgcactctgcttcttcttttctttgaattgtgcgttttgtgtatgtctgattgtgaaattagctcatgttaaagatatcagcatctcgtgatgactccatggtttattattaccctgtgcgatcatgagttttaagggttcttcatgctgttctttcatacttgaattgttgtagtaaattagtaattaccagcaattcctttttcgtactcgctgttaacagcaattctggtttaaatggagaaaagctttgttgagataagtagtttaatttgaacaagggtactggtaaatttgtgtatgggttgggttgtactaagcaaatagaatttatcttgtgataatcatgtcccataccgttttgaagatttctaggcctttctagtttatttattaccgggcaattctttagatgcttccggtgtttttctattaaaattagagtttcagcttggtaacatgtgctttatgatttctatggtaaaacttaaattatgattggaaaataacaccgaaagtacctaaacaaccgcatccaagttttttccacctgttaattgttgtgctatttcttcatttctccgatgtaaacatcatatttgtttgtttttattttttttctctcacttttttctttctttcaggtcaatggcatcttcttcagactcatgggtgaaggaatataatgaagcactgaaacttgctgatgatatcagtggcatgatttctgagcagagttcatttcctgcatctggaccagaaacccagcgtctttcatctgctataaggagaaagattacaatattggggaccaggcttgatagcttgcagtcccttttgtcaaatcttcccagcaagcagcccatgtgagtgtgtaattgttgattatgctgattgaaaaaggtcatgctgtttattaagctacgtggtttaaaatagaagaggcaatgttttcaattcagctgtgaaggtgtatgatgaagtttgcactattgttttatgaagtgtattttgctgacttgacgcagatctgagaaggagatgaatcgtcgcaaggacatgctttcaaatttgagatcaaaagttaatcagatggcttccacgttgaacatgtcaaactttgcaaatagggatagtttgtttgggccagaaagaaaaccagatgcaattaccagaacggttgacctggacaacaatggacttgttggacttcaacggcaaattatgaaaggtcagttgattggattgtttgaaaatatattgcttttaatctgttctttggatctgatagtgcattgctattcaagcagaacaagatgatggctttgagcaattggaagagactgtggcaagcacaaaacatattgcattggcagtgaatgaagagctgaatctacacactagactaattgtatgttccctttgtgcattaatttttgttcttcctgaatctttggttttgatccgagctgaatgatgttgtgtaatctatgtagccaacctcagctagtggtttgttgtttcccttctaaaactgaatcttttctttttgtctttgtctgccaggatgacttagaccaacatgtagatgtcacagattctcggcttagggtaacactcttatcgtaaacttcattggggccaaatctcttgttaagtcatatcaaggttaaattatgttaatattattgacatttacttgctgcttatcttttatgtttctgttgtgaaaacagcgggtgcagaagaacttagcggttttaaataagcgagccaagggtggttgctcctgcatgtgcatgcttttatcagtggttggtatagtggctttggttgttgtcatttggctgttggtcaaatatttgtaatgaataaaatacccaaacttggcaagagtctgcttttcatctttgtttctgccgtgtgcactaaagaatcataaccaggtttcctgatttctcttggtacttttccaatggaatggaatttgttgaggtcgtgaaaggcgatgtattgtattgtaattgccatatttaggtgttttatatatcgtgtgtttttctcttgtacaaatatgaaagtgaatgctactggctggagtatcaatgtggttgagttttcacacatttctccgtgagattgtgctcaagtattatgtacgtgatttgcattaatatcgtgcaactttaatgtgcaaccacaacgaggtacttaagttaaatttcttaaatcccatcataacatttcattttttccctttctttttacacaatttaagcaattttttctttgatgatgtaatttcgaaaaattcaataaataaatcctacaggttactctactcctttaatcttattatttaacttgaattttttgttttgtttttaatattttttttccagctattcaaaactttatttgtaatggtttctagattatccttctcaaatgcattgatcattcaaagaatcattgataattcaaagaatcaatataacgtttttcttataaaaataataactttatcactttatccttagatgacatttaaatgcattctattgtcagatcttcacacattaactataagaattcctcaatgcttgatcatgatgtaatatcacttaattataaccttccctcgtttttttccatgggaagaagggaaatcctaaggtaagagggaacaagaggatattcatattcaattcaatttataattcattgttatcttaatctagcaaaaacgattcaaggatatattttgtttttattttcctttcatttgtaattacaaaaatgtcattataatttctttgtttcatgttttaaataagaaaaaagggttatatagtgacggggtaaaaaattttatacaatcattcaatcacaatctatcatatatgataaatttgttaatttttaaaataattattttaaagtaatttaaacggtgattcggtgcatagatattaaactctttaaagaatgtctagaaaatggtaaaaaagttttttattacaacttgttatgcaaatctgataggagtaggaggtggggcaaaatgtataacaggagggtcaattagtaaaatacatttagttagttagttatactaaatgtgggagggtcacaaatagataaataggaggtgagtgattgaagaaagggaatccagaaagtattaggagagtggtgaacctcgaattcactattgtattgcagtatatattctccaatattcaaataaagattcattctttcttcttttaaatctagttcagttcctatcactcttgaataaacaaaataaaatgaaaataaggtaattattttgtacttaaaagtgaaaataaaatcacaacatattctcaaactaacgcttttaaatttgaaaagaagaaagaacatcaagagaatgatatcccactaaattaagcatcaagatcattgtactacagaatgactacaatataataattggaaaaatgaaaagggtaaaagaaccatgaaactaaaaaaagagcttccgtggggatggtctagattcaaccttgtttgaggacttgggggaggagggactgccctgctttcttggccctcagccactttgtcaagcagctttgcagcccttggatctgttagcaacttcttctgaaaagactgtgagaagccagttgcaatgatagtcacgtgaatctccccagtgtagcgatcatcaacaacagccccaaatataatattagcagaaggatcagccaaactagtcaccacctataaaaattacacgtgttaaggacaaggcaaatacgaagaaaaggtaggagtgaacccggtacgtataccaccatacagcaaaaggcggaatacagcacaaactgaaaagaaaaacagacccctgagggaaatattgatattttccttttttttctcttccagtgaaaggttgggtagctatccgaaattcttgactagatgaattccagaggaataaataacttttttaacatgttaaggtaaaatgaatgcaaaaatataaccataacaaaaaactgcagcactatacttgaaatcataaacacaaaatcaagaaacattataaggttagtttgcaacaaattcacaagatcaaaggaataacaaaatgtttcttaagcaagtggtgacaatctttaaatacctgagaaaccctgttcacttcctgcagggttatgtcctttcctccagtaatattatacactaccccagtagctgactgaatagatgatccaattaaaggagccaaagtagcctgttctgctgcttcttctgctcggtttttacctgatgaaacacctactccaagcattgcagtcccagagtctttcatcacagcttttacatcagcaaaatccacattgacaagtccaggtacctgcaagaaggcacaccagtttataatgtccagaaaaaaaatgcatggacatacccagacataaatgcaaagccacaatgcccaattatgaaggagaagtgagccagtgaccactcaaaagcactaaggaacaagtagggggagaatagttcaagctttttatgtttcccttttctcctcgcaagtagctgatcttatgggatcagcaaggaacttaaatcatgttctagtgtctgaataaaaaaatatgaatacatagtttgccaatcaactcactgttataatgtctgatattccctgtactccttgccgtagaacatcatcagcaagacggaaagcgtcctgaagaggcatctgctcatcagctatatcaagcagacggtcatttggaatcactataagtgtgtcaacatttttctgcagcctttcgatggcttcaaaggcctgaagaaaaccaaatgcaaactagagacttattttctagatttcaaacgacaaaatacaagtttcagatgaaccatagactcttatctgctagataaaataaatttcagacaacaaattatatatactggatgacacataacttggataacaaactatatggtgtgtttggaaaatccattcatttcaacacaatgtcaaaagatgaatttccaaacacacttttaaccagaataaaataaactgcaaaggaagaagataagtgatatttttcaacatattaaaaaaagaaggtagtattaaattaagagcaaaactaattcagtagtcacattcccaaataacgagaaaaaggacacctgcctgcaatgatctcttacgcccttcaaaactgaagggataggtaacaacacctacagtcaagtagcctgcctcttttgatatttgggctacaactggggcagcaccagacccggttcccccacccatcccagccgttataaataccaaatctgatcctttaagagcatcagcaatagcatctctggattcctccgcagcttgttcccccaaaagtggattcccacccgtacctgcttgtctatcaggtaatttgaatcaaaggccacccccctcaatttgtcaacaaattcagcaaagaaacaagactgtagccacaaaaacaaatcacatcatagtaaaaactatgcaagtagagtgcctgacctaatccacgagtcagaacttctccaattttaatagggttctcagcagcagaatttaatagtgcctgagcatcagtatttatcgcatagaagtctacaccctgattgaaaagaaaatgccgcagaattcaacaataacatctgcattattcacttggtggcagcaaaacacaaaggcgaaaaactagatgcatttatttaggtgcttttgtgttgttctccaatcagaattggagtttcaccttggcaacctatgccgacatcgaatataagcatttattatgcaaacgatcgaggtgaaactctaattctaactggacaaaatctcctaaataattacatctaagttttgtccaaacacaaatggtatcttagagaataacgccgctggctaaaaattaacattggattaaataagtgaatctaaaatgtgcaatcaagataaaaaagaagaagagtaaatagaactgtcattctaatttctaataactattttactacaacaataactattttaaagtggtataacctccaaacacaagaagtaaagcattggagtcactacaaatagaaagcattgaaaaaaaatgatattgataataaccaattatcgatgttccaaattgggtggcaaagacaatacccaattgacccacctgcaaaccacttccgatcatccgattaacggcattgttgccgccaccaccgatgccgacaaccttaattttggcgttatccacgtaagcgtaggagcatctcaccgacccgaaacgacgacttaggcattgaggagcaatttttgttgttctggagttgaaggaaacggaagttgtgagtgcattgtggtggaatatagaagagcatgagagtgagagaagctcgtttgggttgcggtttgtgaggggatgaagcatagccatttttattttttgttctctctcactcacggtcttttttttttttttttttttttaaaattagggttttagggcaaaatgaaaatggaaagaaattgaagctgattaccctccaattttgagtggattttgtttacttggttggattcgaatcacatgaagggacgttgtttattaacagttcatcgttacggaaagcgacgacgtcgtttttcactccactcttgtctcttgctcgttggctcgcatgttacaataaagaagaaagaaagtaaagagtattaatcattaataataataaaattctagtaaaaaaagcattaataaaaaaaatttaaataaatctataatctataatcactaataaatcagttattaacatactatatcaatttaattgctgtaaaagaaacacagacatacacactaccaatttaattgatgttatgacgtgtcttgaaatattttttctataaattttcttttatttaaatgttttaaaatgatggtatttttatattttattttaaaattttagtcaaatttaaagtatttgaagaaattattgaaaacttattagtatataaaatttgaatccaattgtttatattaaaaatttctattaatctattttctcttaatgcgtcaattaacgttcttggtatcatacatatcatttttttcgtcaaatgctattgtaacatcttaactagtgtaataaatcgggctgagtattattttttgatatatagtttttttaataaaaaaaatcaaactacgcagagtcttatttgagattcaatgcacttaaagttttcattttataaaaaaattctgtattttaatatataagagtaaattgagatttaaaatcaaagaatctaaggattcatgaattgtaaattcttaatacatgtcaatctttttaataataaaaaaaattaaaacctaaaaacttaagttagatgttttttgattcatgcagataaaaaaactttcttccaattttttgtaggagtaaaaactatttttttgaaacattagattttattcttgaaaatttggaatagtaagttaaagatttatttgtatctagaagtttaaatcaagaaatttaaatttttaactggaaaatgttttggtttagaccttcatgtgcaatttcaattcttccttcttggaaagcaccaccttaggcaacattgtagtatgagagtgttatacttttttttgggtacatacaagagtgagtatgaatatgatcgatgtacttcatttgcctcgcgtttgcaatatttgttaagaaaaggagaatatatttaatagtaaatggtagagtgttaatagcaaaagctgataaacgtggcccaagaaacccaaataacaggataggagggaataagatgggcccatatgcgtgcaggtataatgaatcatgttcaatcaatcagtggccatgcgaggtgataaaattcaaatcaaaccaaattgttaagaagcttcagatcactaatacgacgacgcattaccggaactaaggggtaatgtaaaaatatgtaatgttgtgttgtgttgtgtcgtttcgttttcactttcacgttctcaaattttgtttgtgtctcacaggaattaggatccgttatggggttctctgtaaccacgctaattttcgcagtgattggaatcgtggcgtccctttgtaccagaatttgtttcaatagaggaccttcagctaatctgtatgctatgcttgcttcttcatttctttctgggacttatgaactaatttaataattgctgttgctaatcttacacagattacaaataacaaattcataatctcgcataactcatagatctggaaaaatttgttattgaaggaattgtgatattgccaaacatctttgtggatatgctgctctatttaattaatagctgattctgttatgtcgccttgatgagttttacaatgtgatgtgattgatgtatttatgtttatattttagtttgtgtcaaagtttttttgtattcttgaataatgacttccttgaattttgttgtgtctcatccatctctttccatgataatgtttcctctcacaaaattattgttctctgtatgaactaatatcttattactttgttgcagatttcacctaactttggttcttactgctacaacatgctgctggatgatgtaagtacacctttgatttgcaagttcttttaattttcatggagttagaatagggaattgctgcactgtacaagttttgttcctgagcttgttgccccagcaagctgttattcaattaattggaaaaggaatacactaaaatcaaagttttcattttatttcctaaatgaataacttctccggctgaatgtgtccataatcagttctgctgaagctgtttgtgtacctgtccttttactctccatgaccatgatactgccacatgaatttggagtaccttttagttgaattattatgtgtcctgtgtaacagtaccaaacaaaagtaattgaagaggaatagatgaacttttcaaaatcagaatctgtttaggcaatcatgcctgggcatacccatgcctttggtgctttactttggtcctaagatgggactgttcaccaccatatttcacaaggagaccaaaggatatatgatgggaagctttggcttgtgcttgatgcttaaattgactgtaatataattgtagtgatgttaagtggaaatgcatcaaaacttgtgagtagtttctgaatcaagaagtcaaatgcttgaaaagttatcatttctctgatataactacttatttgctgtctgacagtatgtccagcataattaagggaggagggaaaatgaccttttgatggaatgagcacatgctttgctgaattacattatttttattttatttttttggaaaagggggaataccaaaatcttttatagtctttatcaattaagttcattttatttctcctggtgatgtaattttcatagttctaaacatgcctgccttgagttgacaaactttggttcattaatttgtgattacattttcctttggttcaatagtaattctaactggtaaatagccatgtcctgttttattttccattaagctttctttctctttttgcttacttttgttcttcatttgctatatcaggtgggcgattgtatatctagcacagatgaaaccgctcatagtacctatcttgagtgagggtgaataactttctgtataaacagatgcaactcttaagaatgtgaatcactagttagacgctggagaggagataatttcagctctcataaataattcagtattttctctggctggatctgtatgtattcttgttggataatgacgtttcaattggatcatcttccattgcgggcattatcccatgttgttacaattgttgtattcaacccttgttcgttccataagtattttgatgaaataagttgatacaagaaaattatatctcggttttactatattataaaaaaaaaattgatgagaggattttttcatgcaatcatggtcattaccaattataagaaacgtgatgaattatgtgacgtcacatggattttttatttatttccggttataatgttttccataagagccaacatacatacagatggtaaaaaaaaatgaaaaaagaagccttttatttagtaaactgtaaccgaaattagcacgaggtgaataggttttcttttgcaattgattaatgcttgcatcgaatgtgaatcctctcctattgttaagtagcaagatacggtcatgttgaagagaaaaatacactttacaaatatttcacaattatcgttaccctttataaattatatagcaaattacaagtgattcacatactgattgttgaatcacaaaagctcataacaatagtaaaataggagaaataataaggtcaataaaaatggaataaatatagtatatataaagaatggatctggtgtggtcaagtttatagtttaagtattaaactagccaacaatttaattactttatcaaatattttactttagaagatctgcactctatgttaatatataactttccttatcattaaaatgccaacaaatctagaaaaaatatatttattatactaaaaatgaaaaatatctaatatatcagtattatattaaacattctttaatcaatatctgaaatttcaagcaattaataattaaatctcgaatccaaaataaactactatcacggatagtctataggattatggtaaaatttcagatattagtatcagtatttctaatatagaaatcgaaatgaagaaaatgtgtgtggtgtattttgatataggaataggacatcaacatttgaggagatataagattggttgagtggtaaaaggaaaaaaagataaggaagggaaagaagaagaggttgtgggttgaaatctctccactaacaaaaaaattaacatttaacaattaatattggtcgaccaaaaaataaataaataaataaaaaggaaattatgataatattaaactactaaataattcctctaacttaaaagtttaaccatttgtcagttttcctgcacgtcacgagattaaaaagaaatcacataggtaagacagaaattaataaactaagaacaaaagaatgcagtgactatatttcacttgtttttctatatagataaatattcatacataaaacaaaattagtaagtgcaaaacgtgcaagaagagcaacaatcgtttacttgtcgaaaaataaaattaaaaaagaaactgtaaacaaataatatacgtctttttcaaataatacggggtataatatgatgcgtatagtatgatgcaccgtgatgcgctctgattaatgcgcgagacaatgaaattggaaaagtaaaattgagaataatagaagtgtttaatgtttatataagaataatattaaacagttttacactatcttataagttaaggtttttacggattcgtcaatccgtatgaattacgtagattcatatgagagaaaatgccaaagataattttggtattccactgttatgaaatagtgtattagaaatttaaatgatgtaaaaagcagatcccagaaagttgccatgactgcggacaccgaggcccactgggggcccaacacggtatcggacatcaataatgatttcacgggattgtatacggtgtgacgcagggtatatgttacaatgaggttccaccttctccccaagaaatcacgcaaagaaattgacaaataagggtcatctgacggcaattgaagctcaatcccaaatgcaagcattgaccacaatgttgcatagtcccaaaacaacatccattaaaagatacatgagggtgcaatatatgcccaaaataattgtagggtgaagtttttgtttgtagtggtctttaaggcctatgagtgagagaccaaaaagcaaggccttgattggaaaaataatgaaatgaaattttaattttgattttgatgggttttgtttttggggtgagtctatttgggaggcatgcaaaggagagaaagtgaagaggaggagtttggagttggtgagccaagtgatgaagaaggcagtgacacctgttgggaggacagtggtgggttgaaggggtaggatggtgaataggtacaaccagtggcggacccaggattttgagcatgggagacccaattcaaattgatagacaaagaaatgcatgtcaaactaatattatatataatattagatgttttaatttttttaatctcaaaacaattaatattttagcatttcaaagttcaattaatattatttttccaaatatattcttatgtaatatctcaccattaatgatccagacattaagaatcacagcattaaataaggatataatttttaaactatatgcattaaccttacgttaatggagactaactttgctaatattgacatgagtcaagagtaatttttaagtaaaacgggataaccttgtaattaccactaactttaggggaggagatgacgtaaatagttgtcattaattgttctactataatttcaaagtaggacaaatgttaggagacatgagattccttttatttcttagaagtttttgtccaacagagagaagctttttgaaataagtctggcaatttcagcttagaaaaggaaaataagggagggaataaatgaggaagggaactacgagggaaaaatcaacggaaaaaccttaagccaagtcttattggttcaatcgatgagataatcaagtactaattcatgggggcccaatcctgcttttttttttttccggggggccctaggccccaccaggcccccttctcggtccgcctctgggtacaacactggggagagggacaaaaacctcatgcctttgggcacccttcatgatatgaaataacagtaacatagggaagctaggattcaaacccataccttcatttctccttccatttccatacattttgatacttctattattcttctttgttcttgatccccttctcgcctgaattcttaatatcccaatgattttggtggcacttgtggaatggaacagctttattaattgttatcgaccaataaccattcggaccatcgcgcatagtacagatttctattcttaaatctgctggtcaagatttttttttctccttctttttagtgtgcacatgctgacgggtagaaaatttaaattatttactaaacattatgaaacgtaaaaaaatagaattaaaactcttttatataaaatagaaaatttatattcttaatatcacaatgttcatatgctatgacatgttcatatgcttagaggactcgaataagcaccatgacctagacatggacatcttgttcgtgcgatcagagaaataagtaatttctttttaatgaataaatatataaaatctgtttggatataagttagaagtatttttaagaatttttttattgaaaatataatacttttttagtaaaaaatctctcaaaaatacttctatcggtatccaaatatgctcatagtaatgaatgttttacttttctctttctgcgtcaaagaaagtagtatagcagttgagaactaagttttgtatgaacagatcctgtccactcattttgatcaacaatgtatatttcttcaattgacactctccagattttttcaacgtgagaggacccgtgtccaatttttttcgaaaatacgtaaccattaaactctaagatatatatccatacacacatacaggtaagataacataatataatgtatatttagtaggttcttttgttaatctgttttcaatttttgttatttgtgaaaatagattagaatttttaacccaatttattgaaatgaatttacatatttcatcttttttctaatcagtaattatcactagctgaccataatctctatcacttttccatcataatttttattatcatcattatcattactatcactcttattataactattatcattatttcgtcattataaccattattatagattgatatcaccacactgatatcattattattaacattgttataaattgatatcatcaataatatcattatcatcactactactattatctatttaacttttatcacataaggacaagatagtacaataatgttatctaatgtactaaaaaatgttaaattaaaacttatatttctcttatcatcacttttatatccatcttatcctaaaatatttctattacaatccaaacacaaaaatcatgaaagactatttatatgataattaccaataaatcccaaaagaaaaagaaaaacatattcacaggtgttctttgacagattgagtgggataagtcaaaacattggtagattaaaaacctaacctataccgcaaaaaaataaaaaatcaacaaatccacctcgtttaacgaatctatcgacagaaaaaatatgtcaaggctttgagacattcacacagcatttaatctttttcccatgcttttatcagcttaaaccttataattccgtgtaagaatgaatgagaactaattataaattttctgtttatttgacacggtaaatggtcaccattgttggccatcataacgtaatgaatgacaaaatacaaatacagtagtggaacctacttaaaggcaatataagggacaagtgtgaattgatcacattcaattttattcattcttatccctctgaataagcatttctctccaaagaacaaagatatttttgtacagactattcacatatactattctaaaggtatgttttcatccccaacttttttgaaggttgagaccattgtgaaggtgtttcttaagctttgcaagttcattactcgttatattctccctttaacaaaaacatttaacactcatctcatgccaactagatgactcataacagctcatctcccacagaaacgctgtcagactcgggttgtgaagaagtggctgtggtgtcagaggtggcatcgtcaacactcaagttggagaattcgccaccaatggcagaactttcatcttcaccacataccgaaggtgccagggatgcttcgggcgtggtggtagtagcagtgccgccaggtgaaggaaatgaatccatgtcttcagtctgttgttgcaggctccaatacattatactggctgcaagagtgagaatcatcttctgattaacctgccatgatatcaacaaagaatcaatcacatcataaacaaactgaacccagaatgtgtcaacttaattttttggtatcattgccaaattacatgatggccttgtttgaatgaagttctgcataaacacttgtagaagaagaaaataagataaaatgaattaaatttcacccataagtttaaatcaatttatacacttagcttttggagaacttaaataactttttataaaagctgaagtgtaaagtttgattttaattacgggagaaatttaaattattttaccttgcttgtttctcttataagaacttatgaagtttattcaaagaagactaatgtgtataaatttttgtagcaaatatgaatgaaactctcaggtggcaagaggcaacatacctccataatatcctcaggtaacaaaaatatggaacaaccgagcttccgtgcaacactgattatataagtggcattcaacctcttctcatcatctacaattacaacaaattaagccaatttaggagggatgaaaaaaagtagcaagtaattacatgttatacaaaggatctgtttaatatccctataaagaatcataccgctttcacccttggtgacaaggttccaattgacaatcctaggctcaacagcactcagaagctcaaggaaaaagagtccacttgacaagctcttatcctgtgcaaaaaatttgatacaaaaatttgtcacggataaatcattattttatagtttacagttgttgggaattgttaacagcaaataaaacagagaatttcttttggaaaaaaccttgaagctctctatgtgggaagttctgccaatgctcttcacttttctgttcacccatttcagaatatcagcatcagtgatctcctttccttgggaatgagatctcaaatttttcaacagttgaagcattgtgaatcgcatgagctgccacaataaagctggaaaaaaatattttagataaaattgaaagccaaaacaaataggtgggaaagcggtcataaaaaatttataaaaaataagagtaaattatatccatatgaagagattaccaagaatgagcttcttatttccttgcacaatgtcattaccagctacattgactagtgagaatctcagttgtttaccaatttttatgacctgattgcagttctctacttttctgaatggcattctaattggaggtcttgttgcatgtttccagttaactgatcctggaaatatcttgtctaacacttctaaaagtatccatctacatgcataaagtaaaaggaatcaagcacataagaacttagtgaattaacaaattaaattttgataacacattcatttaatttttcccaatcagtggataaacacgtgccatgtggatcatttggtatgttttgagatccagaaaattaaaaatttacacttctacagatatacaaggatttagattttgccaaaaataataaatgcagtttaagaaaaggaacacatacccattcttgacatcctcaaacagattatttacatgtgtagaaattccaagactattgatccacagtcggaagcatctctcttctctagatgtttgcacatcatctgtcatcatctcagcataggacatctttttagtgtctgtagatagaccactcctgcaatgtgtagggcactaattaaataactacagcacttaaacagattcagaaattaacatgcataagaatatttatttaaattatcaaatagtctgcataaaattaactatgcaattcattttatacctatgatgaaacaattgtgcaacaaatgcaagattcaaatttgaagtaccctctgcaacatcgcttggggtcaggtatcttttgcagcccattctctctgcgtgatcaagaaccagatttgccctttcattggcatccttggtatccaaggtggccggactgcaatgttcaggagcaaggacattaagcagataagcataggcctctccatcctgtaaataaatgggtgtgaacacattaggataatggtttgttaatagcttgattcaatttcaaattgtagaggcaaaactatcatgagttatgacactattggcttagaagttgggagttgaagaaattgcaattctgcaggaacaaacatatgaaaaattggaattggattttttgccgagtgaacaacctcttaaaacatattaagcaatatgacatggtcaaaggtcacatttccattctatgtcatgcattacacacttagatactcccattccatgaagtgggatagacgggattgttattcaagtatatatgtactaaaagcatctagctgtcaaagtgtggtgtgcatgtgcgtgtgtgtatatgtatggacatgaatatatttatggtcatgttgcccatttaccccataagaataatatatgtgacagttaccttttaagaatacattaacaatttgttacaaaaaatatatgtattatacaaggtacaaacaaccattatttgttgtgagcagagaagccttagcaggttcagttcaaggttaataagtaaaaaatccaaaatttgcaatgcagattttttaaggggaggagaacagcagtaattaatattttcaagaccacattttaacatccatactttgaatagtatgagattatgaaggacaagtaggactgggagacacccaagttccaacagggaactgaatatttgtaaaagccctttgaacatcaaaaatctgctaaaagtaccctgattgttttaaatataggggcccaatgatactcatttatgcaatgtttgcaccttatataatagatatattttttacttatcaatactcattgtacaaatttatacctatactcatataccttaacatcagaagaaaaatttctgacagttttctcgtaacccgctctctggagatgaaaattcatccattttagtagaaccttttcaggagacaaattaagaagctcttcgatctcctaagacaacaatgaaatgcaaaatacatcagttatcctgaaacacaatgtgcaaagaatgaaacatcaaaatttgatttaattggaaataaaaattaaagaaaaaaaatgcgtatcttattacctcgttgtcatcaaccaattccacaagctgaggtgtcttcttaaggttgagatcagccagcagctgaatctgaaattaccaagagattgagaggaaaagagaacaatgactatgtaatcatttctgaagtcaaaagatatattaggccattaagaaaaatgatgtaaacatataagcaaaatcaaccactaaactaacaataaacgaatgatatgtgcagttcaaatatttacctttatgatttgggaaatcaaccctagaacaagatgaggctgcaacataaacacccaaacaataatgtcacaaagaataaaaattaagaacctaagtaaatgtctatagaggaataggggaagtgcgtattgctaaaactcactcttccttcaactaagtcctgtgcgccaatgttaaccactgtgcagccaatagccttggcggaattgaggcatagagtatggttctcgtttacctcccaaagactaggattccgtttgcaattgatggctcgctcatctattgtcccaggcacagcaacattgataagtttactgcattaaacacgacatatatcaaagccaatatacattaaaggctcatacagacataagtaaaatgcaacaatcagcagaccctgcttatataccacagaagaacgccatcttttgcaagatcaaatatatcatttgtagctgggtccaaaggaagatattccttcaaaaatggatcatcaccaaggtagctgtttatgtgggcaacatagcaagccttttctgattcaccgatcgtgtgaagaagggtggtcacggtttccttgaggaacgacgaggagtgcctcctaccaccttgttttgtagtagcttggctttgcaaattcaaatatgcctgcatgaaaaatgtaataaattgtaaggctacataacattatatttaatgttgttatatggcgcataaactgtttcattaatacaactaacttacacataatatcccattattataagttcacaacatggaaaaaagttacctaatgtagtaatattaaaaaaagaaaaagtcaaaaacaccaaattactaacctttaagaaagcttcgaaatcaatgtcattggtaaaatcagtgcctgattcacccaagatccccctaatctcatcctcaccgtacatgtctctgaatgcatttagcttcaccattaaaggcggcaaatctccaaatgtaactttacctttctgattctttaaagagacaaactacaacaacagaaagaagggtccaataaggttaaaaataaataaataaataaataaataaaaaaaaaacacaaagcatgaaagacaacaaatttaaaagagtaatgaaattggactaaaatgtcgattacaaggaagcaatgaaatgaacctactttggatttcaggctgcgaagctcaacctgcgtgaactggctttgaagccattgatcggagacaataacaccctcaaattttgacatcttggagaatcactaaccaaagctacaaattgtatggtatcccccaaactacaaaaattccccagaaaagcttaagaatatttgtaacacaaaacaatgcgttatgcgtacgactcaacaacctattgccagatgcaattctacacggtctaattcaaatataaggccaaatctacaacaaatcccaaacaagaagtggtttagctcccggagtcaccaacctgtccaacgttatcctgacagacaacacaaacaaaagataagcttaaaaaggaaaagaaaaaaaaaacagaacaacgatataagacacaaaagattaaaataaaatgaaataagagagttcgttggattagttattaaaaaaaaaaaaaaaaccatcataaaaacaatgaccagaagctcaattccatcaaacacagaaaaagggtatgacgcatttcacatctatccaatggtttttcaacgaaagtatagcaagtctcatgggtattgagttatttacccctccccccgcagagcaaaatccagttgggaagattgagatcgaggaagaagggaagaaagataagaacttgagtgagaaccacgcagaagcagatacaacattgtagtaattgtatgcatttgttgaagttaatgagtgaatgaaaataataatgagaacatacccacacataaaaatgagggtatgggttgtttgaatgctcaactaccccttcattattatttcactaacaccacaattgaattgaatgaagagaagagatgcgcaaggaagagaagaaaggatcgatttttcttagtgggtaggcaaagtgacagagaagagaaccgaccgtgtgactcccaagtcctatgctatgagtctatgactgtcttgtttttatttttattttttgttgttgttggtttggtttcagattgcgcgcgtgggttaaccgcgagagtatcttgaactcgctctacgcttcgcacacgtcgttctctgggtgtatagtttttttggtgttttgtggaaccgactttgtgatctcagcaaaaaacaagcgtcgttatggcgggcatgttcatcatcacagctgggattcggtttgtgacaaagtgaacaatgcattacgcaacattatattattacatttttttttgtcaaggttcttgctatatttatattccataagatctcgtgtccaattttttattcaagcaaattactaccttttcaatttatagcatggtcaattttatcgtaattctgttatatttttataaaaaaggtcaaagaatgaatagtggattcactgttgtcctaaaaaaattgaatgcaataacttttataataattattttaaaaattaaattaacaataattctaaatgactgataggtaccgaatttttacttataatacataaaaattaaaccttaagaatattaaatatcatttgtttttcttatcagaaatcttttgttaactttgctgaaaacaataaaaagatgaaggatgcttgttttaaagttacatataattgattttaaattattaaatagtttaaatatagtttttaattaatatcttatacagtttattgtattaaaataaaacacatgttataattataagacttgattttgatcactattatccaaacatatgtaacttatttctaatacttgactatttatctatttaccatatataaatttagagttgcaaaatataatattacatgtttatataatttttttacatcacatgttttgctacgtgtcattcttttctacaattcttccaataactctcatttaacatcaaaggtttctataattggtgccattacactcttgttcattgaaattgtcactaaaaccaaagtactctgggtcgagctgcttaaatggcgtgacactcatttttgcaatttgtatgttattgtcattacaatttatgacattaattaaaacttttgtagctctcttctccgcaattagtgtattattgtcattatacatccatgaattgaactcaatatttggataaagaacaataagaagttacagtctccaaactcattctttcctgcatgaatttcgtctactagcttcattcctttattttgagtttcagagaaaacaacataataatggagaagaaaaggaagataagcagaacaacgagaaaggacatgattgttgacaccaccaacatgcccgtgatatttgtcaccgttggaattgcagtattcgcgaagctcctcgtgatggtacagcactactcattatcatgtattcgataaagtgaacaagtgactaatgaatgtaacgggtggaagtatgatgaatcaagatcccaatagctgttggagcctaagttaaagaatgctcttgctgatcaagacaaggagtctgtttggatacaagactataagtatttttaagaatttctttactagaaaaactcttaaaaacacttgtgacttggatctaaacaaatccaagtaatatgatccccatcagcaatatttctctcaatttccaagacaactattacaggaatgcattgtagaagaacaaggatggatatgctactgaattacatacggcatgtgcaaggtagtgtttttagcacaaacaatttaacattgtttaaaatctcaatgttttcacgagttgtcaacattgtgagggaaataacagattgttgagaaaaatattataaatcctttatacaggttgcctcatacttttggattggagcataggtcttaaatcaacaaagcatcaaatttcaaagaaataaaaatgtacttcagcaaataccacctttatggcaacttggtcacctcttccttctgccaaccctctctctcctatctgcaggctggggcatgaactcttattagttatagtattaaagcatccatgaacacttaatagggttgttttttgtggggttttagtataatgcaaacagtatatcgtgataagaatacatcatcttcctttgtgcaatttgtcaaaaacaagctaatgagtagcttatgaaaaggtcaaacttgaaaacattaagcctgttggcacttggtaaactgccaaatgttttctttatcctttgccactgaacactgccaaatgttggaatatctccacagcagattgctgcacatccctaacagtatattttcattgaacttattgcaggaagacaaggttcatttgggcacaccttagcccaatgtctcaattagaagctcatgaaaggagcaaatttgagaattaagcaagctcaacacctggttaaggagagtatggcacagtctagtcaatctgccttgcctctatagatttttccattacaattaagaacctcttagtcttcaattgctgtctggtgtttcattttaacacttaagaagcttccaagttttaagacagcatctgatgtccctcaaataaaggtgcagttcattttaatcaacgtgttttgcccaaaagtttgcaagtagacgtgtggtgtattagtgcctgatgttgtagatgttgcaaaggtgtttaatgtacaagaatacaaaatctcattactcttttccctccatgtctacaaaatatccagacgtctattattcctttcctctgaaacttgaaatatgtttatataaaatgtttggttcttggttctgagaagaaactcaataaacgaaacaccataataatagtaataaataatatttaaaaaatatagatagtaatgcatccttcacaacatttccgcatcagtatgagatgagtagaagtaatgtgagtttttctaagacactcaaacccaattgatgatctagcttcattaaacaaagacaacaagctatacgtgggatgaaaacatccgaagtaaatatgttcttaaccatgtcataatggcaggtttagatttcaagtttcaaacaagagttcaagagaattccatcatagtatcaaacattaaaggccccaaaagaacaaaaaagaatcaatagcaaggcaacaagtaactcgggagtcacattagagagatttagcagtttctgctctagctggggtcaagtgattagcagggataagataaagatctttttttctccaagtatggagaattagatatcagattagcactaaattcagttttggtaggatggataacttagggaaaatatttgggagttcttatacatcaatgacagagtggctagagactccttcaaagggattctggacaaagctacatcaaagcttagaatatgtggaaatccaaagttctcattggcaggtagattggttttaataaaatgtgttctcagatcttccaagttccaacctctgttatgcagtccaaccgtccatcgaacttttctttcgtcaaaacacttatctgccttctattgttagatcacagagaatttttatggagatctttaataatccttttgtgctaatggttttgttaatgtaaaactagaaaatcaattagttaaggtgagtacatagataatgtacttggctgaaaaacaacactagaagcaagtatagaaaactaaatagactatattagaagatgaagatgcgaaatgaaatacttgaacaaaatgagacaattccataatgttaagacacaaatattctagcaatgaccggtacatataaacagttttaaaagtatacaacaaccgctagtaatatataaccaatatcgacaattatatgtattaaataaaacaaaattgcaagatcgaaggcaaacaaattataccaaatgaaaaatatgacattcatattacaaaaatttgaatcagatctcccctgcaatgcaatgtgataagctttttgcccttaagttttttgttttcgaagaaggcagaaatggaattgaacaggaaagtgaggaacaagacaaattccagccatgccagatatccactaattcattctgctacaatttcatgagttctcatccttgtcttctttttcacctttttattaagttgacctctaaccattcttacaagccattgaggctttcctattaataacacacaacatcccatgcccactccaaataccattccacatccatatcctatagccactggtttccaaccaaatccaaatttctcttctctccacaaggtcggtgaagatggagaatgttgttcacggtcattgttgcatttcattgacaattggactccacataaccccaaatttccctcataagaatcattcaaaaaagtattgaactgttttccatgaggtatttctcctacaagatggttatgggaaagattgagtacttcaagaaagttcaaatcggttaattctgtaggaatcctaccagtgagaatatttgaggagagatccaatgattccaagtttgtcaaatttcccagggattggggaataggactgcatagtctgttatgggaaaggttgagccctctgagtgcatgaagctctccaataacattcggaatttctccttcaaatttgtttcctgataaatcaatgcttacaaagtttgttggaattttgttgagtgtcatactaatggctttcattgttacagtcacagaatcagtgtatgttccattcattatagatgtttccatgtattcctgcaaaccgttacccactttatcttggacgacattcttcatggcttcaaaattttgtatgtaggattttggtattgggccaatgaagttgttggatgagatatcaaaaataactaaacttcgaaatggatgcttggtctttaactgggaatgggaccgtgcaacttattggcttgcaaaaccaatacttccaaatatggtagagtttgaagccaagggggaaatgtatcctcaatttgattgttgccaagatttaaaaatccacttctgtgcaattggacaaagattttggcaaaagaccttcaaaattggttgccattgagattcaaagtaccgagcaaacttttcttcgaaaaggtactaggtaaagtgccataaaatttgttcatctgtaaatctaatacttgaagggatgataagtttgaaaggcattggggaatgatgcctgtcaatttgttgtgggacaagctgagactctgaagtaaacttgcattgcaaattggcgaagagatgccaccagtgtttgagttgaaactaatatcaaggtaatagagttggtagttccttgagaattggtccattggtgttgtcaacaggttttgagagaggtccaaataatagaatgaaatcatttcatgtaatcaattgggcactcttccactaagtttgttaatggacatatcaagaaatccccaaattggaacttttaccggccgataattttggaaattcagataaacctataaaagataggtccaaactagttaagcaggagaaactgtaattgacattggatttgaaatttagtgataattgatcattgtgcgaaagggaaaatttttccaaattatgaagcttggagaagagtggaaagtggacagatccactgaagttgtttgatgatagacacaagtgagtaaggtttacaaggctgaacatggattttggaatattgccccgtagcttgttgttgcacaaatttagagactcgagtaacaaatgcctacacagaaacaaccaccccatccatcacattgactccattctaacttacttcaaaggaaaatttatttgaaagggtaagcaaccaaagatgaatatttatagccagattaaaaacacaagatgcaagagcccatccctcacgcaaacaaacattattcatttttctaatcctttcactgcgctaatatttttccattttctactctataatgtgtcattaattccctttactgccactatgttacattgacttggaggttattgtctgcaaagatgaggcataggtatttgaatggtttgatttttcatctattttggagtttctttttctttattatatatcatataaacatccattttctaccccatctataacgctatatatattaagattgtttctaacagcattagtagaattgacttggaagtcaatgggatttaggtttgatttttcatcttgaaacttctacattttttttggaaagcaaaaggaatatattaatataacttgagtagaaaaagtaacccaagagttgcagagaattcgtccataggaacaaggaaaattcctagtctggccaagcatgcaatatcaataatgcaatgacagcatttcattgaaaagtaaactcgtttaagttgccataactccagtttgtctaacttgtaagtttctgtcttagaacactaacaagtaacaaccatcgaattagattctttattctcgatgtctttttctgataattccctacccgtcaataatttccttcttatacaatccatgtctttcattgttcaccttatcttcacagatttgcccctcttgctatttccttgaaattctagttcttaggtgcctttatgccatactcaaaatgtattacagatgtattaattaattttgattaaacttatttatccaatttatgcgtataattcactaagaaaaactgattaacttttcattgagatttataatttatttagtcacttgaaaaagaaaaagaaaagtttatcaaaaagagtataaaatgtttattacttccaataatagtaaggtgtgcaaaaattagtatggtaaaaaaatcgaactaaattggtctgtgttaatcgattcagttttatattcaaatagtcaaattaatttgaaaaccgtttaaagaacaatctagttttaaaaaattagctatgtatcgaattaatttttaatcaattttaatctgattttaagaacaaataaaaccaatttcgaactatttttttcaaataaaaaaatattcaaatgaaaatcagtttgattaaccgaatcgattttatagaaacaatttgattaatcaaaatagttttataagatactgtactatttttttttcttaaactaagtcgagaaaaaattaatttgattcaagttcgattacaatccgattccatcagaattaattctttttcacacccctaaatataatatatatatatatatatatatatatatatatatatatatatattgaaaccacatggatagggaggattacaattcagaaagtggtgcaacgtatactttgtgccttgctcttttttcttctctagtttaaggacgaacatttaaagagccttccagctaaccactaatatattttttttggtgagctaaccactaatattaaaaaaacgggtaagaatactcttatatatatatatatatataattcagcgcatgcaaagagaaatttcggaagagaagaaaaaaaataaatgatgtaatagattaaaaaaattattatatgtatatcactgcttaataaataaataataaaaattaatgagacaaatctaaaataattaagtaatatttggccttttgaaatagtcatggcctcaaaatgagttttcaacgtcaatatgtcataacacgataaaaccaaacatagacagatcatttaatttatgcaactggaccaggtccatcatcacaattcaaattaatgaccacaaactcgttgtcatgacgatgagaaagaaacgagatatatgttcttatctatggttagattttaatgtaataatcaaaagtggtgatgaagagtaactgtagtatctaataccacatatattctgaacatgttggactttgacaaagtacttgaaaaagaacgaataaaagtgtgcaatgcagtgggagcagtctcactcggcaatagcatcaaaaatgaaatgaaacccactcaccctcacctcaccaccatcaaatcagagtcgcaattcacggtcgcacgttgttcttctacggtggacacccacgtagaacatttttactattaaatattgaattcaatatatgatatttacgatatcttttaataaatgaagtcaatagatttttaacataaaaaataagttttttaaaagaatttttaatatctatatattattttaaaaataataattttaaaataaaatctactactaacaaaataaattttttttaagagatcttcattaacattatatagtctaacaaaaatagttgaagatgccaccaaatatgatcttagaaccttacggttttgtgcgtttcctcagcaccaatcacagcccgccacgtataccttgccagagtttgacaaccacgttgtggaccccactccgcaccacatactacatcagtcaaaaccgcggcttagctcaagccagcttgtccacttcgccccacattttttttttttttttacttttatttatatttttcagactacactattaaataacactacaatattaatacctccaacaacactaattagtcattggttccaatgaattcagtctttaaagatcttgttttcaaattttatgaatgaaaagatttgatcagtgaaaaaaaaatttaaataatactatatatatgtaaatacacaacagaacacaatgataaatgcaagaaagaaaatactaaaaggccaccacttcagaaaaagttcttctgctgagttaagacctcattgtctcacacacactttctctctctaaaagttttgaggtggttgggttcatcacttgctcctggtcttaatctgccaagtgccaaggttgccgggatgtggaattcacgcgctctctctgcgccactcgctctgcttcttcttcactcgctcctttctctcgtctctgctcagagatctatctggaacactctcagcggtaatgtctcgtgttttactaccatctttgcttctgtctcttttcacttactatttacttacctaataatcactaaccaagtgtacgatctgtgtttttcttttttttgtaaactttgatttcgtttgttactttgacctgagttcggatttggataaatggcttagctaagcttcgagctagtttatggtctatggagatattatatgcagtgcttagaaagagtttgacgtttctcgagagcttaatctgagaatatcatatgtgaaaaggaaacattagttatttgttgtcagggaaagttttggctgaatgaactgtttgcggattcaactcttacaatttgggtttgagcctaactcaacctcaaaagctagctagccttctccacgccaaggactagacatcttcgatgtgaagcttgcatgacttaacggttgacccaatagattcaacaatgatcgctaggatcagctccaatacctgttttagaatttagaatttgggttgtcatattcaatcttaaatgctagcttaagaaatgagggttgccccctatttatacactcttttttgccatatcattagtctgatgtaggatcttcaacaaacaattttttccatgaaatctaaaggccaatcgctgactgaatacgattcatataatatcagagactgttgccactttcagttttagaatatgttcttgaataacttttgcactttttattattattatttaaggaggaactttcactgtgttaggtgttttgaaacttacttgtatacttgttttgcaggaggtgcgccgttggttgtagcacgtggtggattttcggggatacttcctgattccagtgatgctgcctataatttggcagtaataacgagtggaccagatgtctatatatggtgtgatgtgcaattaacaaaagatggagttgggatttgccagccagatataaaccttgcaaattctacttacattgcaaccgcttacccaaataaaaccacaagttacttagttaatggtgtacccacccgtggctattttcctctggattatactctgaaggacctatctagtgttgtctgtgagtttagtttatttcaaacatgtagttttattgctaatagttataaactttcagtatttgatggactgagtgattcttttctacggtgtatatatgtgttgttgatttaaggtttagcttctaatcaggatctttttaaacccttttctgtctcagcttgcaaatgagctttgaagttgtttcttttttctttttggatagggaagttgtttctttatatagttgctgacagtttcttgtttctggacagtaactcagggagtatactctcgatccaacctgtatgatggcaacaattttggaattcttactgttgatgatttagttaaattaacgcaaaaaccaaaaggaatatggttgaatattcaggtaaatagaatgaatgcataatccattctcatgattcagtctccttgttttaaatctaactcttgttttctcttatattttaaagcatgatgcattctacgcacaacacaattttagtatgcgaagctttgtgatttcagtttctagaagagtagttttcagttatatctcatcacctgaggttggttttctgagaagtatagcatcacgcttcaacccaaaaacaacaaaattggtcttcaggtttatgggacagagtgatgtagatccatcaaccaatcggacttatggttcgcttttaaaaaatcttacatttatcaagacatttgcttctggaattcttgttccaaagggatacatatggcctgtagatcatgcaactctttatctacaaccacatacatctttggtctcagatgcacataaagcagggctagaagtttttgcatcagattttgtgaacgatgttccatctagcttcaattacagttatgatcctcttgccgagtacctccaatttgtagacaatggtgacttctctgttgatggtgtgctctctgattttcccataactccatttgaagctataggtaagctgtttatttgtttattctgccatgttatcagaatagcctgccacaattagaatgcatttgattttatcaaaatgttgtttacgtagacgtagggtatgcttggttgcaagagtttagaagggagacaatatttgttttatgtaaacattctaattatttaagattttcttaaataacagaactggggggggtataatcagattatagtgtaacttgccaatcatcacttattcgtttttgtaaacattttataaatgaaaaatctgctgtcatcacttccccttcaaactcttccaaccaaacatatccttgcatatattttcagatttttactatatacagtatttgtcccttgggatggagttgatgcagctataaggttccattaaataaaattatcctaatgtcttcctaatctcatgctcatagtgtttgtgtgaatcaccttaaacgtgcctcttgcatttgcttgccttttcaattttagagtggccacggatggcttgtttaaacttcatggggcaaatcctcaattttaatcctcagtgaaattgttttagtgatcaatctgcccaaaactgatatatttataagctaatttatccttactatccaatctttgtaagcagatactttcactttgcatgagtatgccactaagattgttatgcaatccttaatcaatggaaggatacagatgggatttatgttgactttgactaaaggatttcatgtccgaatgctggtgcaagtgcatgaacaaagttactaaaaatatgtacttttagccaatctctcaccacctcctgctttcaagctcccactgtaaactaaattcagcttagggcaggctcctttaggcagatcagatatggtccagttatatactctttaatcaactatagtaaaagattttgtcatgctgcatgaaagcacatagcgatgtttgccttctaggcattgcattcttattagctatcctaattagaattttctttctcaattttaaaatgcttttacatcatataagcataagacataaacatgtagttgatattagtggcttgtgggtcctactgcatacttataaattgtaatctcagaacatgtctgtatgtttgtgtttccaatccttttttttttttctctatttaagtagatactgtgttgtcttcttataatgcaggttgctttgctcacctaggcaccaatgctacgaaaaaaggtaacttgttttgattttggaatatgtattatcatgttgttcttagtgatttctagttgtttgactgtatgatttttatcattcgatggaagcatagcttgcattattgatgatttgtttctctcacttttttatcatgtttcagataaaactttggttatctcaaaatatggagcgagtggagattatcctgcttgtaccgacttagcatataataaggccatatctgatggtgtggatgttcttgactgtcctgttcaaatgtctaaggatggaacaccattttgcttaaactccattgatcttatagagagtacaacagtcgcccaatcaagcttcagcaaatttgccatgactatccccgagatcaaatctggcagtggcatatttgcattcaacttgacatggaatgatataaaaagcttgacccgtaagtctgaaagttctgtagttgttagctatttatttctgtatttgcatggagttaatccagacttgtcaaagcttaattattattttggctgaattgcaattttggtccccctagttttccaaatccatgattttggtccccttgatttttaattgtaacatttggtcccctagttttatgaatttgtgattttggttaataattatgattattagagagattaaattaattataaattaaataaaaattattaatcattaaaaaggctttgataaaacactattaaacctaatgtggtgttactgctggtggagtcgcgtgtgacacaatggagatagaagaggtatttgcagagaagaggaagaaccgtgttgcagaaaattaggattaataattttttattcaatttttaataattaatggttttgattaatttataattgatttaataactcaattaatgataattatttgttaataatctatctggaagaccaaaatcaccaatttataagactacgaattaaaattcagggaaccaaaatcatgaatttgagaaactagggggactaaaatcacaatattattttttaaacaaaacagcatgcaaatgcatcactttagtttctttaatcccaactatgttggcaccaaagcaactaacaatcacttactgcacactggaaatatattaaccaaaaagaagaggaacataaaaacaacagatggggggacaagaaccaaacccatgaagcaaaaagcctaatggaatcaataatttggcatccctactttgtcaaagcttagttgactgatacgtcatatagccaaaattcagaatgagatatatgaacattgaaacaagtcgtgttttgggaataatggggaaattagcttacaacttcactttataggacaattaatgtctcactgataaattaccatggcaaaattttccctctcatatcttttggtgcctttcacttgctgcctatgataagtgttataacaaatatttgacatatttttctcttctctattttccctgcagcctcaatattgaatccttttgcaaaatacagattgttcaggaatccaaaatctaagaatgctgggacattgttggcattatcagatttcttgtccttgacaaaaaatcagacttctctatcaggtgttgctatcattgttgaggtgtgtgcttccgtgcctattcattctttttgtagtattcattctaccggctgttatttgaacatataattttgtttgaagaattaggacaaatttttgtgagaacggcttagggtcacttaagttatttaataattcctatgaatgatttcaccttggaataagaggggaaatagaaataagaaatattaagactatcatgcattatttctatcaaattgttacaagacctgtttctcacttgtttttgttggccatactttccttctaaatttctgaataacttggccaaaaattatgaaatatactgtttttaactctttggagttctacttgtacttcatgcagctgacaactttctcttttgaaaccaaaaacaaaatgactcacctgccaaactcgtgtgaatttaacatcaaatatttcttcactgactctattcaccctgatttatttcaaccaagtaaagaattatttggcatgttccttgtgtgcaaatgattttttttccttttctttcatcttctatttactaacatgtatattgtgttgttgttgttcttcttatcagaatgcagcctatcttgcagacaagcaaggattaagtgtgattgatgctgtcatcgatgttttgagcaaagcaggttatgataaaccaggatcccaaaaggtttatattcaatccactaatagttctgtactgctgaagttcaaggagaaaaccagttatgagcttgtgtacaagattgacgagactgttggtgatgctgcaaatgcagctgttgaggatataaagaactttgctagttctgtggttgtcaacaaggactccgtaattcctaataatgatcaattcctgacggcctatacaaatattgtgccaaagctaaaaaatgctaacctctcagtttttgtagaaacattcagcaatgagtttgtatctcaagcatgggatttcttctcagatgcaactgttgagatcaactcatatattgagggagcacaaattgatggtatcatcacagacttccctaaaactgctgacagatacagaagtaagtgctagcaaattctgctgtaccatgggttgattgtttcaatataaacagtttttactgaaataatttttctccgttctactgcagggaacaaatgcttaggtttgggtgacaacaaacctacttacatggaacctgttcaaccaggtggtctttttggactcattaccaaagaattcttgcctccagccgaggctccgtttccacccttgacagaatctgaagtggcagagccacctttgcctcctgttgctaaaatagccccagcttccagcccgaatgccggaaccaaattaccacagggaaattcacagcctaaggtcactgtctgcttcttcttgtccactctggctgtgtttatagcttctcttcttctgctttgagtaaaatcatctctaaacttccttctaagaaaaaacaaaaaaaaaaaaaaaaatggagaaaaagttgcttttggtggtctcaaccctctattttccacatctcttctaggtttgagtggcatgaagcttttggcttcagactagatgaacaatccacatttttttttgttcttcttaaaaggagcaaattctttcaatcttatttgttgtagctacgcttgtccattcttagttcctcaattgcttctcgggttggatactatgagcacaaaagcccgcgtggtatatatctatgaattctttttagatgtgtattttgtatcttttggtgtaagatatatttatatttaatacttgttggggtgcatttggcattagattaacaattttcccgaaaactatctagagcatatacatggtttgattgtttcaatataaacaatttttactatcccttctgattctaaatgtacttaacaaatagcgatactgaatatccaattcaaccggaaccaattttgagctggcttgattagtaagtttgaagatgtcaaaaaatttgtacaactactaagttttacttaaatatcgttttgaaaaaaaaaacttaaataatagtaatttacattagatctaatattgcaaattagtttgttttgtattaaataaaataaattattaaaaaataacatttttggcataattatataaatatatattaaatattttgttaatggatactttatacttataatatgataaaaaaaaatgtatgttaatgtcaacaagttaaaattagagaaccactaagcacatagataatgtggtgcatagttattattgtttaatccgtgtctcttgtgtttgagttttgactatatatagtttaaatacttaaagaaaaagttttactttcagcatgtagtaatatgatctgattcgagaaaaaatatctttcatggagaataaatgtgtcttttaaaaataatttaaatttaaagcatatttagtaacgtttgaacattatcaaacgagtacttgactacttgttaaattgtaacatgtgtacggtaaggtaaacgatacatgcacctaacaaattatatttgactttactcacaatgagtggcacaaaatgggtcggtttccccgatttgacaatactaaacaaaatggtggatctttagctggattttgaattcgtgatttcaacaggcactaactacactaccatagaagattttttggcgtcatcttttcgattaattgcagttgctattaatgagtaaatttaaaattgtgccaatttctattgagatttctcaagtccgtttagatagagaatttcaactgagtaaaataaattcagataattaaaagaaaataatctaaaattcattattatttgaatttttttttttaagaaattaaatttttaaaattttaaaatataattttaaaccactaaaaatgtgaaattttaatttccttctaaaagagtgagaaattgaaattgaaattgaaattgaaattggacacccgccgttgaagtcgcaagacaatcggtggcgctgcacctggtgctgtccttggcgacaatcagcattagaaggttgtaaccgtcgaccaaactcacgtcgtagaagtccaacccattggcactattgagagtgaactctgccaatgtcgtcggaggtttgacccagcccaacgcactatactttgccgaagccgcaatcagcaatggcgcaagagaattttttgtcagagtcttggtcgtagagggttgtgcccatatccgacccgaccaagacttcaggatttttacgttatttgatttgcctctcttgagggtgaatctgatggtgggatgaggcggtgagatggtgctagagagagtaatcttgagcatatcgtgtggcggcacttgttcacgatcttgaacgatgttgaaaatttaatttcttcatctaaatataaaattttgaaaatgatgaaatttaattttattatcctaacacagaattttgaaaatgaaagaatttcaattgaagcatttgaaattcttaaaatttaaaattctttataattttaaattgcttcatccaaacagactcttaaattatactaataaactcagaaactagaaactaagaagattgcatatcttacacccacttaggagtctccttgaggggtgtcattacgctatctctttgttaccatagcaataatcattgtgttccttattacaaaccctgcttcgacaaagcattggaagcaataatggccaagtatggtgggttatggtaaacaagtggaataattcactattgtttctccttttatatgaactaatgtggatttgagaaacatatatatgcccaattaagaagacataaagtatgtggattactcctaaattgcactttcaatttgagttgggtatgattttggtggcacaagcttcataattcatatagtcagttatcacgttagatgttttctttccgattttggtggcacaagcttcataattcataattcatatcttttagtgactgattcctagtagggcaatcatgataatgatagctaatacttgtgcttatcattttatatagatattttaatatagtctaatttttgcagatacgtgtgccaactgccaaggggtattctcagctcatgctgagatatgcaaaaaatatttcaggcatcaaaagatataattaactgctactattgataaaaagtttattagtaacggttacagatattgttaatatttatttttaaaaagatattgttaatattattttataaataatgtatggatttgaaaagaacatgagatctagataatgtttaatggggttaattttagtgtatttaacttaatatcattaaagaatattctttaaaatattttaaaatatatttttaattaaaattatactaaagtatttttaatttaccaagttaccattcacctcttgctacacattaaggttgtttctcttcttaaggagttgcaagcaaagtaaaagctttgagagtgataaaatgtgtaactaaatttgttattagaattataaaaaaaaacgttgttagtaatatataaaaaggctaaaaataacattcagtggagaaaaaaaatttaggactgaaaatatattataaaaaaattatgaaaaattgagatatgtactaacaatgttaataatatatgacatgggatttggttgaaaaagtatgaaaatatattatattctgatgagtaattgagaaaaaaaaaagttatgtattgttagtgtaaaatgttttacacaattatttaatcataattaattatgtatgataaatttattgatttttaaaataattattttaaaataattcaaatggtgatttatgattaaatgaagtgtaaaacagttttacattatcaatacatagacatcaaactctaattacatgcataattaacactagatacttactaaatatatgtaaataacccatttcaatggtaggtgcaatggattaagatacaattatttgaataaattaaactctacttaagagagatataaatattttgttgtctttcttttttatgttaatatatattttacaacttcaagtttatgatattttatttcatttaaaaattttcttttaaagttctattaattttcattatgattttttattaccaaaatattgtttacactatcattttttgatagatgcaaatattacattaaccatttcttcttatattaacagatacactttcctcttttgcagttttctgccttgagagattttactattacatttttctctttttactttattgtataacttttttttccttctcaattactcatcagaatgtggactttactagtccatggcatttttgaatttatgagttcgattatgggacgcgtcatgcttttgttctaatgatgtcatttttctcgcacccaacattgcttaccagtttgtcacggctggtgccactgccacataaagaagaagaaagaaacaagtttcaaatttcaactaataaatgcaatctgaagattccaaggagatgcaaagaaaacagataatactaattcttttcagactacaggtattttatgcggaggaactttttttaactatcacaacaattctttagcaagtttaattgtttcaataaagtgtcaatgtatcattgaatgattatattaacaaatgattaaatacaaactgagattaaagaatttacccaagaaaaataaagagaaaaagaaaagtcgtcggtgaataatagctaggctaattgattcagtgggaacatacctcccaaaataattgagtttttgaacaattaaaactcttttaatttgcatagttaacattggaataaacccttatttgcgtgtagagtgtagactgtgggatttagtcttagaccgtgtttgtcatcatgaacaatacacgcacgccgagatcaagtgatcactttattcaacatttttttccctctctttttctttattttgttgtacttaccttggatggaatggaagcataattgaagatgactggggtttttcctagtcattcattgatctccaattgtggttttcatcgaatttcgtatagttaccgtatttttcataaaacccatttttcaacgtgttgattaattcctcccacatgaggtgctgagcggttgatgatgaaagatatgactcaaacattagtatttgttatcatgcttatgccacaataatggtgtctatgccaatagcacaacacaaacatccctctaacaagtgataattgcgtgtacaaattcagtgatttggtttataaagcgagaatgatgtttaaaatctcgctaataatcaagtttatctgtggaatcctttaccacaaactatgatttttaaaataattataataaaagacaataaacttactagtgagttataattgtgatgatgtgttaaaataaaactgttttacatactcaacgtataatcgattttttttccacttaaatcttccaagatcataatttgaacaaaagtaacaaaaagtatttttttttttgcttaaaacttaatttgatgagttttcaaagaaaaatccaaatataatccataaatatgtgttttctaaataagtaccagcattaacaaagttatataatatttagacatctcaacgtgattacatgtactcttttttcctcttaatgtgtgttgctaaatgtttggaatttttttttaattcagaaacaaaatatggatgagattatccatattttttcatttaaaaaatctttttaatctttctaatttaatatttttttgttttgcatccttataaaattatttttataattttagtccttataaattatgtttgttttatttttaatcattaaataactttagataatactttggataatgaaaaaagtgatatctaaagtgttgtaaagaggaaaaataaaataaacataattcgcaagagctaaaaataaaatataaaaaaatttacatggataaaaaaattaaattataaggactataaaggtatttaagcctttttttatgattattattttaattttttctttaataattttaaaataaaattttatatatacgtttcaaattatattttttctattcatatttattaggctaaattttaacttttatccttgtacaagacacttgttttcaacaaaaaatagcttttaaatgtccttaattacatgtgaaatagttcttcattcaggccatcctattgttctccattcatgatatgtgatgtcatttttaatttggcctatacctatgttctcagtttacaattcctataaaaaagagattgatatgtggcttaatatgtcattacatgtgtgtatagttaaacgtaactttaattatatcaattttaaattattcattgataattgctgatcgaatgtaaatctataagtaaattatcctttttttcattcttttatgacttctttttgtgattaaaatatagaaattaacttctcctaaacttttatcaagtagatgttaagtttagttgattcataagttgttgattgtgtttttgtagaaatttcactgcaagaaaatgaaaggacaatggagggtctgaagctactcgttaagtgcgccagatgctcgctcagtgcgacaggcccggtcagcgcgaccagcttgcttagcgcgtggtcacttattcagttggacaatgaaggtgtgctcagcgcgacctttccgcactgagcacagaccacgactttgggttgctgttaaaaggaaaaataagggcacgagacaaaggatctggacttttggagggccagagatagagctagggcacgagtgaaggtagaaatctcactcatttggggacgtcttcatccattttcttctattatctttcattcttcttgctttcttttgtatttgtaaaccctctcatggaaatgggaggctaacccatccattgttggggttccaacaaccaaacactcttgatgtaatgattataactatctatttaatgttattttcgtatcattgtagtttttctgagctttattcatgattgtggtttaatctcctatttgcatgcttgttataggattttaatgcattggaaaatgagaactgaaaaacatttctaaataatatcatgtctaggaataaagtggttttgtttagcctatgttacattttgcatctttactcttaatgcaaattatttgatggaacttgttgagggatcaggagtgaaattaggtaatttaggacctaacacttgaggaattaaggttagaacacattagtagatgatggtgagcaattttaataattaaacagagaaatatttgtaatattgcatcaaaggtagttttggtgagttgagccccaacacgtcataatcctccgcattacctgacatttcaatctcaagtgtttgtattctatctctttattatgttatggttaattatctttatttatgttgaattttacatttccgcattaggattagaaattatcaaacttaatttgtgttcgcttaaaattaaaaatatattaactctgaatacaagcaaaatcattgtggaattcgacactcagacttaccatttatttattacttggataattcgatgtgcttgtcgaccgtttaacattcatctaaatccaagatatggttaatatattcaaaagatttgtttattataattttatttataatacgatttatatattaaaaaatatttattaactataaattttaactatataaaaataaaaatttatcatgtgtaatgtataagttaaaatacttttcttattgtaagaaataaaaactctaaatctagttcatacaattatatagatgattcagacttcaataaacacataaaaaaatatgtgtatttttcttttactattgattattctaatatgatctattgacttatatttgtaatttttatttctcacaataacaagaattcttatttaattaggatcgattatatgttagttagcggttacatgaccatttaaaaaaaccatttacttttttgaatattttgactattcaaatattatttagtgatttgtatttgtagttcttatttctcataataaaaaaatttctcatttgactaaaattattagttagaggtcacgtaattatttaaaatcatgcgcatttttcttttaatatccttaagaccattcacaattgatgtattttcttagaccatttttagtgattaatctcgtaagttacttataagattatttcatgttcttaggtaaaaaaaaatgtccaataatatatgctggctaggtttcataaaaaaagaagaagaaagaattcatttttttaagactcacgtcatcaaaatatttaaattcattataatgatcgtctccatttaaattgtttccaaccaaaatatatttttcttcatcattcctatttagttgtttattctctaaattttcaactttaaagtctaaattatctagatatgcataattctaaatagaaatagtataatgttagaaaaaaacaattatgaagagaaacattttaagattcagtatgaatagcaatttctttctttcttttccgttttattaaatgaccaaaaagttgtttctaagcaacatgttttttgtggaagaaaaaaaacatgttttgaacattaaacatcaagtataaaaaaaacaaattataatctataaatcaaacaaggagtctctaataattaaatatataatgtatgaaacaatggcacctgattgctattttaagccttcaacttaaactcaatttgttccaaaattttaaagtactagattttaatttgattatgaagataaccatgaaacttattgttgtttgaaatataagagattaatgtagtaaactgaatttttttttaatcgactgatataaaatattttttaatcgattgatataaaatattttgtaatcatcaattgtgatataaattatagttttgttcactgtcatattgttgttatttagcataaaaccattgagcatataaacatgttattttccctctatacttcttatcttgatcgatctcttctttattctcagccttgagcttgaaggttgtagttttcacacctcgtaaccctgcttatatttgattattgactccaaaaaaaatttaagagagaatgagaagaaagaggaaaaaaatatattctagaataggagtataatatattctaaaacgaatagatattataatatatatacacatatacacttgtcatattatcttctatcattctattattattattttttgaaaactattaattaaaaatttaattatataaattttttatttcgataattatatatactaataattaaagttttatatactatcttgtgtctccttaaagatggttctctatgtaatcgcctacaccaaacacgctttggaccactatttcttgacccatatctcactttacttcgtcttgcatttttagtcataaatcaaccttttttttcacatggggattaatttgatttgagaacctttttaaccacacaagtaactttttgcatcattttttgtactacatatagaacaaggatacatcagaaattaaaattataattaaaattatttcatattagttacgatgatatttttttctgtaaatatggttaagcagtttttttaaaatatatttatatgataaaagccacgcctcgcgttaaaaaaattattattctcaaatcacattttaagtataatcgaatcatttgaaatgctccagatattgtttagtataaatgatatgaaatattattaaattaaatttatgctccaaagttcaacatatttatttataattaatagaagcttaattattaaatcaactaatgatatttccatttttatttttgaatgaagatttttcattttgagaattaaatttaactcataatttctttttgttattattaagtgtttatgcgtagttcaactaatttacctatttgtttctttcaaacttaaccttaacctcatctataatggaacaaagagattcgaaaagaatatttttaatactttgacaccgagtataggacaaagaataaaactaaaaagaaaaaaaaaaagaaaaagaaaaaagtactcaacttttgaaccatttaatttaattaaaaaattataagaaagagtaaatagacaaacaaaagaggccatacccatttccccgaaaattgtaaagtagaacaaaatgatgaagtgcgaaggttgttaaaaacaagtcaagactttaattaaccgattgtgaaacgtgggtgatgtcaattgtcaagtgatgatgcagaggcacaaatccatctaggacccaagattttttttttctttctcttctgcctttatatgatatttatgagccttaaatttgatttgaagagaaaatcacacaattcaacatgacaggtggtaatcatgtaacaagtaagatactatatcatactatatgaattcaaaaaattcctaagtcctatgcctattcctatgaaacatagcacactacatgacacatcatgagtgcgttatgctgacgttcataggaacaaggaaagaaaaagaaccttcagctcaagcaaactcttattctattctatgctatgacctcaacgttttgagtttgactttccaagagtgaacctcttcctctctttctcacgccacaccccccactttcctatatataccttcaacaatctttgtcttgctcctcacatttccatcattccataaacttttttctttctttctcttttgcacttctttcataaaatgccggaccaagctatttgcagttgcattaatgaaccttgtcttgtagccagaaagttcttggccagacctcagcatgagggtgttggagccgttgttagaagaagcatagggaggtaagacttaaagagagatcaacgataacacagttaatcttagccttagccttagccattatgcatagttatgattatatttaactaagattaatttggatcctaaggttgaaaggtgtagattaactttatatgtgtatagtattgcaagttgtttaaaagttgagctttttgaattgattggttttgtgggtatatatgttcagatttgaactcaagtactttgatcctttccttgccttggatgaattctcaggtgggcatctctgtattttcctctgtttttttaatttggattatgaaaaagtatgatggtcaatcttgtattgtattctaagaatgtgaaattctgaaatattgcagtgactgctcctgctgggtttcctgatcatccacatagaggtttgccaattgaatcttctgtgtcatttatgttcttcaatgatctgatttgcttagtttctgacttgtttcttccttgtggtggtttttatttttaacaggatttgagacggtcacatacatgttgcaggtagagcaaatatttattgttttagttcatgggcttttcctcctttgatcattgattataatataaaactgttttccaacattagagaaaccacgttttgagttatttcattttttgttccaatccgtgttataaagtcaaaggcatataatataatggccattatgcaaatcaacaaaattgaaaaacgaaaaattaaaagtaaactaaatactatttcgctttatgatttctttattctatattagctcatagttttaattgagctaagtatcagctcaatatggtgttaatctttgtgctggtggtgtggcaacatgtaagtcacaaattgatgattcgttaccaattaagattaggaccactaaaaccataccatttaagattgtgtcctgattgcaaatagtagttggttataagcacaaacacaagagtgaccccacatgttgatatcttgtttgcttttctagaatgccaactaccacttgagtgtaatgtaatgtatctaaagttgtgtacgtgatatattggtcacatatgcttgtgctgatgtgctagcctcacctgaatgcaacttttttgcgcaatttagggagctgtaacgcatgaagattttgaaggacataagggaacaattgaagctggtgacttgcaatggatgactgcagggagagggatagttcactcagaaatgcctgcagctcaaggaacccaaaagggtcttcagctgtggatcaatcttgcttcaaaacataaaatgtaagtggacaattcttctgtaccaatgttagagacacttatcaacaaacaacttaattaaatacttattgcccttacaaaaattcataaatattaaacaacttaattaagtacttgttgaacttacaaaaggtcataagtcttttttataagtgtatttggataagcatcaaatatatatatatatatatatatatatatgtttatcaacaaaatcatttcaaatgaatgaaaaaaacacaaaagttactattttttgcttcaggatgacgcacttttggagtggacacaaaactaaatatagattaaataattttttttatagatatcctgtaattcatttatacctagaatttaattttttaatgtaaaaagctccaaataagagtgaccaagagttatttttttatgaaatactcaaatcgcaatcttagccatattagatgacgtactttctgcgtcattgaagatcatcatcatcatcattggtttgggggataattttggataatcctcatcaccaaatatcaacgagaccgaaaggaacttcactctttacaaagaaacagtcaaatcttttaaaactttctgaattaagatatgccttccttactttcacatgtgactttttcctcatgattcgccatcatgtaccatttcctagaagtgctcttaaatagggcatcaaaagatgcaagtgtgcaaaagggacttaaatggccagcataaagaatgtgcctctcaccccatatatcctatagtgatggtggaagcttcaataataagagcaataataacatgttgccaatgctagttcaaaatttgtctggttatggatgccccactaaaaatgaattcaacttttccattagtgtcttcttggaagtattatttgttatcctttaagaagcatttattgtctaccttgaagtttacgttaaattggtaaagtagtttcttcatttagactctaaaactttggtttaatatgtctttgtactattatcttataggattgagccaaggtaccaagaaatgttgagcaaggacatagctgaaactatgatagatggtatcaaagttagagttatagcaggggaagctcttggaataaagtctccaatctacacaaggacaccaaccatgtacttggattttactcttaaacctggtgctcacttgcaacaacttataccaaagtcttggaatgcttttgtgtacatattggaaggagagggtgtatttggaaaccaaaagtctcaacctgtaacctctcaccatatacttcttcttggtcctggggatggcctagaggcatggaacaaatcttctaaggtccttaggttcattttggttggaggtgaaccattgggtgaacctgtggtgcaatttggaccttttgtgatgaatactcaggaagagattgaccaaacaattgatgattttgagaactataccaacggatttgagaaagctagacattggaggtctgaaagtgcaattagccttgattattgattttatttaatgtcacatttgttggttgatttgggaaagatgggaagcaaaataagttctgatgtatattggaatgtatgaattaggcgaagagtttctatcccttttacctttatatttatgtcaatattatatgtatgcgtaaattaaaatccagatgtagtaagttaaaagcagagttaaaattctagttagttaaacttgttatttttacttcttttttttttattgtttttaaacttctcgttataatcctttaaaaaaacctgacacgttactcaagataaaccaaatttcttgccatttaaatccacaggtgttaataaaaacctttttattcttataccttatctaaccattcatttccattttagtaaatcgaaagagtagcgctaggaaaggaataataccaacatattctttgataattaacattttttaaaactttcacgataaaatttcatgtctcactcttatttaattaagtaagcgtaagattttactaaatcatagaattatttccattattatatatattaatgtttagaaaagacatatatcaaaaaacatgtttagaaaagacaagggtccatttgaaaaataaaaataggtgaattgacataaaaaaaaaaaaaagttgaataaaagtttttctaatcttatggatagaacaaagtgaacaaaccatcaacctcatttacatgactttccatgaaattacaaattacctgccgagtatgacataaagtaccttttattttaggtataaaaaagttttacaactatattacccttttattaataatgatttgaggtgattgttaacgaaaaaaaaaatcttttttctatataattgatccattaagtgactaatacagaacaagcttgtggaattaatttgataagtacccctggtattataatttatattttctctatccatatactatcacgattaaaacttacggacattttaattatttaaatttgatatatgttcatgtaatttaatgttaaataaataaagttgcattatcaggaaaaaaaaatgaggctcaagttgttgattattatgctcagttttaggaagtgaaaacgatattacatttaatttatttattttatgaaaagatatttatattatttccaaatggatctattcagcaacaaccattggtaaatcaacatacgaatttgctgccctaactaggtaataagctgtaaaattcgtttgtctccttacaaaataaacttgataatttggtaaaaactgcaaaagtaaactgactaattataactcccagcctcacaagatttggacaacttggccaaaagtttacaaacaaacaaacatccctacccatgaaacaaaccagtgatatcatgataaaaaaaatgaatcaatatctcccaacacccaacccctgcatgataatattatgcatacagcaaccaaaagatatgcgtgaactgcagcaaccatatttgcttgatatacatttctacgaaagaagcttaaccctctctaacagctaacatcagacttcattgcagaaaaaataagttgatttctgctcttctgaagaaaatgctctttgattgtcaactgcatgcgatggtactcctcaccaatccaaacataaacgccatgttttattcggattgacgtaaataaaattatcaaggattacataattttctttaccatatatttaatgtcaacctagagataagtatcaaataatctatgcactcacttgtttgtgttattgattatattgtattatctattaaaatattattcattgtaaatattttatcatgtatttataatatgttaaactatgaagttttaatcattaataataaataaaataatttgtaagtttttatattaattataaaataatttaagagtgaatttacttaaattcgacaccttgtagcttagttaaataagaacgactaatgtcacataatgttttaaaagtaaagtagtatttataaaataactatgaccaattatgaagagggaacattaatgtagagttttaaattttcgattataaattattcatgtaggaacatgtatttatctaataatgtgtttgttttaatgcatattactttaaatgaaagtttttgtcaactgtttaacttaaataggattgttatttagaaagaaaaaaaaaacttcttgaaacacattgaatcctcctctcatattggattcacattcaacctggtttaaaatgaatacaaacacaccttaacactaaaagaggaaagttaaaaaaattgaaaaaactaatatgaaaacttttacaaattagtttagaaaaatttttttttctttcttattttattttcctataaatgtatataaaaatctttttctaaacaaacccaattttttttaagtgaaaacaaacttaaatttaccacatagcaatgttaaaattagataatagctcggatacataattcttatattaagagatggaataaaagagaattgaagaccaacataaaataagttaatagaaattttttataagtatttagtgacaaagttagattttataaaggaatcaacttgagtggttatttaattgcagctaagtgacaaattagattttacaaaggaatcaatttgagtggttatttatttgcagctaagtgacaaattagattttacaaaggaatcaactgaagagcttccgtctatgggtggggatgccaccgcaaacatatgccgccgcgacagattccgtcttctatggaccacagatacttacctgaacgtgaaattgtcattgataacaaacatcactattaaaataacttagctttgtttatttttgtggtggtcatttgaaaggctaacaacttgagtatatgtagtatgtagttgacactattaattagatttcagttatctacatttcaatcacgtaatcaagttgcatttgtaccaagtttgataagatatgtgctgttgttagaataaatggatattcaagtaaggactaggtgcttatatgcttttgaagtatatttccaaccaagatcagaaacataattttctaattaaaatcataaatttgtaaatgtaacatgtataaccagaaaaattccaaaattgcagagtttaactttcaaacaaatatcgctgtcacctaatactaacagttattatattagtaagtgcacgggtcaacctaaatcagtcatcataatccaagttcaacaaaccacgaacatgtaaataatcatgtccttcgacaatttgttgtcacccttaagttcatcaaaaaagaaatgttgataaccgctacaagaaacctacaaaaataaaaggcaaagagtgcacatcttatctacatgatgctagaaaatcacgataccccaatctcttatcgagatgtaggataaggtcccttgctgcgtttcttcaaagaatcggagaaaaaggagaacgcatcttttagttcatctggaagagagagttgaaggggcagtaccaaaggcgaacgtgcattgtgttgcacaggttttttccaggatgtgggaacagcaagtgctggttgctgcttgtttagtccttccatgataaaagaaaatgccccaaaagtgagacagctctgcataagagcttgtggtgcacctgtaaaatcctagaatataagtcctgataacaaaaagtatacaaaatgaaatttacacgtgtatttagctaaacaatgaattgaattttaacaatagcaattattggaaggcattctgcatcagcaaatttcccccctcctccatattaggtgatggtttgggggaggacaagccctgacataacaatcaagttgtgtcttggtgacttggtgacttgttgatcatgagttcgaatctggaaacaacctctttgcatatgcaagaataagattgcgtacaatatccctcttccttaccttctatatagtaaggagcatctggacgatggggtaagtagttttttttcttaaaaagtcctttatcctaattttttctttgcatattcagaatagtcagattgacaagtcctttatcctaattttttcttacaagtttcaaagaaaggacaaacttatcaatttatttaaatatataaataaaagatacctggaaaacttagagcaagaccagtgcaacatccagctacacccgcattaatgactgtagatgcaaaagaattcacattaccagagcttcactaaaaagcaaaagtgacacattttataattaaatattcataccatcatcttttcctctaagtcttttcaagatgcaaacaaccaaactatgaactccagacaaaactgcaaatgtctaatgacaaaaagaacaacataattaattgcaagctcaattgaagcacaaaaaaaatgacatatgaaccaagtatccaatgtaaaacaagcaggaaaaaaaggcagcgagattctcaatgtacctttgcataagaccctgcttctacaaaggatcctttaaaacctttcttcttaaacaatccagcacctgaaacacaccataacatgcatcctcaagcaaaatcagtaaatcttcgaagaagaattcaagcactgaattcttaacatactatagacagaaacagtaaatcttcgactaaatagttgaacgaagaaattaggcttaaacggtaattagtctatgaaacgacggcgtaatgcgataatacggagaggagagaagagaagagaagaaccgtatccaaagatggagcccatgagagcgccgccggcggagtctgtggcaaagcggaggaggcaaacggcgggagcggcggggacgagggcgttgggagaattggaatcgggaacagtgtcggaatcttgagtctgagaggttgcgtcagaattcggcgtcgccatagatgatgaagacgttgaacctctcttctgtgtcttctgcctctttgggttttctctttttgattctattgtgtgcgagtgagtgagtgatgttatccctttgcaacatcctccacgacgctgttctattcccttccacctttttcactctttttaagttttaaccataacgtacattttgagataaaactatttaaaaattaagttattttaatcaaatgctccctccgttatattatacttatcatcagaaaaaaattattttaaaataattattattttattttaatatatatatatattagttttttattttattctttataattaatgacgaacaacacaatatataaaataaattaatgatgataagattaattttatatatttttattatttttatttatttattattattttaatttatataaaaataacctagaacaattattattttgagatcgagagagcacaacatattatcgcttagagcttcttctttttttctatttttaaatgtactgaaaataccaattcaaattgtttgaaaggatatttgtgaaatcctatgtctggaattgaaagcttgacataataactgtcatcaactaattatttaaaaatatttagatattaaatgaataatttatatcgaataagtctcttcattaataacagaaagaagacatgaataatttttaaatatataatattaagacgtttttcctgcttttgagattatttttatttataaataaagtgtatttaaacgagattaatatgaaaagctttttttctcccgtgtttcaaaagtttttattataaataaaaattttacttacgactgaaagctattgaattatttttccaaaaacttttattttcccattttatctttagcaattaattatttaaaatataaaactaattatcatgaaaaaacttcattcccttgcctaaaatatactcattctcaatataacaaaaacaattaatacagtattttttttatatccttaacttaatatagccttcacaatattttaaagtacaccatatttgtgagttgccttggtttttgggtacagatttgtgtgagttgtgtttgtatccgactatccgttctaaacaatatttcctcaaataattcataaaaaaatctgtagcttctgtatttgccagcaaaactcaagcggtaaagaacaaataattcgatgttattacttttacctactgtcagtacaaacagaaaagaattcaaactccaaaaaccaagtgctcccacagcttaaaaaatagaatgaattttaaaacaacacacacagcttaaaaaatagaatgaattttaaaacaacacagagaatataaatggggtgtattgatccaagaaggatcttctgatgctagacaaacttttggaagtttgattgttaaactcatcaattgttaatcaatccaactaatgtcgaattaataatgctgttgatagattgctccaaactctactctccatgcctgatcatcatgggaagttgcatccttgtgaacatcatcagaatcctctctatatagtggctgcagtgcagactctggtaatttgctctctgcaaggtactgtttcatggtaacaatctccatcttgtgttttcttttcagcttatccatttgcttttttagcttttcatcatcttgttgcacttttctgaaattctcctgtataagaaatataaaaatcaagagaaaattagagttgtccgaaatggatcatcacaaaatcgttttccacaagtcctatctaatatctattgattttagggagggttgcgttaagcataaagtaatgcacccccaccaagttagttcatttatcaaatgcatttgaaaaaattgatgggatttttacctctgcaacagacgctgcatgctcagcttctcttagtctgacaagtagttctccagcagcatgaacagcttctgcagtttctctaagttgaatcttgagattcatgttctcctttttcaagaattttgcttccctttctctctccaccctcaatgcagaaagctcagcagcaagagatttggcaaagcgagcatgtcccctttttccagcctttgccgctgctttcttcacctctgctatgccttccattatagcattgtgctttgcagccaaatcattatatttttcttggaggtcggcatagtgttccaccattctaccatgtccgagaaccgctctttttagtgcatcgtctaactcttcagtgcacttcttctctaaactcagttccatctctaccctctctgccctctgacgaatggactcaagatcaactcttagttcatccgtaagacaaatccactcactttccatttctgtccatctctccctctctttctctagctcatctccaccattatcaagagaaaatacaccacttttttggagttgaatggatcttgacattaatgataaggatgatcttagtttgtcggtggactttttaactggtgcatcactacataattgcatcctgcttcttagattctgaatctccttaagaagttcttccttctcagctgcatcgaaagagctgtctctttgatttacgtcttcctggacttctttaatttcacaattttcctctataatacctggtaaatgcctgtctaaggaagttccccttggaagctgcaaacaacataaaaggtacgttaaaagggcgagttccaaacattccaatggataggactttatattgttaaattacaaaaccaacagttgaccttgtcttcatctttcaatgagttatactcttcttcatccctagtcagtttattgctttctggatcatacacaatgatggaagattttacttccatttctcctttcaatttctccacctggacaaaccaaactaaattgtcagtaatgtaaaattcacaccacagataattcacgagggcatgactccttataccaattgatttagttcttcaattctagcagcttgcttcttgcaaactttctctagttccttttctctcgagattgctttatccattatactctgtaaatcctttaagcataaaaaacaaagataaatcagttttacaagaaaattaatcacagaactttctggaaatcgtctataagacatacttttggaaccttatctgtcagtccatccggattctctgcttcagctgtttcaactcttgactttatgctatcttgaacctcagtagaatcctgatcgtatattcttttaaggcaagattcgcaaagcaagctagcagttctttcatcgacagaatatttcttctgttgcattatttgatcacaagaatcatccttgtcttctggacaaggtgtcaaggttaagcactcaaaagagaaggaagttgaagatttgtttaatgctgagtttcgctggtgataatcaattatctgcaatcccctctgtaggcttgctgccaaggagtcggtaggaccttgaaaaaccttgctggaacgtagtgacgatcgcatctgctcaccctctttaaatgattgccttaatatatcattactggaactcatattctcctctgccacattgttccaacttccaagacaacttggtgaataagccacacttttcctctggacattcttgatttttggagactcagacaactgtggttctccaagtattggagaccgactacatgagctaactgaaatgctatctctgaatgtagatttaattgtccttgaggcattagctgtgcatgcaaagtcatctgctgatgcatccaaggtggtagttgatccctcagtttcctcgggacatagcttactcattgcttctccataacatacttcctctttttcaatttcatcaccactggtcatatctgtgtcacaattttccgcaacagaataatactggacacaatcttcactgacagatatgtttttagggttctcttcacacgaatgatacaattcatcaatctgctggcgtaatttccttatgtcttcctcgtccacatttacctcttcatcagtgtcattatcaatgcagggtaggagtagagagcggtttaagctgactcgcaactgattaaggctgtcccgtacattgcgtacttggaggtttccatttttcctcccatctgagctatgaacttcagcctttgctctaataagttcttcctgcgccaaagcaaacacataattctgtgatgtcagatctgtatcaacccattaaaaactatgtcagtgaagtccttaagataaataataccttcagtttccggatttgatcacttaaatcattaacatcctcctcctttatttcattgataacaggttcatttctaatggttcttactcgctgtccaaacctgagagtgcgcagcgtttcaccattattcctacaatcaacaaatacaatctttaccactagaaacaaaatataagatgtctggcatacacatgaataggtaatgctcctcggtccaggtaaatacttgttatcaggggagatggaacagattaatgagagtttggcatttccaccgagtgattcttgtagtaaacgagttaaacaggaattcctgtttgaaatttcttctgctttttctgagtgagtttctttagtcagggcttctaccaagtgcctacagcagtgaaataaaatagtggttacaaagaagtaaaataaggacgggataacttcacccattaaataaataaataagaccaagatattgctttcaaccaacactagatgcggtcctgtgcattttgctcggaagagacaaaaaaatgcaataaacggttaaaatcacaaataacaaataaaaaatagtaaatggcatgaggcaggaatggaaatcaagagaagccacgtatgtgttgccaggacaattttaataaatatttggataactgaaaaactaccaactttagacatttgtatctagtcatgacatggcatcttacccaagctgagataaggacttctttacattcttgtcttcctttagacattgcttgcctgcatcctcaactttgtttctgtcctgtccagcaagatcaataaggctaattctgctagattttgaactactgaaaccatttgatgatattccctgcagcaccagtcaaaaaaaaccagaagtagcgattaactaagagaaaattaacaatataaatctgtgtcaatcttaaataagaaaaaaaaaaaaaaaagatgttagtcttccatagctagtcactttaaatacaattatagtgggcaataccttacaccaagattcaatcacaaaagtgaaaattatatgtgatctagagctcttagaatttaagcttgttgttccaacttttctgcttgaaaggccctgcagcatataaagaccaaattagctaagctgataaagtataaatagtatgtagacatataatattcaacaatatattatatttcctttgatgcttccgtagtccctaccttaatcagaatttgtgttacatcatcatagctagtgacatattcctcggtcagattctctatatacaatgcatttttggaatcatctttcatctgcaataatttagaccagccataataagcatgcagcaatcgaaaactagtgtattagtcttttatgataaattgtagcacaaaaggatggcatatgcgtgcctcaaggttccgctgggttggatcaagtaaatccccaatttgttcgttgtatatctgtttcaaacaacaaatgaaaaagaaacaagatcatcatcatacaaacaaggaagccaaaatgggaagttttataaagaattacctcaaggaaagaacatcgacattggtagttgaattgtttcccgtcagacacatgctgctcctaatatagtaattgaaaaataaaaataaaaaataatcaaaaacataatagaaaatagatttagtggttaaagcaggaagtaaaacgtactctctccagctcagaaaacaacatttggaagatccgaggaacaattcccttgtgacttttgggcgagggctcctcaaacatggcacttgggggaccccacattgtataagtttttccacttccagactagcaaagaattaaaagaaaaataaaaaaaatccccaacaattaattgtcgaacaagaatgccatttttttctctcactaaaaggttaaaataatatagcaaacatcaagaagtacctggccatatgacagaattgaagtgttgtaaccagctaaagcattcttaaccaaagggacaccaactgactgaaaaatatcttcctgaacaaacaacagcttatataaatcacacttatcttctcttaacagcatggaagcaaataaaatgaactattagttgcttcattcaccaaagcaagtgagcaagtcatataaatagtaagtatcataatcctatcagagaaaattatttaaagttaaaaaaatactagttgtttcatttataaaagcaagtcatataaatagtaagtaaattaccttaatcctatcatggaaaattattgaaagataaagaacataaatcacaaatagcacaatgaagtgaagttatttacctgattggtgttcgaatcaaaaactgaatcaaaggtaaattgcctatccccaacacacaatgtgtcagaagaaaccttcttaacagttcgatctccctctattccattgttattcgtaggtctgatccgtactacaacctgtttcagaaccatagtataagcaaataagcagcagaaattttttcacatacgtcatacctatcttcagactcacagataacaacttcaatgttcaaaaaaataagcccaaaaagagagaaaaattggcgattaccttgactgatgggtcggattcaagagggaatttcgattttttgaggttgttctgagaaattgaggttttggactgtgattgtttggttgtggaaggcaacgattgttcatggttgatctggatgttgggatcggtggggggagtgttctctgcatctgaatttgggattttagggtttgaaatggttttgtgtttggaagagagtgatctgggaagaaattttttgagggatgaggatgaaatggtgccagagaaacgagtctctgcagtttctaagttactgctttgtctcatggttatggtttcgctgagcaagcaaacaatttagcaatgaagctatacacagagagagagagagagagagagagagagagagagagagagagagagagagtgataaacacagaaagaatgagagttttggattcaaacgttgatagagtgaagacagagaagagaagcaagtttttgaattgaggaggtttagatgaccgttggaagaaggataatagccaatgaaattaccaaattatcctttcttctttcctaaagacaaataatggcttcaaacaaagaaaaaaaaaacatttaatttaaattgagcttttgttgtgactatgatttttatattcctatgtttttcttcttcttttttctctctggatattataagggtaaaacatctcaattatacaatttggctgcaattgaaagaagaattccgtaatattaatatttattaggacgagatgagaaagggccagatatgtcaggaaaattattactctaacctattcatgtaaagggtgtaagtatctaaataggtcaatattaaatctaccataaaaagaagattttgctgtatgtcataatgtgacaaacttatatttattttcttaaaaaatattcaataaaattattttatttttaattctaataaatataattaataattaaatgtaattaactaacattaatataacatatttatgctaataaattaattattcaatatattgatgttaataaattaattactaagcacattacaatatcaagaagaattaataacattgttatatgaaaaaaatcaatactgataaattagtgtttgattgataatattgatgtattgaatatacttaatttctaaatttattatatatctttttacaatccaaatttattataataaattacattaattatcactttaataatttaaaattaattcaatcaaataaaaaattgccattatatttattctacatgtgatttttttctctcttctatttttcagttttattcacattccaaagaaaaattatccataaaaattggtaggaatatataatcaatatttattctaattaaatatgtattttaaattctgaattgtaataacttttaaaaatctttattataataaattaaaatatcaattaagtaatataattatcaatttaatgtatagtatttgttaatattttaaatttaataaaaatataatgttatactacaaactttgtccacaatctagtatcctatactaaaaaaatacatatttaatattttaaattataatatttatattaacataaatttgagcaacacacgaatatgatatttaattaattttggtctcttccacactcacataattaaggcatttgcagataacatgagcttacaattcagactgtacatgtgatccctcttgacgcacttaactttaggtgaatgattttgtgatgactattgctccagttgccacattgagaccagcatgaaatgcaagcatgtaaagccagcttagccccttaagctttctagctttattcacacactcaactttaaacttaattataacaacagcatgcattactcttgtgctccctctattttcacacacacaactctacttagactttaatagataaaaactttaaattaaacgttttttttctgtggtgttttgggctggaaggaaaagttagtccaacttgaaattaaaactagtaaaattttttttactaagattatgagctagctcacataactgaatgttttatcattatgaacaatgatattttgctttttaaaacatttatttaacatttattattttctctgtctcttttcttatcatattatattatttataatatttatattttctctttttttatcactctcactatgtgtctactaccatattagttctcaaagtattattttcctactgttatatattagttttggatatccatttatcttttatccatgtaaaagatatgggagtagtttgattgaaaacgataatgggaaatgaacatatatgatttcaatttttcgataacagtgtcgagattttccaacactttttcagggtttaccttttatttggcacaatagcatcaatccacctgggcaattacgcaaaattatgtaactaaatgtacaaggcataactattttttcaactcacaagccaacatgattagtttggaattattgaaattaaaaagctcgagtttagtttccaccgtcaacaatttccttatgataagaatcatgtggttagcgccgaaattaatagcatatcttctgccattaagtgcatttttaaattttagttaagagaaaaagaggtttttttactcttaaaacaataatcttttttcttcttaattttatgcattagaatccataaaactagtttctaatatttatccaaatatatcctgaatgggataatctccttcaaatttttcatcacctcaaattttttatttttatatgtgagaatcaaaaataaatatcaaaagttttataataatttatatatcatgttcaattaattgaattagaattcattgatacaaatcttttgtcatctcaaaataccgaaaaagaaaagaaggaaatcagaggctcgtcctccatacatacatttcaattctatcacgagccaatagtaatcgtagtttaataattacgtaattagctttccagaagcttatatcatttttattgaaatggtacaactcactgttaataattgactatgccatttgttcttatatgcaatgcaacagcgaattgcaacaatcaaaagtctcacatggtacccacatgtccttcaaatccaaaaaattcaaagaagatattaaaatctattatattaatttagtatttatactagctttattggtcaataattttcattacggtgtctaatatctgaaagctttgtacgcaaattacggcatccatataccgactatatatgtgaaggatgaaaaaagggtatttgatgagcaaaagtagaaaggcacatgaaagcactccaatgcacatccttccttaccgatccaaaagagaaagtaaaaggggaagaaagagcatgcagattgtcacggatctcactcacttagttaaataaatatgtatgagttgttgtaaattttggtaatatctttaatttctattaataaaaaagaatatatagaaataataataataataatgataggggacttgggttgggattctttcacgacacgcgtcacatttacgaaattaagggaaaatattcaatcggtgaagggcacgagtagttaatagtagtgggtcacatcttattttagaactgaaaaatttataatggatgaaatatttgataaatttcaagagatattctacaataatagacgatatagtcctccgaaagatataattaactatgatagtttgacaaaaaattgataatttcttacaccaataaaattatactatattacattatccaactttagaagaagattaacatcacaagcatctaacttttaagagaagatgatccgactatttgggaaatcctcttttaaaaattagttgataaaatatatgtttggagtcatggttttttctctctcttttaaataaaaatgaagataatataatttattacacttatataagtatgataaataatattatatccattacaagttaggaagtgatagtatgatggaaaaaaagagaagaataagagataaagatagtgtggtcaaaataatgagatgttcaaatattattattttattataaatagaaaaatcaaattaatgacattttggcaaccacaccatagagaacattttctgaaatattatcaaccaactttaatataccttaatttatataaaaagaacatatttattgatataaaaaaaaaaaaaaaaaaaacagaactaacagttaaatacttcacccaacattccatattactcaataatgtgggactttgagacccgtaacacccagattccttatcaacacatcatggtttcagttgctatatatatgctattaagaatgctttatatattcatagatagtgctcaagataaattattgtaggagaaagaaagttcaacaagtaaatacgaaataagtaacaaactgacaaaacataatttctctgaaattgttttacaaaaacgtattcacgccatttaacttctcttccaaagacacaattgagtgttgttgaatagtgaactagtgacgcccctgttgtctacctccaagtcatttttcttttcttttaaggtgatacctctaagaagtcattttgagctgatgaacaaagcagaagaccccaccatgattaatctttgatttttacgtaaaactttggtgcaagagttgcaaaatacgtcggggaagcatatgccatgggacccacgaatgaagaaaaagggcaaatttctagaacaaaagtgcaaaagctcttctcataagtgggcgaccgatggtatcatgcgaggaaatctctcatgttctagactcacataacatcaatgcatttcctgcacaggattcctgcacaggatttttgatgatcaaatttgacttcatatttttcttcacataaaaaaatgacacagaaagagaaacaccaacaatgttaaattgctttatgggattatacatgaaaagaaagagggttaattgattatttcttgatatgtagttgtaactctataaacccaagactcgagtatacgtaattaaggtatttcagaataacatgaacctactggctgagcaacaatataatgagactgattgattgttcatgttcatcaaggtaaattctattataagggtcttcatctatatagccatcaaattcaaatcttactgagatgaagagtaggaaatctccctggcaaactcaggtcctgagtgctccgatcgagaacatgtgaaactttcaactacttgtcaactatacagtaagattcacttctcaactactcatatgtttcataaaaagtaactctttcaagtgagtcctactgtgtggtataccttgtcaacatgtgacacttctaaaattatttttagatacctagaataatattatttacttatttattttaaaataaaaaggttaagtgaatatccaagtgacaccaactagtctgtgatactatgtcagcatgtaacatttctaaattatttttaattcttcaaataatgttattttttaaaataaacattaagaacttaaaacaataatttcttaccaacgaggattgagtgcagcggaagagactcatcctcacaaactgacaaatcaaggttcgaatttatacttaaagagattattttttttattgtttgttagtgtctcaaacaaaattacctctaaaaatgatatttatgaagaaaaaaacaatgatttcacatttaggaaggatatatgaaggaaacaaaaaccaaaatcaaaatttactgtttttataaagatgaaaaacactaatttcatattttaaagggacacaaattaaataatttttttataatagctaaaattaatactaactcatttttataaggactggatataaccgaaattataacatgaattttttttgtaaaggatgaaaattaaactattatcttataaattattcttcataatcatgtgaaagcaacaaaaaagaaatatcatggacatatacatcaagatacataaatattttaagtactctctaattagagtttttgtttcttgagactctaagatatcccacaactacaagcttgaccttttggacaaattatagaattaatcttcgaatccaaacttaatcatatttaaaattctttgttctttctcatattttctctcataaactgaatgtatattatcaactaagttatattcattagttttgtaaaaaaaaaaaagaattatcttaaatactacatagttcaaacaaaattatctgtttataaaatatatatgtataattttaagaaaaaaaagattatacactaataagtaacaatgtaaaattatcattaaattacaatttataatttatgatcaatttattaaattttattaaattatcataaaaattatacaaatgataatttataatttgataacaattttttaagaattaaataataatataaaataattttatattatttatacatcaccaacatcaccattaaactttaatttgtttaaaaaaaacaataaaaaacactagaagaagggacagaaatgcactcactcaaagtcgtaggtgggggcagaaagagaagtgtggagcagaaaaagtacaaagaaaagtcataagcagcataccccacctccaactgcaaaatgcacacaactcccttctcattggtctgtctcagccattcgcgcggggctgccgcatccccttccatttccataccttatcctctctctctctctctatccccacacacaacaattgcaataaatgagtgccctctgtgtatgcacagcaccttattaattgctcatatatactctcaacatacatactccaaatacacacaacaaaatcatagaccaacacacaacactacagcacctctagatttttattttcttcactgttcacactatttcctcctttcctttcacattatcccttcccttttttaaacaagccatcttgcttttgttccttctcttctcatcaccaacacggtgtgtgtccttcattctggattagggccacaaacataacacattccgctttgactttggaggctaagggcctaaggcaggtatgttaaaccacaacaacttaatcatctctgtgtttttaatcaaagtctctcttctttttttgtttcctgtttctctctgaattcttgtatgtttctatttttactttaactgtttccctcccttggattccgctggtagtttttctgcatagagcagcagaaaaaaaagctagtagctttattagaatctcctcaaatctggcaataccctttattcttattgatagcttttaagttttagccggttctgggcatcttagtatttctctagaaagtgaaaagtttcaattttgaagctgaggttctggttcctgggaattcgtttcactctatttgggttttgtggaccttgatcctcaattccgtgtttctctgctcttagctataaagttaaggtatgaactggggttgttgtttctgaattgccttccttcctgttagttgacaactcacgtgacagcccttaggagaaattcagattgaagcttcccacttctctttcacatttggggattgagtgttgcctttcctttttcttcctttttctatttttttgtacttcacaattcacatactagaaactttctatctgttttggatgtgcttaatccttcctgggctgcaaattgtaaggaagtattttcaagctgagttttagcagttttggtcttggaatagtgaattttgagttcttcctgttccttgttcctgtttgaagtttgggtttaagttcaaaaaatcatttgtgatgttggtttgaagcttagcttaacatagagtgacttgaatttgttgaaggtttttttgctttgtcaggttcccaatcactgtgatatcatggaatccccacaatctgttgtgtcaccattcaagagctctgtcttgggtgaagctgagaagtacaggtctgatgttttcacacaaagctcgggtcctttgtctaaggacattgaagtcaatggaagggaagctgccgaggttaatccggaggaatccatcggtgttgttgatgtttacattcatcaggccagggacattcataacatctgcatataccacaagcaagatgtttatgctaagatttgcttgactagtaatcctgagaatactgtctctaccaagactgtcaatggaggaggaaggaaccctgtcttcaatgagaatcttcgtctaagcgttaggactgttgattctgctgtcaaatgtgaaatttggatgctgagcagggtgaagaattatcttgaagatcagttgcttggttttgctttggtgcctttgtctgaagtactggtgaaggatggaaaacttgagaaagagttctctctttcttcaactgatttatttcattccccagctggttttgttaaattgtctcttgcttatatcggtgcttcacctgatgttatggctatttctgcaatgcctactgagttggccgcaaatggcaccgagaaggactcagaatcatgtgagtcactggccagagatttggacaaaattgaattcccagatccaaaaattgtaaatgaagaccactggatggtttcggaatactttggcattccatgtgaggagagccagtgttctgatagcttgaccactactgatactgaaaatcttagttctgaagcaggtgttcagattgtggagagcttctcagcatgcagtgttgaatctgtccaacctcctaaggctgattctccacccagcagtgtgttaacaaatggggtttcatctccttcagtggctgcaagctcagactcatctgatgttgctgcttccaagtctcccagtcaggaacaagtttcagccaccgaaaagaaaaatggggatgtcaaagacggtgggagtgactcctcaaatggggtgctgaatgagtcattcactaagcctgttgtgactgttaacatcgagccggagcctaatgtggtgcagcaggattttgtagacatgtacatgaaaagcatgcagcaattcaccgagtcactggcgaaaatgaagcttcctatggactttgaaagtggaccaactagttcaggaaactctagctctgaacagaagatacagacaccaaagagcactaactcccgtgtgttttatggcagcagggctttcttctgaacttttggttacctttggatcaagggaatactttcaggtgacataggatttagaatgaaaactgatgtcagtagtgaaatgaaataatgcactgtccagtgggattctcgcttctgtacttgttgatctgttataggtaacagggaatcttaactttgtattctcacaggcttggtcctatcttaactgctacatgaacttttttctgtcttgatcttattttcttgtgtttctttttgttttggatgtcaatattttgtgaaagcgattttcatctggcaaaagtttcatgctgtggataatcacgagtggtactaacatggtccccacgttcacatggcgaatactaaagttgatggaggtaccaaatcatctatgattttgatttcttctatttcacacgaacaagagtaccgtacagcatcatggatatgcttttctttttctttttcgtgatttgggccttaagcctacattcttttatccaaattaaacaactttggatatttggaatgatgctgttttgttacgaaaatgaaatactcctaaaatttgaggttttgtactcaattttggatttttggaataatggtgttttgttaacgaaaatgaaattctcctaaaatttgaggtattgtactcaatgaaaattaaactattttctttatatacaactatcttaaattgttatatacgatatggatcctcgagttcacaagtgaactacatctgattcagtttaaatccaatgactttcactagcaacacatttaaaaacacacggtgctgacaagtgacagaaaagttttggaaagacactcacggtgcgaaacaaacatcatccgctggatatgaatttttaaatttaacatcagtggttaaaatagtgatgaactacggtggaaatccctacaccggataaaattaaaagtattattttcttaataatttgagggattttgatactgtgaattttttaatcaataaaattatgtcatctttttaattaaaccctattttttaaattactttcaatgctctttataaaaccttaaaccccaaaagattttttataaaaaaaagtgttgaaaggaaactaaaaaaaattagaattcatactactaaaattatttttaatcatatttttaatttaaaaattgaaaattaaaaaaaaataaggactaatttgaaaagaaaaaaaaaataactaatgaaaaaataacatgtaataatattggttaaaaattaagactgtcaaaaccctaaaattatgcaggtcagcatagaaattatttttttatttttctttctcgatatgtccttctcccttcatagtatccaaccatccctccctctctgacaccaccccgtagtcgccactgctccgcatcgacggtgtcaacagagaacaaaatgaaaacgattaatgtcctccttagatctgaaatccgacctaccccgtcgtaaaacccaccgtcacaacaccgtgaaccaccacgaatcccccacctcagcggcagccgcaactcctccacctacaaattcatcccaaaaaacgcatctttttttttttttttaaacttgcctacaaccccaacgatgaggaaacgattctccccaaaacccaaattaaaccacacataacaaaaacccattctagttgaatcctgaaccaaccaccaccgcacaaccacggcgaattgatctcgcgagttgtagtgcgggagagggagagagagagagagagagagagaaagttgaggtttgaaggtgtcgagagcatcgacgaagatgtgagcggagattggaagttgttgagattggaaaagggaaacagtgatcatggtggaggtgaacggcatgagtgcaactgtgcaagagaagaagggtatgatcgaaaaaatatattatttcattctggcagtgtgcatatccctttggggtatcttaaaaactatggtgtgatggcaagatgcttgtagtttgaaaagtagttgcagagtatcttaatttcttgtaaatataattggtagtaaccaagccaacccgtgcattgtagggtaatgcaaagctagccaactagttatagttataagctaaaattgtaatttggacaaggcaccgttccttgaaaaaggaagcttctgttcattttgtaattctgatgtggaaacgcatgatcgtttattttttcagtgcagattttctttgtatttggtcagcagttcgggattggatcagatttcctagaagaaatatttcattgcaggcactttgaatagcttaatccatcagcatgctacttccgatcactttgggaagatgaggtgcttggctctggcattcacagtttattgtatttggatgacaagaaactgtattcttttttatggtcaaactttaaatattgttgatgttattgagaaaattaaatttcatgtgcttaagatggttcatttgttatacttgtattagcaaatttgtgtttgtatagaagttagttggctaactctaactattatttatttgcttcttttggcaaatgtaacagaactcatatttttccaaaaaaaaaaaagtcgttttcccaacttggtattctcgaaaatacgcaatgaatatgtaaaacaaagccctccatagaaaagaaagtggtaaaacataggacaaaagtaatgccaaaacagaagacctaaaaaaagtaagtaaaagtatgaggaaaccatgattattttagaatataatttactgatcacatctatcttctactcttccattttttttatttaaattaataaattttaaaatataccttttataactgtttaataaaaaaattaaaaaataattttatatttttatgcaatttttctttggctttaaaatattttttattttaaaaaaatatttgatttagcaaaagaaaaaattatagttatttaaactttaccctcatctcttatcatctttaatacataaaataagagattattaattaatgaaatgagaatattttaataaagaataatttaatgttttaaaaaatgttttcatacagatcaaataatgatttgtaaacatcaatttctattttcaaattatgaaaatcggcataaaatgtgtatgaaaatatatctatggaagaaatgaatctcttaaataaatattattactttgaaaaattagtgtttgactttaagccgagtgatatgttatggttaacaatatgtagttttttatcactactcctattataatttatatgtttacaaaaattttctaacattttaatatccttcatcgcgttaaatatgactcgttcgtcaataaaacaattctatttgtaagctgtgggacaaattgttactcctgtcacaactttacagagtctcgtatatcaagtaaaaggtggatgaacttttagcagaagttgtaaacttgttgtaacatctcatttgtggcatcaattatgataccatatatttgattgtttgcaattctaaaggtcctaccacaaagattcaaccagcctaagcctatatggactgtgatgtgagcattggtatgatcacaaaacttaaacaaacacacacggcatgaccccaatcccataaggaaaaacatttgctggcaaagaccgacccaaacagaaaagcttactagaatgcctctccgtgaacaacccaatgtagagtataaaaatgttgcttgttttgactgcggacactataaggttatgggcttatggcaactctataaccaagctgattcgataagaataattaattgatgaacagacagtgtaaataatttttacattgttatttgattgatgtccatttttacattgttagctgattcaaaataaggttatagcaattataccaaaattttggttgacatttttcaattcttaaaccacgtttaatacaagagcaatttttttatgtgcaagaattatgatttctgaagattatgaatcttaggaattatattttttggaaatgaataaaatttgtttgattgattattggaatcttaaataagttttttaaaaatcaaagagttatacaatattttcactaaattaaatattttcactaaattaaataatttgataaagagtaagatgatatttttaatgtattaaaagacaaattacttgtgaaaattaagattttcacctttttcattgatttttttatatggaaaattgatttacaaatatccttttaaagaaatattatttttaaaaaatatatcaaacatggaaaactaagtttttcaacctataattctcataaaatcaaaaaatattcccctaccaaagtcctcctacagttagtttaggaaaaaaatgggaaggatgaaagagaaacaccaatttttttattattttctttgtttggagcacttcaaaaaagagaaagaaggaataaaaagcatgagctcacacgcactaataattcttccaaatgtgaaaagaaagggaaaggaaagtttatttaaacagacttaaatacccctttttttttctatattctttttcatcttcaaaatagaaggaaagaacctagtacctacacacttcaataatgcctccgaatttgaagagaaaggggaaggaattcttgcttaaataactacaacactggacctgtgctttgcaaggtcaatggaaaactaattaataaaaaaattgcaatttgcaaagagataaatagaaaaaaaaatgtaaaaattggcacaaaatggtgacacgtgtctaatttttggatagttttatgtaattataaataaagattcaattactgttattgtatgtataattttttagtagatatatttacgtcatttttatattcatattttgtatttcatttttttctaaaaaatcaaacaagagaagaaaaatttgcaaagtcatctcaattttcactcttttcttttctttcacttttatttcctaagccaaacacaaacacacattttagtgcatataaattaaactaattcaataaataagttgaaagagacaaaccgatctaaatgcactgatttaaatttcattaatatacgatatataggaaattgcaaatatccattgaaattaattaaaagtattaatttaattagatataaaagctccaaaaatgttataaaatgaaaaaagaaatacacaagaatatgtcccgatgttagcctaaggcatattgcttttgaaaatagttatggtatcatatatttcaatatccccaacatccttatctatagagcctcaatttcattcatgcattgttttcccattcaaacttccaaggagttctgaaacgaaacattgttatcatccatgattttgtcattgccagtttgccacacgctattgtcttcaaattaataaagattccaccatatgtctacaaccacaaccttcaacataattgaggcatgtgcatttatatggatttgcatgtgacaatcgtctaaaatctccaacacaggcttgcatggcttagaataatgatattctacccaagtattgtactaataattgtgcacatccaagttaatataagctgtttaatagctaagactatggatatatatatagttatatacaattttgtgtgtcctctgtggggagagagagagagagagaggaccacattgtaatggggggttttcaggggaaaactgaaagtgatacaagacaaatcatgatccatataaggataagagttagcatgaccacacacaaattctatcttaagatccaaattggaattgtaagaaacaaccaaaaaactaaaaaagttactatttagtatttactattgacaaacataagctaccaaaaaaaattgaaccatgctcccttattttaaccaatcaattttggtccataaaaagatgctatagcatgctcgatattttcaccacaaagttacaacaaccaaacaggagagaaagcaactattatgaatagagtcgtaatatcagcaggaaccaaattttgaatgtaacaataaaccaaagtataaagttgtataacaaaagtctaacaaaaaataatatctgtccagtaactaattatttgatgggggatccaagatgggtacccctctaatgtatcaaacctgataaatcaaacagaacttcacttacaatttgatcagaaacatgtcccatgaaaaagatggtgacaagaacaaacagctttgccaagcattacagtggcaaaaaaaaaaaaaatcaaaaattaataaactatcattaagcatattaacgatgatggtgcatccctccagcaatgcacaattaaactactggaaccaatcttcctgagtatatcccgcaatctgatgttacacctcaatcaaattccaagaaaggaacctagccttgaaaaataaagacaacgaaaatcccaaaccttacacaaaaacacttgtgactgatttagcttccgtatgatttcacctttaatcagtttcccttgatctactgttaccataacatatccaattaacatatctcctaagcagcaattcctgaaacaagtagacatgcaacaaaagaaaatgagtatacaatgaagttgaaccagaacaggtaaaaaaacgtaatggaaatactcaaatgccaaccctttcacaacaatataatacaagaaagtataatcaaacctcatttttcactaacgaatcaaaggggtgtaatctatgtctatattctgttttacagtttgaagctctcaaatcctaattattgagaaaataatcatactcaattaacaagagtgagtaatctatgcctacatctctagcatcttgcaagttagtataacttcacatgaaacatcaaatttgaatatctttaaatgaaagtaatcaagaaactcaggcattattacagcaagctaagggcatacttggtttgagaatatttcttcttttttttttttcttttttttttcactaataattaaaaaaatgtcactttgttttttactttattcctgttttcaaagatttgcacaagaaatggtgaaaacatttattttatagaaaatataacttctcagtggttttcactatttcctatataaatctttgaaaacataaagtaaaaattaagtgatattttagtaattacatgcgaaaataagaaatgagaacataaaatgttttctcaaacaaaccacagaggccctaataaattaagtgatattttagtaattacttttagactgtagtaagaatttacaatgacaacatcaagaataaaggaataaaggaaacatgtcaataaagtcaggaacctagggtgtttgggataatcaaaagacatgaataatgcttccatgttatgtttatctatattcacaattctaacatgatgatcataagcttaaagacaaatgtaatagcacattaaaaaataaacagacttagttttcaactttcttcagtaatattcctattctgaaacatagaaagtccaaaacacacaattggttttatgaaaaaatggaataaacaacagacaatgtataaactatgatctaattttctacatgagacaagcatgtagtcaaagatcttacctctattagtttgtctacttattacattgtagtttccaataaaaccctcagaactctttactggatcatctgaagctataccaccaagtccaccataaccaaacgaaccagaagcatctatctcagaagcagcagaccgccaagttgagtcaccataaactgaaccattgcggtacaaatccccataggatccttcataatcaccagttggtgcagtaaatgttgaggattgaggcacacttgggctgctgttccttccataccctccacctcctaaactgatgctgttatctccaccttcataagagttaccccaagtactatacccagtggcagcccctccaccctgggttggaactgatggaccccaattggtgccaccatttccaattgaaacaccaaaagccccacttccagatcccaagtaagcgccagggctgactggactattggcagcattgttcaggcccccatttccccaaacactccgggaagctgagttcataagagaatcgcttctcccattgcccccgctattgccaataggagtggtatatctgttagagttgccattgttgaaaggactcatccgagcgtatccaagactgccaccataactggaagtccctccatagcttgggttcaatcctaaatccaaattcactcccattccataaccactggagccaaatggggtaaacccacttctggcactagtaagtggactaaaccttccatccatcctgactccataacctccaattggattcatattgaaaccctgagcataactatttaggaagctactggtcctattcaaaccatagttatatcctatcaatgggcttcgggtaggtccaggggaaagctctttaggaactgccctcttgacctcaaccatcttcccattgagttcatgaaatgtcttataaagaactctgtccacagcttcttctgaatcataagtgatgaagccaaaacctcttggcctctgggtattgtgatcatacattacaacaacatcagtaattgtaccaaactgatcaaagtacttcttaaaatcactctctgtgattgttgatggtaaacctccaacaaaaatctttttggtgcgtccaggacttggagatccatggatgctaccagactgtctgtttatagtttgctgatcatccctaggaacagctttcttagcttcaacctgcaaattgacagcacaacacacacggatcaaatctgcaagtcattttcagcttcctgtcctataagaaaatataaaagtagggacacaatgatctctatcagaaacataaatttagctaggtcccatcactgcccatccaaataacatgtatattgaaataatgcttaacaaatctatgatgaaaaactcactgtgcggccatcaattatgtgcttatccataatgactctctctgcagctgaaggatcagcaaagacaacaaaaccgaaaccgcgagcacggcctgttgtccgatctctcatgatcacagcctctatcacctctccatatttcccaaaatattctttcagacgttcgtcatcggtgtcccaggaaattcccccaatgaagagcttgccaagatccgactccatctgttctgtcaccaaccatgcccagttaaccatcaatcactcatttcatcaaacaaatccaatccaaccattcttattgaatcaaaattctcatgccaaaccaaaaaacaatataacataaaaaaaattagaaattccaatacacaaaatctagattctatattattcagtgatgggcaaagttccagtcccagaaccaatctaaatgcatagctgattgaataatgcataattgagctaaatcaccagaaagattcaatttttcatgagcaaaaacaaagcaaagcgatcagaaatgcagattagataaatctgtgaagaagggtcaccttatgttgaatctcagacagaacccagttggtgcttcaatcagatacgaagtgggttatgccaaattcgatctaagagaatcggatctttggagcatcaataaaaaaaactgaaccaaaatatctaatccagcaaagagagaaaaccaagcagctatgttttttttataaaaaaaaaaatgttcttaatgttttttttagtttgtttttttgtttcttttctgggatcagagaagaagaaattgagagaaggcgaagagatcaaaggaaaaagagaggaacccagatggggaattcaccatccaaagatgaatggttggtgatggaaacaaaagaaactaataataaaaaataaataatgagaggtcatgtgaaaatttgaatggcagggaaaactaagaatgagaatgaaaacagaggatgtggtgtcatcctctctctctcctgttttgctttcttatcttgttgcttgcttcaactaggtactcttaattaaatcaaaagaaatggaatttgaagcaaagatgggcaaaacacagttcactatttatatataaatagatatattttaagagagaaagagagagagacagacagacacacactgcaaatcgtgcaagaatatttggaggagccagcaaatgacaacagatcatggtatttttaaaattaaataaattcaactatatataaagggaaaatgtaaatcacctaattacttatttcttttaaataaataatatgaattttcgtaaaataaattaatgtgaatatatatagatgcagtggagttgttgaacaaattgtttgttatagtaattattaatttgatatattttatattttatatagatataaggtagcaaatccaacctaaaaagaaaaaggtaacaagaaaaaaataggaagaatacatgtaccatttaagtgaataattaattaaaaggaaaaacattaatttgacattttttttttgctgaatggacattaatttgacatgtgttacagaaggaaagagaaaaatatacacaaaaaatatctgactttaaaaatgaaaatgtaaatttattatataggatcaaatttgattagatattttattactatcctctctgtataaattatatatatatttaagaaaactaatttatgctttccattacttggcatcatgttccaaagaggaaattcaattggagatgcttttcatctaacagctcgcaaaatgcaaaaccgttctggaaataacgaatgaaatgatgatatttgtttcaaagaatttggactaatatttacttcaaaatgcatattgaagtagtagtcttactctcgaggaacaattaatatttgtaggtgatttagctcatattatttggtacaaaatcgtcttttttagattttgcataacttttttttttgtaaaagtgaaaaaaatataatttattaattgttttggatatggaatggtatatgcatacttaggagaagaggaggaggaggaggaggaggaggaggaggaggaggaggaggaggaggaaggggagaggaggaggggggggggggggggggaatcatcggattggaaataggaaacgccatagcaataagaatatgttacgtgacacttcaaattattttacgtattgattacacacagagataaaaacgttttaaattgttataaaaaaaaacgttttaaatttatgatagtaagcatttttcatccttaaaatttgtgttcagctttaatatccttacccatccatgatcatgatgttaatacaaataatgatatcttaagattttgttcttgtaattttttttatattatgatattgagttattattatcatttttaatggaattttttctttcaattacgtttttaatctccacaagatccaaactcaaaattttatttaagaaaaagagtctaaaattgttcacaccaactacttttcatgctttggattcaaaatgagctttaaatgttgcagattattacaacgttttaaagatagagtaacaaaagaattaaaatgttaggttattgtgggagtagatggagcatcaacttttttgtttattttatttaaaatttgattgagagttttgatggggtaacaactgaaagtgcagctcaaaccgacgggtaattcctataaacaaaggaaaaaccaacaacaaatgtctaataactattattattattatgcaatgctacgtgaacactcaacgttgagttacaccaagttgacatatgaaggaaaacaagaacacggaaagactggttggtaacatatttttccacattcctatgatcagttggttcctcctatggacaccttgaaagctactctaaaatgcttaggcagagatcgcaatatttgaagctgaatctggagtaaccccttaccttgggttttttccaaaacaaacccatcataacgtactacgtaatcataacgcattgacctcatttttctttttcttatttttaaaagcttatataagaaatattgaagaagaaaaaataaagtataatactttatgagtagaaatgaaaataaaaaataaaacatttttttaaaaccaaataatcgtaattttcttctctaaaggcctttctattcccagttggatttcttttactgcagtatgagcccactaggcggcacagttcctacacgctagaacattcaagtgtatggaaaaaagaaaaaaaaaaaaaaaaaaaaacccttaaagtgttgaaaaaacgtaagcacatttaagcggtgaatcaacactgcgaagaccaataaatagcagagggaaacccaagtttgaccttaggatttggaagcctttgatgctactcaacttagacctcagctgttgagacgctctttttttggactttttcatagtaagatgttattttccttgagctttcttttctaaacactctctacattttacacaaccttcaaatttcatatttttgttggcaagttatttttcagaagtttggtatcataaagtcatcatgttcatataataataataataataataataataataataaaacttttactcggatcaacttcatagtaacaggtttagataatttacatgaggtttcgttctagatttaaactccattgtcactattataaaaagtaaataaaatttctcacataaatatttcatattaaaaattaaactttttggtaatcgggatataataggatatagttatacatgaaaattaataataaaacttctcacacaaatatttatgccaaaaaaaaatatatatggaatttcatattatttttcccttaagttttccaatttgcttttgttttgattgacgaggtaagacaaatagggatttatatggattggacatgccaaatagataaacctgttagagcaaattgattaaaagcctctaataagctaatctgaagttaaaatatttagaaggggaaatatataacagagatcgaattcctgtactcagaatttatgtttcacaatttcacttgaactgactcaaggagacataataattattcttcgattaactatttcattgctttatcttttttgtagcagtaattatcatccgcacacgctcattgcttttgaaaaatcaacccaaacgagtttcaaacgcatgacatgcttatcattattcatctgttcaggtgggtaaaaattcaagtaaaacccacaaatccaggtagcttcagtagggcttccaccatgccacactcttttgttttgggataaataaaaaataaaaagttattagcattttagcatatattaagagttaggtaacatcattgtattctacagatatgttattgaaatttcagatggaatgtacatgattcttttccttgtcctttcatgataaacaagttcaatttttttggtctttaactctgtttcatcaagagaaataaattgtgactaatttgaagtatattttagaagataagtaaagtttgacaaatgatcaaatttggatattatttaaacaattcaactttaatttcagcacattaatcatttgattaaacaaattcaattttgagtacacttatttcaacacctgtctgcttttgcttgttgtctatataatcaacaacttgaagcatatatagctacatttatatagcaaaatatagttaaaaaattcataattaacaaaatattaaaataacatgtatcaaatcaagttcaaaagcatagttccagaatacaggattaattcctttataacaaaccgatgactacaaagtatcacatgtttttctactagataatgcccatagtttctaagtcatgtgggactaaattagaaaagctctcacacaggaatcactatgatatataaataggtgaatacatgttattatagggagcatgaagataaatcaataatttgatcctggagaatcccacgtttcaggtatgattttgtgaagtgaacaacactcatcgtggttggatccaatggaacagcatttggaagcacaacgttcgtgatgttgttcatgttgatccatgacctcctcaatcttctccaaaatctccatagtggttggcctattttcttggaaacgtgacacacacaagagggctatattgagaagaggaaatgcccattgatgatcattttccctaacctctttgtcaaatacctctcctgtccattcctcccttaccatggaccttacccatctagcaaggtctattctactcacctctgtgctttttcctgttagtagttccaagagaatcactccaaagctatacacatcacccttttctgttaggctcttttcaggagctgtgtatccctgagaggaaaacaagaaacctctatttgggtccatgaattttgataagccatgctcacttattagtggctcactgttctcatcaagaaggatgtttgatggcttgagatttccatgaggaatgacctcctcctctccatccaacttcctatatatgaaggccaaaccccttgcaatcccacatgctatattcaaacgcattttccatgggaaatcttttctacctgctatataatctgcataaaaaaaaaaaatcaattacttttagttttgatacattggtggtgtgtttatgctatcaaccaattagaaataagactcttattacaaaagtcatcaacaatcttattatacatgacaattcatgattggatggcaatgtaaaaactcttcacactatctgtaattctgtatattctaaagtcattcctacttataattaagtgtcaaataacttttatatcatgatatattaaatgtttcacttttgataaaaaaaaatcactttgtttttttaatcacttattagcatttgccgtatattaatgtactaatgtggggtttcagctagattgttcaaatgatcaaggcagaaacataattactcgtgcagcacaagttagggaacaaatagagaagatgatatggagtgttgcagctgatgaaaaacaaattaatcttaacttaccgtttaacagattaagcaggcttccattgctttgatatttgtaaatgatgagtttttcttcactggtagaacgataaccaacaagggggagaatattctgatgcttcaagttacttatcttccttaatgtttcaccaaattcttccaaggatacctgcaaattcttcaatcttttgactgcatagtgaacattgtgttccaatttcaccttgtaaaggctgctgcaaaagccttcactcctcaagtcagcggtggctcgaagaaggtcctcgagtgtgaacctttcacgatcttcaacaaagaaaacaagctcagaatctccttcctttagcttcacctcgtgaacttcatgagttgtagcctttgttattggagacaaacgacgatggtctttaactacctctctctctgcacttaattttcctgacttctttacaataaagtaaatggttgacaaaagcaatccagcacccaaaagtatcacccccaaggtttctggccgtggattcttgccattattaggtgtgctgtcgcttaaaggacctggcgttgcttgctgtattgtgtttgtgtcactttcctttagccactctttggtactattgctttccaacttgttacttggagtcacataataactaaggaggtgaatataatgttgtttactagggatcgtaccagaaaagttgttattggaaatgtctaagttcctaagatgtttcaattttgttaaggcatttggcaacctcccactcaattggttgccggttacatttaaatgtgtcaaccttgtacaacgcaaaattgagtgtggtatggttcctctaatgttgttgttagccaagcttaccactcttaacttttggagcctgcatagggaatctgcatcgattgtgccactaaggttcaagttctcaagccttatatgtacaatattggtagcatttaagttgcatcttacaccattcaacttgaccaagcatggatgggatggtgactcaatccaggtaatgttaagcacgtttttgggatcaagggcccttatgaaattgaagaaagactcagattctgatgaatcacctcttgtacattctactataaagaaaataaggatagcaaaggaaactagcctccttagaaacacagcaaaatctcttgtgttctgcatttttttttgtggtcaccccctccaattggctttctcctctgtagctaagggtttcgcgagagaatcatgttagtcctgcaatcttctttatttgtgcattggataaagacatgtctcttcttagaagttttcgctaggtacgtgtaatacttgtttttagtggtacatcgttaatatctacatgcaatataaaattacacgttgttccaaaattgatgaatggtatgtatatcgggattgacaacataattgcaaggtatcagtataactcttgtcatgaagcatctatcctactataaactaaggaagtgtttgtacaagggatttcaaaattttacagcgtgtgtagataggagttttgatcctctgttctccaactaaaatattcaccttttcttttcagtacctaccccatatatatatataagtataaaaaataaattttaccgttatgttcgaaacgctatttcggttagttttctattttttttttattagcttgaaaaaatatatctctttttttctctaattctggataattattagtattattacttttattaagtattattagaaataaggatatcatgaattttatttattaaaatgagattttttttttgtaagttttttcatgttgggttgaggttgaaaaccttatttaaccttgttagtagtatattgtaatgtttttttgagatactacttctagtaatcatttgtgaaactttagctttttatttcctatattttactcatcttatgttttttaagtatttattaaatttcccttttattctttttaatgtaaggtaagatttcatttttttcttcttctttcacctgtaatgtatggttatttttttcttacagctttcaggttattgtgagcgagcagaaattgcacgatagtggttagagagaagggatctcacgagaatttgggaaagttgataaaataaaataaaaagataaagctagtaaaatcacagccttttatttaaaatataataaatccaatggtgataaaaaggtttgtcacacgtcatcgtctaggatcataattgactaattgtgcaatttaagtttcttaaattttaattgaattttctaacattgtaattgtacaattttagtttttttttaatagaacaacatcattcttattaatatatatacacacacgcttgggggtaaagaaaaaataaatatactttgaggattaaaatcaaatatttgcaatacatgaggaattcgatattaattgacacatttaaaatctgaaaaattaaaattgatattgtacaattatgatacttgagggatcaaaagtccaactaatccttaatactaaaaaatgcacaaattgatataaatgttacaaggccaatttttatttgcctatctattcaaatcatcattattgttttctgacaaataatatcgtaactagattagagtttattatcaagatactgacaatgtaaaatattattcaatcacaaattataattagatacctataataaaacttttatactattaatatataacacttttttcattagtttaacacttttcgttacaatttgtactgaggtttctttggtaacaaaaatagcaatgctcttatatatatatatatatatatatatatatatatatatatatatatatataagagttaataaaaatggatctggagaacatgattctaaaccaaacatattaaaaacattaaccgtgctgaaagctgttatagatgtgatgtgagcaccaaaacgttaatatattatttttttattttgacaatatatatatatatatatatatatatatatattcatttaacacataagaatgaataattttaattaatttatttgagtaataatatgggtgaatgttggacgacatcgattataggtgtgccggctaggatttgtaaagaaaagaaaaaaagaaaattgagagtgtttatagacattatgagtgccttgatacataggtgattttcactctattattttttgttttcccttttttatcttaacccttatcaattatcatcatatcctgcatgtcttataggtaaacgcaataaatgacgcagaaaggggggaaaacagaactcttgtttgggagaaaagagactagacacagtaaataaaggaaaggaaaataatagaagacagagtacattaaaccacttttttttaactcttatatttgttgtgggggactgtggtcatgagtatgcggctgagtcattgcataagaaagaattagtgagtagcccgttaaattgcataactagagattatggaagtgagtattatttgtcataagccaagtgaaatatatatcttatctcatgtgtacacttccctggaactctgcttgcataccaaaaagttcagtaccttctacttctaacaattggttaatataaaattcgttaatttttcggaagatttaacttagtcgattgaatatagtgtatgagttattataaatcttctgatattatctttgattgaggatgagtcctgacataacggtaaagttatatcttactgatttattgatcatatgttcaaatccggaaacatatcccttcctcttaactgcgcataatgataaacctccgtacaatggagaaaagagaccagactaatcagaattcagccaaatttaagtaaaattcaacacattaaacaagttatttattttctaaatataaataattttgctacatatatcatcgaatggaaagtacaatttggttactaatctattaatttaaacatgttatgattatctattgtaagtacgatataatataaagttgttaaaataataattttatccatttttaaggtgatccaaatatgattaaaaaaaaggtgatccaaatattaaggttaatttacaaatcaattcaaatcttatcttctttataagttttcattatggatatttctaaatcaaatcaatataagtgaaagtaattaaattaattccaaatttaaatttaatactctgatcgcacttttaaatttaatataatttttgcaagaaaatcattcacaataaattagttcttaaaagcaactatttttttatcattaatgtcataaaatttaattaatgaactacataatgcaatctgttttgaaatagtgtattttttttttatatatttgtattgcctaaattggtttacattaaaacaaaaaaaaaaaaatcttattttttggcaaatagctgtcatggacctggttatatagataggagactaattgtagcattagcatgtgccgtgccttgaatatgttagattatacatgaacaactaattaataattgaaaataaacattcattgactttccacctctgcaaaaaatatttcctctatctaccttgacctgcatgatatgaagtactaatatatgagcgatattaccgcaatcgctgttataacatcaaacgtaacgaaattaaaatggaatatattcccctgccataattccattggcaaacttccattgaaattgcccctaaggttgtttaaccaccttgtacttgtctttatctccaatttgctcttgcagaagatgaatctgataagtgttattttcttttggcaatgatattattttattgttgttgaattatgtagtagttctttggcattcgtgaggaatttgcaaagtacaatgcttggattcgtaccctgcaaataaaagaatattgaaaacaataagaaaagtcaatgtcaaaattccttattggtttaaggagaaaaaagatgtggtacacccaacgggtcactacaataatttgattaatttcacaacaaaaatgagtggggttgcacgatacaagtctaagtaccctttagttcacacctacttctcttcatcattaagcttagccgttggaccaatttttaaaacatgaacaactcattttgcttgttgtgattattatatgtaagctggcctccaacatatatcaggctgcttaaactgcgttcaaacccttgacttcacttttctttgccctcaaatcaaacgataaaacccttttcattctgacattgtttttgattgcttccaatatctcatttccattattgaaggtggcaataaaaggaagcattcaaatattgaaataccatttttgatattcaaacattcttaaggatggtaaatttagggtttatttaaataaacttgtataaaaagattaataaatcttgtacactacaaaatgataaaataaaaagtacataaaggatttgattttcaaggatgaagagaatagtttttaaaatgtaattttatatttggatgaaatcgttaatacatatcctttagtttactagaatcacgtccttctaaaatgggacagttatatttttttatacaatttcctttctaagattacatctttagtactatttttatttttcaagatatagtatttattccatcacacatcccttgactgctgataacatctaatatactattttaacatatattgtcaaatcaaatcatcattcaatgtatgccgcacaactcatctgtaaaatttcctatgtacaaaaacaaaaggacaccaaccccaatcaagccctcccctggtaacccccatattcaaccaaaccttatccaatttcacaactagccaaatggaaaaaatatataaacaatttatgttcacagttctaggctgcccaaattgacattgcatactgaaaaggtaggtgaatcaaatttaaaaaaaaaaacacacacacacatatcaaatcaacactgtaagaaatattctattggtatgaacaagaacagtcatcattttcttcatcatcaacaatctcatcaaagaaaggatctctgagaagctcagctgcagaaggcctagcccttggccgagcaaggcacttctcaataaaggccttaacctcaggatctttgaccttgttcaaggcagcaggtctaactccagaagacaccttcttgtatattttagcaacattgtcacattcactataaggaatctccactgtcaccatctctaacacacacatcccaaatgagtatatgtccaccaattctgtgtagtcttcatcgtataactctggagccataaattctggtgtgccaagaatcgtgtgtgcacaatggttcttgcccacaattgctgccaaccccaagtcaccaatcttaacctgatatccatgaaaaaagatacaatcactaacaaaacctttatgttaattacatatataacaacagcataactaagattaaccttggttgtaatagtggctaaaggcaaacaagtttgaagtttctaaaccaaaaaaatgtttgataagaatagtttccaaaaatagtttaaaatcaaaatatcttagactattatggttttttactttcaattttccattattcgtgttgtttcttatgctatcccatcttcttgccctattatagttttaatgcatcacttatttcacctctcatattttttcatagtagaaatttataggcaaaaacagagcaaggaaaaaagtaagcaccaaattagtattctaaaaacaatgtaattgatcgtttttgtcaagcaaacaggagacatcatccatgacttgctcaagttaattacttagatctcacacagaaggcatcgagtcaaaggaaagttaagaaaaagaagaaaaaaaatccaactttttcttgcatttttggtagtttactttcaccttgataatcaatcaaacatatatgatatataactggacggaaaataagatttgaataaaatggttcacctggccagtattcccattgacaaacacattgctgcaattgagatctctgtggatgatgcagggatcatgcaagtgcaaataattcaaccctttcaaaatctgcttagaccacttctttagtgcctttatcgaaacatgcctatgcttcttcctgtactccctcaaattcccactggtgcaaacctcagtgatgaaattcaaagtgtttcgctgctcatccctccacacattgtaaagtgcaatgatgttcttgttggacaagcctctgagcaacctcacttcagagtaaagcctatccaacatggcaggatcatcacagaagttcctcagcttcacctggttccatgccacctctattccttcttcctgatcaaatgcacgatacactttcttcacagcaccacatccaagcaactcactgtatctaccatagcgaccagttggatcggtctcaacaaatggctcggaatctttgtcagggttaacactcggcatctatcacatgtaagaccaatcagatactcggcaaaatctaatcatatcaaatcaaattcagcatgccactaaattttgtggaagaaaaaggaaacaaacaacaacaataacaaaacaaccccattgaagtcttcagatgaaaattatcaaagaaaaatcaatcaaaaaataattttctgcaaccaagtctagccattaattcattgatttttattatatcacgttttcatgtcggtcaatcttctcttaccatgtgaacaagtttttcaattcactaaaaagagataataaaattcgattatgtgtgatatgaatattggctgaacttataaacatgtagtaatttcaaaccatacaataatttctcaccagatatttatataagtaaaacagaaaaacacacccagaatacttcaaatctggtgggctatgtgagttgtttaggagaagaatggtaaatgaatgaatataatgcatgaaagaataaggataagattgataaccatgaagagaaccgattgcttgacccccaagggagagaaaacaacacaattctgcagctttcggcagaaaagagaagctgactacgctccaacctcaaatcagacacagaaaatgaggagagaggtcagagacgtgtaaatgtgactatttataattataataaagatgcagtgttgaggagtaattaatgcaaactataaagtattgacggttttctttgatcattattttatcttttttcgaattcaactttttctatatcttttaaaattgtatagtaacaaatataaaaataatttgatattatcatctgaacaaaactcaccattcagttagttgatttttttaaaattattttaaaaattatatcaaccacaaaaaaaaaataacttgattcttttaaattgagattacgtattcaattcaaattttgtaaataaaaagaagtttgagtaggatttttttgaaatgagtttattttactcagcttgaattacttaaaatttaatatgacttttaaaaataaaagattagggagaaaaattaataaaaaaacaaattaattgattgtcttgtttaaccacactcatcagtgtcatgccatgactcattggagatgtatatgccattggattgagattctctcattttagtgaaattttccgacattgtgtctatatctctgctatgggtaaattccaataaatgaaagagaatttttttcctatgtcattataataacgtctagagaacaatttttgaattttctataatatctttgtattattctttctatttattaaacataaaaaaaagtattttaagatatcgaatatatttacttttatttgatactttctgtatcaaaaaatgtaaatgaagatttgttaataatattaaagccgaagtgccgaactaaggaaacgggtttgcaatttgcatcgtgttttttgggtgttgaggaaagtcaaataaaccgttgttttgtgggtcaacgcgtaaggctttgacggcagcgcgtgcggggcaaacaatgatggatgagcgtgttgaggtgcttctaatagctttccaggtaatggggaagaggttaccttccaagaaaagaaaactttagaaagaaataacaaaatcaggttgtggcttcagaatcacattctcttgctgttgacaggaatccaagtaaagagaactggagggaaaaagagttaacaattaaagtcagatatactatgtgcatgaaaaaagaaagaaaactgagagataaaagtgattatattatttgatatttaaacaatgtaagtagaaagaaaatatctatcaataagatataatagagttagtagataatttgattctttaaacatgttcatagagattgattctcaaatggtgcatatgaaaaaaaaaacatatcgggagagataaaattggatttttatgtttcgatgattagtctcatgattagtctcatgactttcgattataggaatatcttgtttgaggagaaaaaaaaagttaatcttattattagaacaaaacttgtgtttttaagaaaactttttctactataatgtttttaaaggatttttttaactttttttattaatttatcatttttatctttattttaaattaaattttaatatttttataaaattatcaatatataaaataacgtgtatgttagactatgtttaataaaatcagttgaaagtttatgagttataagttataaactgaaaagttgaaaattatttaaaaacttataagctaattaaaagtatttaataaaattaactgataaattgacttataaatatcaaatgatgtaaaaggatgtatttaatattttgaactttattacaaaaaatggtacaattaaattttaatttgtttttgaaaaagtaaaagtaaattaaaaaaactttattattattgattattatattgcttaaaacattttttaacatataaacaataatattaataacattattttaaaactgaagataaaaaaatattttttctttaagtagcatttcagttagtttttaattttttttactaattaaaaaatttatttctcggtaaataagttttttttagtagtttgactaaaaaaaatttcaaaatttaaggtttgactaagcatataaaaagtaatagtttgaagttaacaatagttcgtcaatgccacttgccctttcttccattttattacagtaaaatattattataaaagaatgaatcgcatttgatatagtaattgtatgatatagtttgaaaacaaataattcttataaataaagcaaataatgctttatatcagtcaaaccatatattattttgaagattttttctttaaatttttattcgtttggattattgcttccctaataatcttattaactctttttattattgaatgaaatcttatgtggctcaaataacaaagactaaacacaagtaatattatttcaaatatttataccaataagatattaaaattattggaaaacattgtacttcgactttatccatcccgtgcatggtgggattgtccaagatcatgtaaaatcattgcgggttctatgcatcttaattaccctgattaatgatttctactcctcaatttgatgaaatattttgaaaaggaattaaaataattaattggttgctggctttacaacaccattgaaaagaaattaaaaagattttaccaaactttgttgctgtgatttatgggagaagatatcttaaccaaaatattgtgatgtgcttcgcgtgaagatgactttaatttatttccaaaatatgtgaataactttcatttccaaaatcttccgtatggtttctcaacgtaagaataatgtgattcttttcattggaaattgtcctattttatggggaaatgctatttttagttagagttattaagtccgtgtagccctttcattcatccatgagttaattacttgtatcatatgaccatccctttcaacatgcatgaaaggccttgaatcaccaaaggtgccatttgccaacgaacgaaaagaaaagtggatcatcactttaagctcaatatttgatttccaataatgattacggtaaattggtaattgtatatttgtttcagtttattttaggggaacttttccccattaacttgttgagaacgttttcaaaaaatcggcaattatttcttaaaatttatactacaataattatatattaaccaaataatatacaattaatatccgtactggatcagggcatagcagcccaagcattatggcccaattcatatccgtactgttgttgtgacactagtgtttaggattgttggtgtttttagtccttgaaaaataggcatctttgagtgtctgattggataaatcataaacatttattggagaaaaaaaattaaaaaaaaaatgaaatgagacagagtttcaggttgaagtcccttaattttttgttatatttgaacagttaggagatgatattatggtgtaactgtgtgtttttgttttgttggtgtagcttgttaactgttgttgtaagctatgacactagtgtttagggttaatggtgtgtgaggatcatctttggttttagttccaggttgcaatcccttaattgaatttgattttttgctttatttgagctggtaggagatggatggtattgtgcatctgattattgtctacgatacttaatttgtgagtaaatttagagatctcacttttcttcttatttggagtcttgttaaactcaatttaatctagttttataaagttttaactttttagttggttgtcttattttgtagttatctttgtatttctaattcctttttgtagaaatagaggttgaagttggaaagaaaattaggagcaaaagcttgaaaaaatgtaaggaaatgcgttacagttactaagccataattttaggctaagctaaaattcagatagagaacaaaaggttcaagcctgactaagcaagaatcgatggctgagcaagagttttgttgtgttcatttgagatctatgtattctaactaaaccaaattttatgcctaagcgaaaattgttgccaaaaatgaaaagttttcttatgtatttaaagtggatgtttgtctaataaaggatggttcttcattttttttttcttttgtctagagacacgaagttcccactattcgtttggagataaatttttcccttggtccttttctccatttctcttccatctttcatgtattttggagctactcattgctataagtagctaagtttctccattgttaaaagtaggtaaaacattactcaaactctcttgtacatcttgataaatatatatatatataaaaagagatcaaattatatatgtgtaactttgacaatttttacatcatttttataatttgatatagaatgtgactttttttattcaatcgttaaattatatctacatattattaagattgtatatgtcaaaattaaacaacacaaaggggataatcaaattattcatattttagtatatttgaaatgtttatattaagtcaattttagtatatatgaatgaaataacaaatgattttgaattaatatgaaattttgcatatgtgatataagtgggaaaaaatttcaatcaaacaatgagttttaagaaaacattattcagttataagttatagaatgatgtaatagttatcaaagttacacttgtgtaatttttctctctctctctttcaatatatatatatatatatatatatatgtgtgtgtgtgtgtgtgtgtgtttgtgttcaatgttaatattttgtttctttgtttaatgcttgttgtggaatggtcaaccatgacataattttaggacatgattgttgttgaaaatgtcttcattctatagagctgaaacaaaatacccaatgaacttggtgtttaggaatgaagcttattcattattatcttgtgtcatttttcttaagttgttgagggatcaagacttaataaagaaattaagacttttttcatctaagggatcagagctacaaagatatttattgattgattttaacattgaaatacaaatggaatatgtattgtgcattaaagtgaaaagaaagtagagtttggtgaagtctaatcccgtcaatacctttgttaattgttaaatcttttattttcagttttgtttttattataaaaccacaaaaagatcattttaatcttatttatgcacttattttgttttaatctttataaaattaactaaagttagtgtttttactgttttttgtgatatttgtgatcttatgttgatatttacatgaaaattactaatattatacaaatatttagagaaacgatatttatgtttttgttttttgttgtacttatagtttcttaactgttgttgttgctacaatagtgtttaaggttaatggcgtttttatttcctaaaacaatggatctttggttttaggcccagacttttaagatcttcgtgcctatgtttagccaatatccaaactttatcccctaataccataatttaactttcttttgtctctcacaaggtccattgcaattttagctttaggggactaaaacacatggacggaaactaatgatattgaaagtcacggacaaaaactaaagattacccattttcagggtgttaaaacatcattaaccccctagtgtttatgttacgtgatcttgaagttggaattttttttataaaaaaaaatggtgcaaggttatattgaaatggtgatgctgctattatttgatttctagcgttacaatttttggtggtttaacttgtgagggaaattttgttttgggtgttttgcagatcttgtgcagaaacttattgacaggagcaaacatattctagctgttaagtttgtttttaagttcaatcttgctcataagattccaccgattcccattttgaaagctcatgtgaatgagtctcagaaacttgttaaaagactttccgaagaaggtaagtcacttgtaagtatcctccccgtgattggtttatacctgatgtatggtatcactgcctgtatttatttgggtgtttttgcagaatgagatcatggcaagagaaatccatgcattgaaatcggcgattaaggttattgagagtcataatcttcaataaagttgttgaaagcctccctctcacttctactataatctcccactcccactcctctttcctccattcttcttacacaattgaaatcactcaagatacaccaacacttgatattgctagtggcccttttttttgtagaagttcctcccataatttaactttcttttgtctctcacaaggtacatatacattaacaatagtaactaaagaatgtgtgtctctccaaatcccctccaagccaatataaccctcaccacaaaaacaacttactacctccaagctttccgagtttcacaaagtaatcccccgactgatccaattgctggacttgttacactttttgcctcattttccccccagagagcattgcatagagtatcaccatttgccagcatcttggtttcttgaatgcacaacacttgaatgttctcctttgccaccacattcctaataaactttcacttaatccttcccccaacccctgctcattgtatatcattagtctcatatggacccttgctgcatccctcctcataacatatctttatcttttcacttcctactatttgatctctattcttcatctccaccattttctgtttcataacagtttcatcccgctcataagatacgcccctcttcagcccattttctgttgcatatactgattccactatcagaaacattattactaagatcatgttgcatatccaactgtttcttcccttcttattcttcttttcttttcttcttcctcttgctacattgtcccccttgagattgtattattgaacattaccatatggtaactttgggtttgtatagaaaaagatttctatacaaatttataggaaaagacaataagaaagaaaaattaaataaacttttttccaaactaatttgcaaatgttctcatattagtttcttaaaaaaaagtttaacttctttccaaaaaaggataatttttaacttatgcatgaattaattttattttattggagataccgtgacagggaatatggtttgcaggacaacgagccccagcgtaaaatcaattatcaagaaaattttccagtttattctgtttcttccttttcacctagctagtggaaggctttttgaagttgttattctgtttcctcctttgtcttattttcttgcaagaatcaccaatgttccagtttaacaatgatttaaaataactacctatctttcatgccttgtaccaatagcttcatcattcctcccttttctggccatatatgttctattgagaaattagtcatcaattcttaaccccaccatctagatcactattgttcgtattcaaagtattgaataaatgtttcaacatatatagcaaagcttcttatgacaaattaaatgaaattaaatttgagggctgctataaaagagagcatgggacaacctacatgtggttgcttgctgaatgtgatcagtctctctacaaaaaatgtttgagaaaattatatctattgtctcattggtttccaacatgaagttcttgcagctgcagtacctagatgctacagcaagtctatctccaaagcaaaaatgaatggaaagacagctctagtttgttcatttctcccattattgtaattcaacttatttgctatatggagcatatgctatctttgttaatatatatggctaagaactttaaagcggaaaatgcggatcagagtgttaacagttatttattgatgaaattggatgaaaatatggccatttcacttgagagagaattatgaagatacaatttttatgaacttaactgatgggcagatctaatatgctatgattttgtattaaaaaaatttgtgatagagaaacaacgcagaaaatcatcataacatatctctagacttatgtaagttaacttcacatgtgttattgaagtttaaatttaattgtgcggcatgtttttatttatacaattttcgttcatttgccattatacttcctgaaataagttcagtttagaagataactcacaaattgtgacgataggagcatattcaattatttactatctcttgattttatattaatatcttgcagcacaaatttgcataaaatttaacgattatacataacgtgtgtactttatgccgatcatgtcagcgtttatatcatatcaaatttatacaaaatgtacttcatacatttttattttttttgcctattttgctaatgtgccttaaacattatccttgacaaatttaagcacgtgggttgatgaactaacaaacaaactctaaaccaagaccaactcattctctgaaggactcaactacctgtaaggaccattggaccgtctgttcgccacataaccctctaatctggataactacatttcccgacattgccttcatttcaaagttgaatctatctatctataatggcatacataaataaagtcttgtattatatttataaatgggagtgctttttatacataatttttttaaaataaatctgaagcagacttatttcacaccatttattttttccaaccctctttccttttcttattgagccgtcgtcgacacctttataaaacctgtaagtatcttatctgtacagataattgcaattttttgcacctatggaatacatgtaaaccacaagattgacaaaggcgtaggactcagctgtattcaaatgtgaggaaacgatttatttaaatagaaaacttatgtttgatttccacaatatacaaaatttttcttgaaccaacggctgaaaaaattattgcaatttaagagatacataagaaattttacagttaagaatatactttttttacctattgcattccaacttgcaagtgccaactaatgctccagaaaggaagggttagccatgacctgttttttctaaaatatttgatagtactactgtaaccatataaagcgacatactctattttcctttggtacccttagatgtaacattgaaaatggtttttcaaacattttgtcagctgttcatcgatggacctttaaaaatttattataaaataagaaatcaataaatatttgaaactcattctcaactccatacctatcaagtatctaatactctcctttagtcacctcagttgattaagttgcgggacatgaaattgtgtgtaagtttgatcttttacagtgtgtttcaatctttttttattctctttacttgtgaggctttctatgaatttttcccttcgggaaaaaaagaacaaaacagcattcaaagttctttatattaagtgatcttctggagtttctttagaatatttttttaaaaaaaaataggaagaatacaagtcagctcatattttgtaagtttacttctagttttttccttaaactcccaacaggaaagaagccatcatgttttaattatttgtgttctggttggggggcggggagaacaggttattactggacccaaaaaaggctgacctctctttgtatttaagggggagaaattgaaagagacaaatgtgttaaaactcctcttaaaaaaaaaaaccgtcaagaacataaagaggaaaaaaaaatctcaaacgaagaatattatgccgagaaaaacagatctcagtgtggcctgaggggggaaaaccgtgaggatacagatcttagaagctcaatataatcaaactaaataagaacacgatttatatttgaagaatttgaatccattaacccacaaggaatcaagtatttaaataagaaagaataggcaataaacacacacacaagaaattcccttgaaaaaactactagtaatggataagcattgatcaaatggcataacaattttatataaaaaaagaattgtgctgcttaatcaatgacaactactttggggtccacttgctagagaaaatacatccatccgtagagaaatgggggttataaatttatattatacaatataaaaattcagcatccttcgttcaatgtttctccaagtcttccctgatcttctagaagttggaactcccgttcaaatctctggattaacctgaactttgtttttgcaacatatctcatcctatccctaactatattttgtaatattggatagtagaagcatttcaaatgaataaaataattaaataaataaataaactttgtcagaataaccaagaagcattgccatggcagcccttgctcatgctaccatctgctcctgctctatatacagctgctccacccatggtgaaagcatctctttactgagatcatattgttggttctcagcaccaaatatctcagacctctcggagggaacatctttaaccaatgaatgaacccatgagacatccggctcagcaccaaattctggctgtgctatgggggatgcagttaccccactgtttctgaacccaaaggaagtagatttcctcagcttgttcagcttgtctccgtttacaccccaatccagtttcccagtaggggaactccaatctgaaagggtagaggagaccctgcaagaagggttggaagctgaagacagcccaagatggtgggttgcagctccacggtcaatgaaactttggcttcgttttgcgaaggcagcggacctggaattcatcattgcagttgccacagcagctgatgagtcaaacccaaaagctgagggcttcctcagaggagaggaagggatgttggatggataactcgcacggaggtggttcatgttttggcgcatctgaagcccactttgtgtgggtgttgaaggttgcacagaaagtccatgtaattgagataatacagaagggtcagcagatgctaacaggtcatcaaggttagtaggattcaaatcaacaatcctgttgaattcctggctccgaaaagatggggaagagatcctggcaatttcttcgatcaattgttgttgctgctgctgttgttggcgagcagggctttctagaccgagcagttccatctccatctccagatccctggcactcaaagcggccttcagtcggctaccagggagctgcaacgatggtggagtaaggtttattttgttctgccacaagcttccactcttgggagatgaagctactgccaagggagacatgggtggggttgaaacacttggcatcggcaaagatgtggaactaagagccaatggactcatcgctgtcatgtcaagtccactagctgaataggattttggtgatggcatagccgacccagtggaagcatacacagggcgtagttcttcaggtttatgagcaaagaagcagacttttctagcacagcccgtctcatccttgcaaagccttgtccggtattgggcgggatgtagccaggactcaaaaacaccatgagcatactcgcaggaatcacccttctggcaggtccctttgcggaactctgggcaaggaacacagctgtaagggtatttccgtgggtctctcctcctcgcgttctccccgggatgaacgaatggacactcggtccagtcatgggagtaagcccttgagcaaggcttcaccttgaagttgtacatcctaaactcatctgttccatatacaccgttgttgatgtcaggcagtgatatatcaacagggtattctttcttattatcacttccttcttttttctctggaacagaaaacatctgtaactccatctcctggctcatgagttcatctctttccccaccacccctgaggaacatctccatagccttccttcgcgatttggacaaagaatcaaaggcaggagcaatcagattaaccggcttgttgccactcgcatcaaggcactcagcatcagccccagcatcaagcaagagcttgacaatctcaagtgaggattcggagccaccagcaacagcacaatggagagcagtggccctatcagaaccacagaccctgttcacatcaacacctcctcctttctcaagaagaatataattgagcaccttagcgcttccaaacaaagaagcaatcatcagaggggtcctcgtttcagatcccatcttctttgatccaattcttctaccataccataagcctgcctcgttcacatctaagcccttttcatccacctctcttttgaaagcctcataatcatcagatgcagacaattcaagcaaaaccgagttgtagagaccatccagattctgcttctgaatgttactactctccatgacgactagggttggggaagaaagtttacttttagaatcactgcacatgatgtcccaaaacctgcagaataagacaacgtaatctcaataagcctttcaatttataatttattattcacacagaataaagaaaaacgataaaacctcaaatttagaaacagagtttccaaaccctagttcaaatccctacagatacaaagctaagcaacgtccccataaaacgtgttaataccaattttaccaacaaaggttagatccataactaatcctatccaagacaacaacaacttggtattccaataaacttaataaggaactaaaaggaagaaaggtgggtcggggcgaaaacatgcaactgccaaaatctgaaaccaaagtttgaaactttaatctacccagaagcagacccacgaagcatattcctcagacccacccaaaacaaccaaagatctaaacaagaacacccaacaaaaaaaaaaacaaaaaaatgtatgagccagtaaaagcacggaaagaaagacatacctttttgagtagagtagacactggaacaagtattttggttgcaagagaatagagcgttgtgttgtagaaaaggaaatcgagaagacctcgattgagcgaagaatgaagaagagggagaaaggggtggccctttttattgtcagcacagcacagcagcaacgggaaagccaaaggaagaagggaggaaagtgtgacttttcttctcattcttctctttggtcaaagtcggcggcttcttccaatgtgagtggtaaaaaattgaatggctgaggtctttttattttttattttttatttttaaaatattttattttggttatgagacataataaattaggcattaaaaaagtaaatttaaatttagttttaaaataaaatgtttgaaagattaattacgtgaataatttaataataaattgattctttaattttgtaatataatattaaagtgaacttaataataaaatttattattaaattaatctttgttatcatttaataataaaatattttcacaaatttaatgataacacccatctatttgttatttttttcacattatggtcgagagctcagagaaaggcaacttcattaacgggtaaacttttaattgtttttggttaaaaatattttgttttataagtaattagttttgcctatcaaaatgtgaaagaatgacaaattaatcttaaaagaaaaaaaaattaaattaactcctaaatgtataaaaatgtgagaaactaattctttagataatttaataataaattaatatctaaattttataacttagtatcaaattaatttttaaaaatataatttattatcaaataaatacttaaatgatataattaagtataaaataattttatgaatttaaaaatttatcgcatttacggaaactaaatttggaatgaattgcatattgtgagtgccggaaggaggtggtccaattggttcatggaaaggagtgacgaaataaagaaaactaaagtaattgttataaaacattcaaatgtaattagaaaataaccgattaagtgagttccctttcttgaatctcagcccaatattttagttatatatctaatgataaaaattaatgccacttcaccctagaactagaatagtagaatccatcttcaaatgcagctagctcaaaatctttgcatacaacgaacttcattttagtaatcatggatatgaatatgcagagttataatgggcgataaagcctataaggtttgaagaagatgcaaagagtgtgagttttaggcgcgaacacaatcatttttaaagtgaccattttcatagaagatcattgcacctcacatttatctcatacagtctttttaatatttgcacatgcagaatctttaaaatctgtttaaaaaacaaaaagaatctttaaaatctaaacacgtaaggtatatatacataccacacaattatattattgcaagaaagttaatgaattaaagagtatgttcatgaattgtgttgtccatgtcatgactattcacttatcattgattttttttttatcagccattcaatattgatatgaattacaggatcttgtacaatataatggctgtatttgataataaaattatctgacatcaaataatatatttatataatcttttatttagtagacaaaatatatttttagataattataattttgttttttaattaatttaaagcatttactttttgtttgaaagtcaaatactgttataataaaaataaataatgtggtattaaaaactattttttgttaaaataaataatataacattaaaagaagtgataaatgaaaatgtttcttaaaatattgaaggtaaaaaaactgagttcaaacgcaaattcaaaaaacatttaaaaaatattataagttagtaaaataatatttaccaaacataagtaatttaattaaataaagtatagtctagttaaaataattttaattaaataaattaaaaggtagttaaattttgttaaaacaagacacttgacttccttctttgcaagtaactgctattaattgtatttcattctatgaaagctttactagttagttcaattcctttttattgggaactatttaagggaaagaaaagttatagttaatattgtaaaattgaaagtggaaaatcaatgatgattaaaaatggttattacccgttaaacttgttccactctaagagctatgtaatttaaataataggcagtggagtaaggaaaagtatggagggagcagaaatagaatagaatgggtattgaacgcgtcttcgttgtaccctccctttaataatattaattttaaaataaaactttgaagtgaacgcgttttcgttgttgtttggctgattctgttatataatgcttctgaagtgagtaacgttgacagagagcactagtaggataagttccttcctgattcagccttccactatagactatagactatagcttcaaattcaaaaccaattcctctctctcacttacgctttcataagtccatgcattttttgccctttgttctttatttaaaaacccaacaaagtatctaatcttattttattgttcgatagggtgtttacggataggatttaatctgattagattaaattcattatttaatctgatgaaaactttgcaagttaaattgagttttaacaatttttttttataaattcgattcaaatcaatctaaatagattaatctagtctaaatatttgaatatatatatatatattttttgtaaaaaatatttttttttagaataataatttattcttacctaaaattttataaatatataactactaaatatatgttaatatgatatttttattttagatataaataaaattttatattagcataaaaaaatcatgatagagataaaaataataacttaaaaaaatatggattgtttaatttaataatttaataaattatatgagttaaaaattaatgtattttatatttaataattaatttatgatatgaattggattggattggattggatcggataaaaaataaaactcacaatccaatctatttataatcaaatcttaattggattgaattagatttgatacaaaccatttttaagttaatccaataacacccctaagctggaacacatatttaattcagatactactactattgtttttgcaggtcattgcctaattgtgcttggttaaagtaggagttgtgagtttggtactatgattaaaaaaagtaagttttgaattagaggaaaaaaaacattatcttcttagattttgtccaaaggtttgaatattttttttatcttgtaattatatcaactttcgtttttaatttttataatttttttatgattttttacggtgttcaattcaaatgttcttattttttattttatcccctccgattctttttgtctcgtattctaatagacgtatgtaagtatgtttgtaaggactccatttgatcatcaattcaaagactattttacttaaagattttcattaacacccttcactaaaaaaatagctcaaggacccgtctattccgatcagagtgataagggcttgttagaattcatgggtggggagaaaagagagaaaagtatattttactcaaataagaaaaattattacatgagtacaaatgtagattatatagtcaatcctagtaatactaatatcctatatctgtaataagatttgtttacttggaatgaaacaagttcaataagtctaatttttcatgagacataccaataggattttgagacttactataatcaacatcaaatgacattaccttgaagaaattattaatttatcgtaatttttatatattcatgaattaaatttaaaattttcattttttaggtattaatttgtcatcgcatcacatcttcaggatgaatttgactatttacccgaaaataaatcaagacagagttccgggttaaaactgttaggagatggtattatggcgtgactttgtttttgttttgttgttgtagcttgttaactgttaggagatggtatgtatgctttggtctatagtagttgaagtctctttttatgaagcagcccaaaacaatatgtttgggttcccatcaccttgggctaatccaaggtatgtgacactcattgtaggaaaataaacttttgggctgtctgagattttttagtctatagaaaactaagaaatctgcctacgggactaagtccatgacaaacacgtggcttaagtttgaatcccaggtcttcttaatccttatggcgggttatttgtgagtgccctgcgtgggcctaccctgaatctggatttcagcaaccattttcccgctctattttttttttccaaaaaaaaaaaatataaagaaataatcacattgaagctggtgagattaagattagctaatgataaaaaaacaatattaagattaacatttttttatttactatgttgtaagtgcaaagtatctatcaactttgttgataattaatttctgtaaaaaaattggtgaccatctttaatgaaagatattattttccaattatgttcatttttattctcaagttcaaaattcaagattttacttaaagaaactcaattacattcgaaccaacgtaatgtgggtggaataagattagcttgagaaaatgagttttgacacttcgattatacacacactagggaggttctgttaacaattttagcaccagctgattttgtgatacatgtttctgtacgtacagtattttgatctttacgtttcctggacgtcattagctctgtcaatgtgcattagcttgagttttaccgtagaatagttaacactaaagaagggtaagtgcatgagaggatttttacactgttctacctatgaagtgatctattacctaagaaaagatgtgtctgtattattatttggtgttgtatagattgttcctctcaccttttgagatcattgctaattggtaatgtaacatgtaagagacctcgttttctatatgtttggaaatgtttactacactgatggttgagacgtattctcagtgtgttccatgaaaatgggccgtagatgactggccagctttcttcttttttggttagtgaatagttagaatttcattcagaagaaatggactttgcatccctaacaaaccctggacgactagctttaagcatagaagttggaatttggcaaagaatattagtgaatatattattgaagtctgtattatggtttttatcaacgggacatgagtacttttacaagatttaacattagtgggaaatacactatgcggagtcaagattttaatattagtgagcacagattgaaaagtggaatttgattgatttaaatatttgtcaaagaaaacttaattatagaatatatgcagaaatattaaataaacttaattcattcttatgttttagtaattttttttagacaacatgttttagtaaattggaagcgttgaatactagaaaattataaatacatagttttctgtataagttgttttagctgttcaacgttattatttcatgaaatgaattttctctggatttttaatttaagtaatcctctatttttgtgaggaagtttttcctacctcgttatacacgttcttgtttttattattctcattgccgaaaagataagaaaattcaaaacaaatagaggtaatttatttgtcaatacaagacaaaacaactagaagcaatttatcaatcgtaagatgggtatctattcagtttttggtaatttttaatatatgattcatcaatattttattattcaccttcggttttgaatgatatcaataggaacttttcattcattaaattttaagggaatcaacaataaaatatgcaatttattaaaaataagaaaaaaattaatattattggggtttaataaaattttattcaatgctcctttatatatatattgaccaaaagcagaatcatatcatttcattaacaatgatagacttctttataaaatattaagaatgatggactgaatacagtaagagatactgttattaagagtatttttaactaatagtcgaaaattagtcctttttaaaatatagagataattgaaataggctctatctcatctaataaaaaaaattccgtacacattattaagatccaaactctgtgagcactgagcatacttaagggatcatattaataaaagtattaacaaacaggctttttatgattgagtacctttccttttaaaaaaaagtaagagtttcttctccacattctgaaatttaaaaattagtttgtaatcccattgttaaaaatcttgagaatgagttttctttctcctttaaactattttatccaaaattcacctctaagattttcacatgaaattctgaagatacttaacgaactcttaatgtgataaaatctctctttctatacatcattttttttgcgacagttttcaaatttcattcattaaataaattcgagaaagcaaatgcactcagccatttccaaagtttgtaaagtggcaaaaaattattggatgaatagatggtcggtaagatggtgagaggaatgccaatgaaattaacaactcttaactgtttctactttctacggtataaataagggattcatactttaattttatctgggaaattttgtcagcaaataagaaaaaatgttgagagagatagataaggtaggtgattttatttttggatagcatgctctgatatgcaattgaattgaatgtggcatgctttaacatttaatatagtaaaattcattagggaggaaagatattactcgataaaaaaaattgtaaagaattagaaaaccagtgagacctttgctttaactgcatctcaagccgttaaatgcttagatttgtcgttgttttcctatctcttcacctaattataggctaagtacacccttccttttcttatctgtctccacacaggtaaaaagtaaaaacacacaccgaatggataaaagaaaacaaactataatgaaatgtttctatctcttgtgcttttctagaccatatttcattaataatactctatacattatagtagtaaaccaaaaattgagcctcaacttctttttaaccccttttagtaaaatggtatgagattagtaaagaagatatttaatagtgtgaggccaacatgttaacttattctttcttagatctttacagcatatccatgaaaatttgacaacattctcatttattgttgtgactgaaaaatacccaaatggatttttttttttttttaaatcagcaaacccaaatggaattaattggtcaggtcaacaattgccacatttagatgccctaaaccatgtagtattgtccaaaaacctcaaacacaacatgattctgtgaactagttatggtttaatccagttctcttcgctacatccacttactaatttttttgtgtcacacacatgacataacccccatgggaattgccgacagagcattccttgaattgaatcatgtgatcaaagttcaaataacatagacaaaactacacactgaggtcattgcttgagcctgactctcctattcatgagattaaattatttgaatctaaccctttgctgaaccaattctggtttggctttggctttcaacttgtggaaagggaaccgcagttttgcaccaatcactcatattgattgtgtatggtgaagagtaacatagagttggtacttggcacaccacttttcactttcaactcttacctagccaaaacacacatcaaacacaaaaaataataattcttttaacgaatagtaaataatcattttgttacaaaatctttgtccaatagtgaatcattcattgacaaaatcatccacctatcagctttaaaaagtctaaaagctaaatctacacaaccgattattttctctctccatcgcatccgttcacgccttaatttttttccaaacaaagaataaataatatatactgtattttttttatattatcaacaaattacttacatgtattaatttttataataattattttaagagtttaatttgtatgtaccattaatgtaatttttttttatattatcaattaataagaaattattgttaatatgatttttaagttgattattgtaaaataataactttttacacttacaatattataatcgaatgataatatgattttttttatattattgatgtatatcttatttactcttatattaataataatttttgaataataatgatccatgcatgtgtattaagctacaaacaattcaatatgggtattatgaaatcatcttgacttgaaaaatctaaaaatccaaaccaaactaataaaattggtttgaatttgttgatcaattagttcctttcattttaaatataagcaaaatcaattatgattcgttttgtttccattttttttaatccaaactaatcctacgtcttatcaactttctttttttaacttttgaaactaattgattttagattttagtatttcatttttcttctacttttgtttttctttccttttttatttattttgactttcttattattttatctagtgttactgagggccttataatttgattatgtttattttatgattttttttatcatatttggataaataaattaatgaaatatttaagataataactataagaaactaaatactaaatgaagtaaaaaagaagaaggaatgttacaaatacactctctaattcatttccaattatataatactattatcttatttataaaattttattgaaaatcataatagtaaagttcattaaataaaaaataagactcctataatattatgatttctaataaaattcaactaataacaaagtttgttaaaaaaaaatcttcttgatatttttgataaaaaaaaaactagttattaaaagaaagaaaatttctatcttatattatcatattaatataatattgaaaatttatataatgataaaaaaattgaaaaattatataaaataaacaataaataaaaacaaaaagttaacaatataataattttttttatcatgacatgaatcaaaccaatatactcctataatcttgggaccaatttgtttaaacttattttgttggaatgaatatttattttaataaaataaacaacttttttgtttttttaatgtgtttgtatacactgtttttgtttttaaaaaatatttttttgcttattttaaaaaataaatcttatctacttctttaaagaaacacttatataaaaaaatatttattttaaagttattttttaaaatttaaacaaactcacttttaataggattaattttaggctaaatagtcattttcattcctgaatgtatagagcgctgacaaattcgtccttgaaagatgaaattcaaattttagtccatgaaagtaaaaaaagtacaacaaattcatctatatgttaactttcatttattactgttaatgaaagagcctacgtgatatagatatagatggacataaaatgtcacataaaaagattactaacatgaatgttgaatagtttgaaccaaaatttcagtaaattttcattgaaccaaaatgtcaataatttttcattgaactaatttgtcatatcccaaatttcatttcatttaaaggtaaaatataatttaatattaatttccctccttttttttatcattgcgagaataaacattataataaacacttaaaaaaatagggaagcaaatataagttagaacaaacataataataaatataatattaattaataagtataatttgtctgttgcgatgaaatttttagtgtgacagtaacttagccaaaatattgtaatagtacaaaaaaattgtaatagtgtaccaatcatttcattttggataaggtactggcacattagaaatctccgagtaatatatagatcatgactattaatcaatattatgtttatttttctatttttttaagtgcttattataatgttatgcttgcaacgataaaaatgggagaattgaagattaaattatatttttcttgaataaaacgaaatttgagatctgacaaattagtctaatgaaaacttattaacattttggtgtaatctatttaatagtcatgttaaacaatcatttttgtgacgtttttgttcttaagtgtcatataagttcttttattaacgataataaatagaaattaaccaatcaatatatttatcgcattttttacatttttaaaaactaaaatttgaatttttatttttcgaaaataaatttgtcaaccgagaagtaaaattaactaattacctttatataggaccaaaaatattttcaaaatcagaatgaatccgatccaaccatgaaaactccttaaattcaacatcaattattactatcatgatgactttttttttatggtgtgagtttagttactcagaagtaacaaaaaaaaaaatgttaaaaagggtttaaaatgacagagaagagagagtcacagatgaatgaatgagttgtgtgagaaagagatccctccaacgttgcaagtcaactgagagtcctgctctgctctcccaaacatctctgacacaacacacaccaaaatgcatcattgaaatgacccttttgcccttccttccctccctacttctcctttgactctccgcaacgccaccgcccacaatggacgccgccaccaactccggcgaaccccgctccagttcggtgctccaaaatactggggcatccgaggatccgaatcgaagcgggtcgggtcagaattcgatggcgagatacaagctgttgtcgccggcgaagcttccgatctcgaggtcgccgtgcatcacgattcctccggggctcagtccgacgtcgtttctggaatccccggttcttctttccaacatgaaggtgagtgtgagtgtgctcatttgaaatctttttggtttcggtgaaaaatggaaataaaatggcttgtgttatgagggagaaatttcatttttcaaaggggtttgtgttttctgagaggaaatggattagaagaaggaaaggtaaatgcttgagtgaattcattgggggaatgttgttgtttttgagttcattttggtcaaaggtttttttttgctgttttttatttttacttgacccatgtaaggtaaaggtcacttattgtgagtggcgtatcaaagttttgttcttttcactacgattttcttggggtttctcagctactcaatagggcttatctgggttggtgtcaaatcttttttttttttggtggaataatttgataacttaaaatgacttgatttgaatgctgatgagcaatgagctgaagatgctgttttttgttttgtgaaattcgaaattcttatatgctggtttagtctcgtggcacattgtttctttagagttggctcttcacttgtttgattttgatccttcacttactagttcatttgtgtatgggtccgttaggttctgatgcttttgctcttataggattatgtattggctgctttatgctcaaataaatacggtgttctgtttagtggaatataactttagcttaggatcgctcgacattctccttttatttatttattttagtgtcagtgttgttttttcgcataatgaatcttcttttttgttggtgcttgccctttttgtttgtttttgtttcaacggtgcagcagagtgcaatgaaaagtcttcttcttttcctttactatttatatatgtggaacaaacgaatcaatgcattgcaacgattagtggattgatttaagttatttgtgctgtgagaatagtataaggaatgccagaaagattgtgggtctagattttgtgggacttgtttctagacgttaatcgtctggatggtcctaatttgagtagaattctgtgctacattcatgtgagagtgtcttttctttgttatgattgattgtttatataactaacttttgcatattataatgtacaatgctatctttgtcaaactgactccaaataaacaacatgcaatatcatcagcaggagaaaatggagaactttgcttacgctcagttataatgggttgcttacatcactggctgataaaactgttcaattagttggcttattcataagattatatatatatatatatatatatatactctttttccgctgttattactgatatcataggttgattgattgctgtttgaggccttagggtttgcaggtattcaggaacttgcttgttttggcttcccccctcccccttctttttattgtttttttgagaatttttttttccagtatctttttgtgcatttgaatttataatttttcatttgactcaacaacagttgctcaaagaatattatagtttaaatattatttgtgtccatgcattgcaggtggaggtttcaccaactacagggtccttccgtaagctccaaccaacagtacatggttctatggcttctgcttcctctgctacatttccagtaacctctgcctgcttcaataccaatactgttgatgccagaaaatcaagtttctttgagttcaaaccactgaatagatcgaatatggtaattaaaatcgatgttggcaacactttgattaatattactttcaaatcacatggatgaaggggcttggattttgtttccctttctcccgtgcctttacttggtttaaatctggatactaactaaacaagatggaataattaatcagatttgtcaagattgttgttactcatcactttgtcgcattagacaaaatcaattccgaaagtcatgtttcatttaagtagttttataatttataatcctttaaatagatattttttggggggttaaagtgttaaatggaaacaaattgcattgtcatgtttcatgttctaattaatattgttttgaatattactaattgcctagcacttatccaatgctattcactcgttttaaggttcctgcagacttcaacaaccatgtaagtaaacaatctactcaagtagaaggtccaggaaaaactcaatcatttgcttcctcacccttaattgaaagtgagatagcagttccttctaatgaattaagcctatcatcacctgtacaaaaggttagttctagtgctagtgatcctgttgatgttgatttggatgacattaaccacaaaggcaacacagctactgggcttcaagcatcacatgttgaggttagaggcagtggactttcagttgcagctgagaaaacatctgatgatggatacaattggcgaaaatatgggcaaaagcttgttaaaggaagtgaatttcctcgcagttattacaaatgtacacatcccaactgtgaagtgaaaaaactttttgagcgctctcatgatggtcaaatcacagagatagtttacaagggaacacatgatcatcctaaacctcaaccaagctgccgatactctactggtactgttatgtctattcaaggagagagatctgataaggcttctatggctggccgagatggtaataccagccatctatcttagcttccattttattgcaaacaaaataactggctttcttttcttctcattcttgaattgtagacaaagcatccactatgtatggtcaggtgtctcatgctgctgagcccaacagtacttcagagtcatcacctgtagcaacaaattatgatggtttagagggtgccgggtttgcgtcaaacagaactattgaagaggttgataatgacgatcccttctcaaagcgaaggtatgacaatttggttgaagctctggattttctccagcatgtgtgctcacttgctgctgctgaggttctttttttttttttttttttttgagcagaaaaatggaacttggaaatgttgacatcactcctgtagttaagcctattagggaaccacgggttgttgtacaaactttgagtgaggttgacatattggatgatgggtaccgctggcgtaagtatggccaaaaggttgtgagaggcaatcctaacccaaggtatgtcctcacgttgatgaaactaagaatagaaattaatttataaattccaatttaatgtatgtgctttgtccaatgaacttttttattaatattgtaaaatgtcaagttttttctgttgtacttgctgtctagacaacagttaaagtgaggaatcaacttgatataataatttattgaagcctatatatattcacttatcaaccattttgctttgcaatctgtttcttttattatcatgggttttagtatagtctgaggctttgaggcccctgttgcagctttgtagccaacatggtccataaaaaacagtctgtatcttacattagagtatattcagatatacagacatgaaggatatatatatttacaaaaaatggagggaatttttggtaaacaccaacttttgtgggtttaattaagaaatacaaggagtaacttcatagatttgttttggtaagggatactgagatggacatatgggtgaaggttgatgagaactggtggggatggaggatcttaaaaaggaactagagtgactaaatacctagtaattaagatacaagttggaaattaaaagcatgatttctaaaagtttgcaaagaaacagtggcaaattaaagtggcagtagattattagatataggaaagtattgtggaatagatgttgcttccaaaggaaaggagtgaatattaattttgcaagccaatacgaagttataagaaaacttagggtggggtgaagaggaagggcaagaagatattcaggcatcattgcaatttttatactcagttatgaagatggtaggaaagtaggattgccatcctgctggttttcatgaatgactagtgttagccgatcccaatgttacaactaagcctgcttattgatgtcattttattatgtcattgggcacttgtgaacaattatttataaatagggctatattcacctaggaaatgtatgtactaacgcattctatttcgtggtgacaatcattactgtggatgccataattacagactcaaaaggttacttctcatgattccagttatattagtgtgtcgctacttcaggaaatgcttgaaagcttggaattaaaatcaaatgtgtgcttcgaccttgatgaatgaggcttgtttcatgttaatgatccatgcttatgatactaactcgctgcagtgctaaaatatgctactcaactacatattttttgttaatcttgtatcttactatgcttcttattcaggagctattacaaatgcacaaatgctggttgccctgtcagaaaacatgtggagagggcatctcatgatccaaaagcagtgataaccacatatgagggtaaacacaatcatgatgtaccagctgcaaggaatagcagccatgacatggcagtaccagcagctgcagcaggtggacagacaagaactaagttagaagaaagtgataccattagccttgaccttggaatgggaattagctcagctgttgaacataggtcaaatgggcaagggaaaatgctgcattcagagtttggggagacacaaactcatactagcagttccaacttcaagtttgttcatactacctcggctccagtatactttggtgttctaaataacagctcaaatccctatggttctagagacaataggagtgatggtccatctttaaaccgttcctcatatccatacccacagagcatgggaagaatactaatgggtccatgaagttgattacacaacagatattaaataaaaaactacgagtaacaatttgctttcttttttattatttttggcgggtatagcttcaaatgtgtaacatctcattttctgtaagaaaatgcagatagttcttttatgtttatatcactattccatagcgcttctgtttagtagagttgttagcagctccatcttgacttttaaatctaattgccgtttgtaattgtataattataaattataattgtatccaaattcttctgtataaatatgaagctgatatcaaagttacctccacaaaaccttagtccccactgcactggttacaagtcgtacataacccgtgattgatgacctgttttgacatggtgaaaattgaagtgcaccgtgcactaaatgatatcatgaatttgtacatgttggatattctcaatgttttgtgtagattggactctctaaggccattttcatcctaaacgcctcattttctactttttacacattttaaatgaaatttcactatcatcatttatttaactaaatacgtctcacatatgatgtaacctagtgctccttacatttcatcaacattaacattccttttgtgtgggtcttgttaattagtattcttagggtattgattaaagaattaaaaggaagaaatatttattgtataaattataggagtaaaaaaaatcataacataattttttttctctcaataaaaatatttttactttaagttccttaatcaatatcctcatagtacttattaacatttatcttcttttattataaatacttattttaccatcttgaccccacacagaaacaagcacatgcttaaataagtatccgatgtttgttaagacctgtgatcaatgattgtcttaataagatgcggtgcttaatgagaagatttgatgttaccattgcatatcaagatggcctaacacgattttttttttattttttattttaataatatgattgagagggatgtgaatatagataaatgtgtctattctctattcacatacgaaaaactcggtggatgttatactcttatacgtacatataccttatcctcacagacattaagaattcaatcctttggtttcagcatacaaaaggacacggtccctttcaccctgtaatttagggagggggaccgcagcattggcaaatgtgctgcacttgttgtttctagaaaactgaatagaagggaaaaaaatggggattttttctttgcatgttcctagtacattgcaataacattaatttagccactgtcatatttcattgccacttctcaaggtgtgattagtttagcgtagtagtagtatttggactttggagtgcattcaagaattttgctagaaagagaaacacaaatgaaaggtgatggagccaattgaataattatgttataactgaacgtgctagcttggtggaagagcaaaatgaatttaacactatttttgcaataaatatacatcttgcattttagcacgacatttgcttagatataggatgaatttcttgtattagtcaatcggcattgggatttacatactgccatacttggaatattgattgataaatcctttatgacgattggattctcttggctttatctttgaacaattctgacatgttcacgttggtctttaattgcagtgcaagtaaagtacaactttcttaaattcatttatttgtcttagcttaaccaggactgaagaatcatgcagccacgttgtgtcctatttatggaatcaagatgtatggattatgagctgatccttaccatgagcacaaatctgtatccttactatatcatcatcatctagctagaacccattatgatttttttatgctaacgggaatggttcttgtttttaaagaaataaacaccaaattagagataaaagaaagtttgatctcttgtttgctttattatttatcataaaaatggaaaaagcaatgctagtgacatgactctttataccaaagaaaaaagccacaaccatgtttctgtatgattgtgtctttaatatgtgaagcgacttttcagaaccaatatgcaaacagatgatattctattttgtctttagacttgagcatatcactttttctttttcataaatgaaaagagaaattatatatatttgtacaaatagtttgtaatttttttatacaacagatagaggtaggaatagaagaaaaatgcaagataaatactgcggtgaagagaaataaagagaaaattgatattgtaaaaagtgttgtatgaatgatataactcaagcgtaagattaagcccaaaaaattatatgttaggaacatatttcatgattgaactggtgaagttaatcttgcttttgcaaaatttgattagctaggcatatgatatggacattgtaactaaaaatcaaagaactgcttgcctaaaactgacaaaagaacaataaatgactaaggagagtccaccgtagtcttgcctttctcaagcattccagagcagacgtttctcactcatttttaaaacagatccatcatctgtgtcctatacggacagaaggaaaaagaaaaggttgaaatatatttttgtcctaatgctacatgcattttaattcaaaacttgtaccaaaagaggttttaatttcttttaatgttattttctttgttgccgttacaatgcagtaaaattaacacacggtcattgtaaaatataaaaactaaattgaaaacaattatgcataaaaacaaaatataatcttttatccatatacataaatttcaatttggtcaacagacagcaagaaataaaaacaattatacctttataaataaactaattttttccctatatgtataaaattgaaaatgagtttagtgaacaaaaatttactctttgttttttgtccctcaattttgtgcatgttactgagacaacaaacttgttcacaagaagccattccttttgtgctcatatatttcaatccacacagggaggaagaggagcgaaaaaagagatgcatgccatatgggtctccttgaaggataatgtcaaatgtggaaacaagctcaacgatgtaatcaagcagcaaacaaaatgcggcaaaggaagtggctatgttgcagaaaaggagaaaatgaatggatataatagacctctaatggaaactccaactagcctagtggtttcaagaccaagcaacacactgggaaggcttcatggtaagttactaagttgcatgctgctcctatttgcatgaacacatcatgcttttgtcttcaaaactcagtgtaactcggtgtgtcatgataaagaagtttgaaatataagaattatgatttttcagaagtccttgtaatgtaacgggcttataagaagaaactagctagagcaattggtttatactttcttacttcctttatcctttctttcactatctatatgttttgttctactaacttgttaatgtcattataaaattatggcagagcttagtgttggagacccatcaagaaaaattgtggagatgatctttcaaaaagcttggtttaacaaatcaaagccactgaagaaggttagaacagtcctcagggtgagttactcagaagaagtccttgaaaggtttgagaagtatagagaatatgtcaagaaggtggcctctgagcaaaatccaaggaatccaaggagcacagttgatgggaacgaactgttgcggttctatggtactacaatgagatgtttgcaagaaaaatctgataagaaacttcatgatctgtgtaaagatccatcttgttatctttgtcaaataattcagtttaatttcaacacacgatatgcagagattcacttgaatacaagtgacaaagagttgagaaacagaacaactgccactgccagagtacataatgtgaaaaaagctgcaataatttgcaggataattgctggaactgcagtaaatgaagttgatggtgaatatgaagggtctcactcaactgggttaggagaaatgcagtttaccttagaaaaatttgtagtaaaaaatcccagttctattcttccttgttttgtaataattttcagctaacatgttttgtaggtgtaaattgtcattattcttttatctttgtaaggcgtgtcatagcaaaatatagaatacatagtgctgcttgccattttttcttttttctactttgatgagatcgagcttgctggttctggcattattaacataaatcaagtgtgttattttaacaaactatagagtaacttgactatgaattccgcgaaagaagattaggatgatacataaactaactaaaagtctgaaataacaaaaatgaaccagttgtcattggatcatcacctccaagcacaagtggtaataagaacttgattcatccaaccaagacatagagccccatctctctcttctagagtgtaatgtccttggtagctttgctgaagattttttattgaacaagtaataaaggagttcaacggatatggtgtgaatccggccatagtgaaacgtgatctccacttctttagaagctcgtgacgttccactctttctgccccttcacatgctattaagttgacaacttctcgagccaaacaatgctgctccacattaatcctttctttgtgctccctcggcagagcaacatcaattgattcaaaaatagccaagtagtagttcattgtctcaacaaaacgggggaagaatgggaggttgttggtatgtgattcttgctcaactagtgtcacaatcttaggagacaagcactttgccaatctcaccaaccggtcacgatggttccgactatccacacattcatctggaacatggtgcaacatcatggcaaagttcacagcaatagcttcaccaggttgaagtgcaaggtctttgaattcaacctcagtgggagcagctcgtatagcatggaactcaaagggtacattatatgattttgcaagcattgataaccttgctccaacaatttcaaggcctccttccctggcataagctgaagtggagtcatcaaaacctgttattctaatcttggggggtgctccaggtctgccagcaacagcttggattaggcttacccactgaattccctggttaatctgaaaatcaataatgtggacttcactttcctcctccatggcttcagcaatagctccatttgctgacatgtaaccaaatttgagatatggacagatttcataaagtagatgcatgtgtgaaaggagttcactaccagtaggctctttacatttcaagactttgtagattgtgcttcctgaagaggccagccttgcaacaagagcctccaacatgtatgctcccaatcgttggattggattgcccgagacggagaccattttacgcaactctgacatcaaccattcagttgtctccatatcatttcctgccactgcttttgcacatgtacaaagcatctcttttaaattccctctagatatcatttccatcattctcttccacctttctgcctctttcaaaaacgaatcagattcttctggaattatggtatcataagtatccagaatatctgtatcatgtcccaacatagcactttcaagctctcttatcttgtgcctcagctcatcatcgttaagtgtcaagcaagattcgttttctagcgaatcattaacaatttcaagcgaattctgggaactcaacacatttgattttgactgcagctttgagactgggctattgttaggtgagaaactgacagtagatggagaatttagggaagggaaattgttgtttgtagaagattccagggtgcaatattgttcgaaattacaaacagaagggtaggttgcatggctaccgttatcagaggatgagtagtagtctaggttcccactttgcaggaagcaacatgaccccagattttgcacaggctcaatgccgaacctgctagagtcataggacattttatgtttctgagacatttgcatttgaaaagtaactggtactttgaatatatgcaaacaacaccaaaatgtttttctggtataaacactcctgaattttctgatttctctaattttttgaacaacaaacaacaggaacttctatttatggtctgtgatcgttgtccacattttactccaattccagctggacatgagcagtgttctcaaaatctaagatattctgcagaaagggtaacacaacagtttaagcaacaaacatagatagcaaaataatagaagctataaccatataaaacaaaaaggcagtctcagtcctgatggaataagaagcaggtagtattgaggctattgtctaaaattggtattctttgatgtcaggagttaatgaatatggaatatattactcaaataaaggctagaaaccaatatgaacagagttggattatttattgaaggcataagcaggcattttaaaactagaaaaacaaacttgtatacaacatattatatttttcagatttattatatgctattccaactaacagcacgccaaagagagtctgattttcataatccacatgaacagaatgtagttcttaacatccgaacaaaacagcaattttatcattttatttgaatctttttataatcagtctcttctttagcttttcactttccacatgttattgtttttgtttgtgctttcaaatttgatgcaatcaataaatggagattgacttgataaatataactagataatgaattttggagcacttgctgctacttaaagggagacctttttttttttgttttttttttgcttttttgttccctttatttgttcattaaaaaagtaaaaaaataggatcgttcagaaatgcctcccacatgctattcatgattttcaattccttaaaggaatactcataagattcattaatattttcttgaactcaaacttctttaaacatgctctaaacttcaactcaattacatagaaaggtgaatagggacttccaattataaactaaaaataaaaaataagcattcaaatacaaattcattcaaagttcaaacacactgagacacagaaattctgatcaatcaccctgttgattcaacaaaacctaaactgaaaagcaaaacaaaaaagtgaaaaataattactataaaccagaaagggatcaaccttggaagtaattgctcccggttaaacataccattgttaaaagttaatcagcaacccatttttacaagctcaataacttccataaaagtaactttttttcttctctgataaataaaacaagatgcagcatctccttcaacttcaacatgagcagcacaaacacttctataatctatatggtaaagaagtaaaaccacttccctcccacaacatcctcatacaaaacaagaaaagtagaaaacaagatcagcacaatattttcagactctcaccttaaatgaaaaggaaagcatgatctgaactttgaagccaaaacaatagagaactgatgcaacgaggaattggcatgcatgtgggcttttgtttttgtggttttattattcaaggttggaggcaaagaccaaatacaaggttgttgagtactatattttataggaacgcttacttaggcaatgcataagtcttgttctccccccagaaaattaccactaagcggattcaatcatgtttatctcccaaatttgtcctttactcgttgtcaataatcttataaagttaacttcgtgttatttctgttaatcacctcttaagcagttaagcattccatttttttcttcattttttttcaaaacataattttttacatgctcttttaacataaaagataaagaatatttttaacgcatcttaaaatcgttggttacaaaataaaatttaaatgttttactaaaatgaaaaaaaataataatattaataatgttaaatatttatattttttaaaatatgtaattggttagaactgaattagattcaaacattttaaacaaagtcttgagtttgagaatcaagtcttatgaataaagaaatacagattaagaaaagaaacttcattaaaaataattaactaatctttttgacaattattcataaactgataagcattaattaatgcctaataacaagtctgaaacctctatgttttatttggattccactgttccgaatacagacgcacgtgcatgacacgtaaacattaattagagtgcaagcaacgatctcagttatacgtcatctgataaaaaacgtgatttaactgtcaataagttaacttttaaacttaacaaatcgtatttgtaaaatagactcacgtgtgaaggagaagaaaaatcatgtaaggaatcaatatatgcatactttgatgagttaaaatgagtattttaaaccattttccagaaatttacgtagcggtgtcttacattttaatcttaattttaggaagaaaagtgattttttttcccatcgacatgaagatttttatttagtttagtcgtttgttgacgtctcttgttttggcgcgtgtaattgaaaaagaaaaaacaatgaagcaagtgtgtcggtaatggtatggtggttgataacattgcccccacacggtttttttttttttttttttcatttttagggatggaaattaggcattaattagtattttttttattgactatatttatctttcaccgtaaacaattcgagttacaataattatgaataacaaaaaatttccttaaactcaaatctgaattaattaaattgaaacaatcatatgtgaattgatgtaggccctcaatgataaaattaattagtataataccatcaataatctttcttctccccattttttatagatgcagatatgcgtcattataattgcaacaataagagcagtttttaattaaacacgacgcagtctagcatacgcaaccaaaacatgttgcgtatgctgcgtgagtaatggtggccgtcagatttattaataagggaaatgaatggataaaaatgcttgttgctaccggttgtgggagtacttaccaaaatgttatgcgcagaaggagttcacagacccatttggagaagatagaatgcgcttctcacaaaaaaagttcatttatttacataaaattatgaaatcttatatttatactatatatggatgatattgtaaagcaaattaattgtatctgatgttttttagattacaatattttataatttagtaaaaaattaaatgatacaattaaatttagtgacatttttttaaaaaaataatataaatttaattaggtaaatttattcagctttctattatattttgctttatttaattattcagttttttagtttatataatgttagattttccgtttataagtcataaaattataattttgtcatttatcgttaatgaaagtgcctacatgatatagagagacaaaaatgattgtcaacatggttgttgactaaattttgcactaaaatgtaataagttatcattggactaaaatattagtaattttcaattagaccaaaatgtcagtaatattccactgaactcaaatgtcaataatttttttggtaaaaaaggtcaatacctttcaatttgaccaaaatgttattaagagtaaatttttcctcttttttttatcattaaaacataataatgacaacacaataatcacttaaaaaataagaaattaagtataagttaaaagtagggatgaaaataagtcaggcctcctatgggacctttggtctgacttgtttattataaaggttaggctaaatttttttaaaaagtctatttaaataaaaaaaaagtcagacttaagcttttaaaaaattatgttagacctatcaagctggtctatttaatatatatatatatattaaaatttaaaaataatatatttatttttctaaaaaaatatttttccttattatgaaggtagatgatcaaccacttcaaaaaatcaccttgaaaatcttataaaatgattattactcatttaaaaatataagtaagatgttgagatattttctgtttaaaaattatttctttaactttcctaaaataaaatttcctaaaaaaatgtttcttcatgtttaagaaatggttggatataggaggagaatcatgaagaatggaatactttgattcaagactgaagcttttaacatgcttggatgccttgattagaagaaactagatgtaacttctgttgtgaagtgaaccggtataaattgcttgtatattgtttctcaatctctattactcttattgttcattgattatttgtttcatagttcaacaagtcctattttaagcaatttgattccaaagggctgaactatttgattgagtaaaaatatttcttagttttgaaagtgataaagatccttaaactctgatttgaattttttaaaataccaaggtttaatcaattcaccttccctcttgattattgtgagtattcccttgattcttatttcttatttattttgttatttaacattaagactagattgtaaaatgaaacttatgatattttatttagcttacttattttgtttataatattttgttgaatacttaaaaatgttctaattaattttaatttttttcacatacaaattaaaagggtggtatgtatctttatttatattacaccaattatgtgggattgatgtttattataattagtcttaatctattataatttgactaattattataatttggataaatttataatgattaatacattgttacaatgtttatttttgtatattggtaaatgtttattttggataatttctattatgacagacaaattatagttattaatcaatattatgattattattatgggataaaaatgataatttaccttaaaattatggttattagtgctctacatctttaggaacaaaaataattatctattctaaaattaattataaactttaacttgaaaacaacaacaataatattaatgtcttttaaatagaccaagttgttagacttaaaagaatttttaaatagtaaaagattgtcctttttaattaaatagactttaataaaaaaaattgttttgactcattttttgaaaattttggcctaaccaaagcctcctcaaatagactagtctatagattcctagtgagcaatttgatcaaaggatacataatctcttagcgttaaatgcgcaacatatgaaaagacttgataattaggaataaacgtgattgaaggatacaaagtaaatttgttgtctctcttatgaaaattcaagaatattattgtgacatgttgactaattagataaaaaataattaagtgaaaaaaatgagatgataaatttcaataattttttaaaaaataatacaaattattcacaatttcatactattaattcaattaattaagtttttcaaagttatcgtagttttgatattttatattaacagttaattattgtcaattttatattttaaaaaaaatatatacaaatttgacaaaagaaatgtacacgtagaagtagtggagttttcacaaatgacagtgtccagttatattatattaagactttttgattttttttttcttctccataatatctttattaactttaatcacattaaattaatttatttcaaaagtgtttgtgttgttataattaaaattttgtttaaatcaaatcacattttattaggataatagtaattatttaaaaaaattgcttgtaatctatttatgctcattaattgttaaattatattaattgtcagtagattaacatcaataatgtggtgtttggttccttgtaagttgtgcctacgtatgtgtcggtcatagttgcagacttgctgcgcatacaaggtcacatggagaatatttttagtaagtactcccacaaccggtaacaacaagcatttttatccattcatttcccttattaataaatctgacggccaccattactcacgcagcatacgcaacatgttttggttgcgtatgctagactgcgtcattaaacacaaacttgacgcgtttggcttcaaccctttcacgagcaatcacacccacatgcataaatgtatctttatcttcttaaagtacgttctgctgtgtttgtattgttcctttcgagtgttgcaaaaccaatttctttagatgctatccaattctggaagttgagttggaatttgaactaaactggtttcactttgttcttttctgtttgtttcaattcaacaccaacatgctgcacaccctgattgttcacgtcataaatcgtaatataggatgacatgaatttcttgtcagccatacgtcataaatttttggtggttactatttttcttcttcttttacttaaaaaaaaaaggaagaagaagccccatgaatgcgtttagaactatgattctgaaagtaaaaatagaaaatgttttataaaaatctttgttatattaaaattacaaatcatctaatattttttaaaaataattagaagcaattactagtaataaaaatgttttaaatactcaacaaacttgttaaaatgtcacattacaaatttgaatcctctctaataaactttcccgattcaaattactactatctagtacaaccatacattgcatttaagaggctagcgattggttagattgttttacgactaatcaattaatcgcaagattggtgcatgttaatggaagattgaccaatgttttgtgaattagtcaatcgacattaaaatttgtcagtattgaccaatataccaaaaacaattgaccaatttccattaacatggaccaattgggaccaattaatgtgcagcattagatgtaatattctactgtgatttgatggaggttgagctagagagagttggttgcaaagcaaaggatccgtttcatcacatcaccctttagaaagcgggaaagggacgcaataaagtagcataattttgtagttgaagtccatcaatactattaaatgcaatttaatagatagaaaattagaagtccaaaattgtggctgtgtactaattcaagcaccaagccaaggattcttaaatgcaaaactgcaaaaacaaaaacaaaatactactccctctatctctttgactatgagaaataattgtctaagttatgtttattaaaaaagtttaattaatttagttattaatattaagtttatctataattataatatttttttcaaatttatctttaactttattggaaatcgattaatctttctcaaatctctataggaaagagaaagagacaatccaggatattttagtaaaaaaataagaaatacacaagagaaataaaattaaatcttataataaaaataaaaatttgttaactatatctcataaataaaacaatatcttataattagagacacaaagaaatatattatttcagaatggagaaaaaataatcatcataatataaatttatcaacgtggcacttttttgtgtgtcagtaaagtcttaccttactgcaagatcatgtactcttcaaagtcaatatgataaagtcctaagataattatcaattatgtaagacaatacacctaaaagtagggacagtatacgaaggattaggttggaagatcttgttacagattcgtgtagactactttaggtagccaagcgtcatgtaacaattacgagtatgtgacatcagtaatgacatagttatagagaagaagatgatgaagatgaagaagaatcatggctgcctaatttgaaaagaatcttcttatatatggcgttggtattgatattgatataaaggatttaatacgaggtatattgtaattggaataaacgaatcaacctcaaaatgataaaatggccttgagagactttacaagaggcatctgtttttcaattctggattcgttcaacaactatcagtagcttgaaatagacggtaaaacttggagaatttgggcatgattggtgttaagaatatacattatttggaaaaagggataaggtcaaataaacatctgttctcaaacttgtaagatagtaacaagtagtaacacatttagtaacttctcacattttaaattttattaatcgcgtagttgcattaaaagttcttataaaatatattaagtctacaatgtatgcgacagaaaatgcaataatggcttgctcatgcttcccaagctaaattcactagtattggctttaaatccttgctctatcaatttaatgcatttactgcgtaagtaagccagtctgattacatcctatccatgtgaatattactgaaaattggagtcaattcaatcagaatcctagacacaggaacaacctacaatgaaaaaacagctagaaaaccaagcttctaccacttcaaaaaaaaacagtccaaatatcaagacttcacctttaaaatgcctccagtagcataaaaaataatagtttaatattggtaacaagctacatagttatgaaatcagccatcggatatatgtgcagcagcttgatcttatcacagaaggaagtcctcattcttatttttcatcattgatgcacccaaatcttttcctagggtgagtaatcaataaggtagcaaataccatttctctcaaaaaaggaattacaatgttttttataaattttttatttggtaatcatggcaaatggctttactatgttgtttacatttgtgtataatagagaatgttatcacaaacagaatctctgctaaaataaagttgtcattgttgaagtatgctttttagtacaatgctgtagaaattaaccggagaagaatcttttccaggattgccaaggaagaaacccacctgcgatatacagcacatgaaggactgtaaggtaatcaatttgacacgaataacttagttaaaagttgatcaacaaaacataaatgacaagaaaaatagggaaacaacaaagcaatgagaagtaacgttattggtacaggtcagactaatgatcataatttacgaagtttctaaattgatattatggttgtgaaatccagttattcctttctctttaaactttcagaataattaagggtttgaaacagaagttacatgagtgagaccaaccaatggtactttaattacactgctggagtggaattactaaagaaacgctagaattcaccatcatacacttgtcatagctcctcataaccaaaatgaaagaaactgtgaaccaaaaggaagaggatctatgaaaaatatctccttttcaacatcaaaatattctcaggttgacaatagatattcaaattagcttgggaatgcagggatttctgcaattcctaggtgttcaatgtacatccaaataatttataactacacacattcaagatactgaatttgatgttcaattactgagacatcagaaagccccataaatcaggaatatttcagagacatgcaataacattctcccagctgcatacttaattggttaaatagagtacatgatatgagaagaagaagtgaatgctatcataccacattctgggcaacggagatagtccttttccttttccctaagaacaagccctgaccctccacacacctcacatcttttttgagctaactgtaacattatccaacaatgaaggcatgaaacacacgggcttcataacttatgagttagcagctcaaccaaaagactgacttacaattcttttgttaaattcaatccctgccaccacaaaaggggtaaccccagctgcaaaattcaaacacacaaaatcaaaacccaatttcggaacaccgttctctttccataaagataagcacaaaatataactgcagtcttttggtgctgctctcaaatcagaattgaagtttcatctcgataacatgtttaatgcaaatctttattaagcagattattgataaaaaaaatctctaatttgatttaagaataacaatatcaaaaacacctaataaactgcatccaaagttttgtttgtcctataaaaacaaacatcacaagtaaagtaaaatatcaaaggttgtgctgtgtgacttaaggtacctatagctccaaccacaatttgccatgtgacttccactggggcagggtcaagtactgtggttacatcatcaacattcacaggcacagcagccacccttgttcttcttgcattcttaacacaaacattattacaacgttgtctttgttgagtcacatgacagttctgtgagactttgctcctagttttcacactccctaacgaaagcagagacaaagaagaagatgctgcttccatggtacggtaactaactgtccaagctcgttcatttcacacttcacaacaacctaaccgttataaataatgccacgtgggcttttttagcccacgggctcgcgccacctacgcgttacattgtgtgactcatgtttcagatatggttttaagtaaaaacgacaccgtttcagatagaaagataaacctctgggagtgcagagattctgattattagggttttggagtatattctttttctgtttctctctgcaacaatggcggctgttatgcctcactatccttataatccattgctatacttttcgactccttcgagtttttgttctcaattttggatttttgagagagagcgtttgggttctgcgaggttgaagaatttggtgaaacttgcagcacattccaatccgaggattctcaagagcaacaggaagtcaaagtatggagaggcactgtcgctgtacgatagcgacgaagacgatgaagagttggacgtcgacgacaacgaggacgacgatgatgattggctttctgatgtgagctttgtgatttcattgtgtgcggtcaaaagttttctttaaattctaggatgaatatctaattcaattgatgggtgaagtgggttttttaattatgcatttgaattgtttctttagtccaatgtaaaaaactgaggaatgtttaattatctgttgaaatttgatattgatgatgattgtttctttatttgttaattttccctttcattggggaacatgtgtgcaggaggaattttctgagcctgctaacttagatgttaataacatcaagagatttaagtcaaagacaactaaaggtatgcttgaaaatgttatattgattattagttttaaggggggaagttgaatattcagactcttgtttgtgcaggaaaagatagacaacaggaacaggagtggggtttgagatcttttgacaatgaacaaagcattagattgcctagaagtgagagagtggcatccttacaaagaaatgagagtggaaaggtaccaaatcgtgatacagtaagctgtgaactgtcaaattgtgccatttaatgtacttgtggtgctcttgaaccttatgtttatttatctttcttttttcaagttgcagcatagtagaaatgtaaaggataaaaaatatccgcggttgtccgaggagattcctttggatgtgaaatggttaccacttcttgattacttaagcacttttggaatgaaggaatcacactttgtccaaatgtatgagagacgcatgcaatcacttcaaattaatgtgtgttccgcacaggaaaggttagaatacttactgagtattggtgttaaacaaagagatgtaagaagaatccttttgaggcagccacaaattcttgagtatacagtggagaacaatttgaagtctcgtgttgctttcttgaggggcctgggcatacctaattctagaatagggcaaattgttgctgctgctccatccttgttttcttatagtgttgagaattcgttaaaacctacggttagttatttaattgaggaagttggtatcaaggaaaaagatttgggtaaggtcattcagcttagtccccagattcttgtgcagagaattgacatttcatggaatactcgttgtatgtttcttaccaaagagttgggtgcacccagagatagcattgtgaagatggtgacaaaacatccccaacttctccattacagcatagatgatggattacttccaagaataaatttcctaaggagcataggaatgaaaaattcagacattgtgaaagttttgactagcctaacacaggtcattttgcatgtatttccctcattattaatttatgaaaattatcctgttttactgttccaaatttcgattcctcctttccaatttatactgtttttgtaggatgccctacatttgcacaaatagaactaggaaaataatatattgttatatgacattgtcgtatatttttgtatattttggattcatacttataatgtgaagaacagtttgtatctcttgttaatgttgactactgtgcctgcaggtgctatctctgtccttggaggagaatctaaagcccaaatatttgtacttggttaatgaacttaacaatgaggtgcaatccttgaccaaatacccaatgtatcttagcttatctttagaccagagaattcgtcctcgtcataggttcttggtttccctaaagaaagctccaaaaggaccatttccacttggatctctagttccaactgatgaatgcttttgccaacagtgggctggaactagtttggataaatatttggcatttcgtcagagattgttacttaaaaagtttgctgagaaatatgaaagaaaaatgtgacagatcagaatcaagtttgtatctgtcaacttgcacgaatactggaaaaagaatctgttgtaatattattgtcatgcatcatgttgctataaaattttcgtgatggtctccattgtggctgaagctcaataattagagtttagttggctatttggcatactgtcatcacatgatttcatgacacactcaagtatcagtgtctgattctcagcagaagctgcccaactacttttgtgaagtttattattgctgtgcttgtggctgaaaagcagaacacatcatggtgcaatttgtcaccctaaggtgagctggtttgttagttaataattaatacattaagtatgctgttattaaccataagtctcttaacatatcgcaggttgtggaccatattgcaaacttttattggtataaattgaagaagctgtatcaattttaactctaagatccagcttatggattctgtcatcgctactctcatgtttcctttttacctacaacgatgtgtttgtgtagatatatctttttactgtttgcattcttttgtgtatctgagatcagtagggcttctgttacctttgtcaatgtcaccttcaccagaccaatacataattttttttttttcaccccgcggccatttgtatcacatgtatgagttgaaataacattcatattatcttcagtactagtaattgtattctatcttctggatttatttatttttggggagggggagggggttgcttggtttatgttgagttggtgtaatatatcactttcatctttcagtcgtgtattctcagaagaatgaataaaggaatttcttataatcaaacatgggtagattcaggttagagattgatatttttattatgataaaaacaaaggtatccgcatcattaactggatatggaagatactttttggatgattacagggaagaaatgacgagaaattattagcacatgcttggaaatggattaatgttttgaaattacgatttcacaggaatagcagatgatgcaatagacaggttaaaattaaggttcattacattaaacattgttttcaatataggtacacgttcaaataaattgccatccaaatattaacaaattaaaaattgttttctggctcgtataacttttgtcatgttgcttacaatggaatggacgatgatgctctggcaagctttatttaatgattatttccacatcaatgacgaaaagtgattttggttttttttttttttttttttaccatcttccaaactttatcttgcttgtggtataaagtttcatttgtgaattgagactaatattgttcgtatcatatatgcacaatgaataatggtctctgtataagcttcatacttctcatatattttactcgagttatcttcttggtcctgctagcctaaatcatgtaatacctcgcattcgttaagcatattttcacagcgaaaattacatgaagaaaattgaacagtaattgatgatgcaaaagcaagctaaaacaatcaagcttcttatctagcatttgcattataaacgataatatactttttctttttgagattatgtgggggaaacaaagtggtttaaagtgagaaaaattcaacctgtaaacatgacatcgttgaacaataattcaagattctattttagcacaactcattatatgtatttctagtttagtaacccatgacttgagttcgaatctaaaaacagtctctttacatatacaagaataagactgtataatatttctcccccttacctacacaggcgtgaaatctctgggtaatgaggtacgtagttttagtttttttttttaatggacttgcaataaaccattattaaagcagttcatattgagtaaattagttcctcaaaacatagactcgtattctaagagctccttcaatctaattaaaactttggacaataatatacctagttcttttcatccactaatgacttcatgaataaaactcaactatatgatctaaaattcaaacattttgccacctgtctgtaactaaaagctataaccttcttacatgtatcgtttaacttttgttattgccaccaattccaattgtgaagaggaaattcttcccgtgtctcttcttcagcatgtatgcactagctggaattttgactaaaattactgcactaattgagaaatatttccatagaagaactatattgtgtatgaaaagaaagctgcgaccattggcctgattctgtttggactctatatttcttgtatatgtatctgaaactatgactgtttacctcccactatctagtgaaaatgcgaatggactgtccgggagattgagtccttgattgctggataaaaattaaaaagtaaataaataacattatccatagtcaacaaaatatttcaggaaaagtatagcagcaaaactgcatgtttgcaaacaaataatatcatccacacagaaattgtaaacaagcagaggtaacttttactatgtctcatatttgctacttgacaaaacgaatggtgttctactacagccaagatcatgaaagaaaacttttagtgttttacaaatctcttttagtgttatacaaatcatgaaaggaactattgtttatggggtttaccggtttggctatggtatagagatatatcagaatggttacaatcaaatccttccatcatttctatttacataaaaccctcatatagttatttacaactcaaataactagaaatttaaaatgaatgagatagaaaatgacttcaaaggttcacaatacaaaatttgataaaatgtgtaacattttatagtgtacaatgttgaggtttcaaagacaaaaatttgggatcaaaagatgatttaaaataatgtctcaattgcttggtttgaaacaaaagatgatttaaaatggtttaatggatctggttcatagaaattttcaaagaaaagttgagaatttgagaattttagataaaaagaaaacttataggaaaggacttgattataataacaaaaaactgaaggactaaattcaataaaaaaattattaggggaacaaaatcccagcgaccatagtagtgaaacaaaaagtacaattaagcctagtgtacacaaaacaggtaggaagtagaatgtgagagggagagaagtctattggaaattgatgcatacctgtcctcatcagagtaattggagtctgtatgcatggatttggcatgcagtggaaaaccgaaagattcttgcgctggctggaaattgaagtgatctgcatgagaaattatttcaatcaatataactcagaatgatagttagaacatacagaaacttgataaatagaaatgtaaactatattatcacacaccatctgaaatccttgactcatccatggagaagccaaaatgaggtgaactggagaaagatttttgggcaaacggaagctgtgcaagacttctcctctgaagttccaggacttgctcctgctcttcctcttcaattagttgtggctgtctcctaatggatctatggttcccaaaacttcttggaactaaataaattataattatgcattagattgtacaaaggcttctcccacaaaagggaacagaaagaaagcagatcattaagtaacttggatgagaaaaccaatcattgggaagttaattgataaccataagaaataagaaatattttgggttgtaaactagataatgtcatacttgagttaagttcagtgtcgacatctacatggcgtggtgaataacaaacagggtgctcaattctatctgtgtacttcctgcatccaaattgaaatgcacactgaaattattatggggaaaagaagacattaacaatgccccaagagaattttaccgaaaggtatataagcagaagcacgtaagatttctttagatgtaaataccaattcaatatactacatttgtccatcttactttgcatttaaagaatagagagagacagagcagactagttttcacacttcaaacaatgcacttgctattcagtcacaggattgatttacttggttgtgtatgttgacaacaacattattgtattgtacatgtaaagcaacatctctttctacattttggacaatatcttggcaaggttaaatatttcttgggaatagaggtggcacaatccaagaatggtattgtcatttcccaaagaaagaatgcaatggatatattagaggagacaaattgatggatgctaaacctgtagacactcctatggatcctaatgccaagcttctaccatttagggtgagccattggttagaacttagaagactgaactaactcactatttctcatccatatatctcttttacagtcaatgtggtaagtcaaatacttaatcctccctgtgaaggacactggatgcagcaatttgcatcctacaatatattgaagaagctctaagaaaagttctcctgtaagacgacaaaatacagactagagttgtgggatattccattgcagattgagcaggctctccctacttatcacttatggcgcattcttattggtgataccatgatttcttggaaaaataagagtgttgttgccagatccaatgcataagcaaaatgttaagccatggccctagccacttgtgaactaatgtgactaaaatagatgctcaaagaattcaggtttggggaagttgcacaaatgacacatgtatgtgacaatcaggcagctccatattgcctaatatccaatatttcatgaggaccaaacacaattagttatatgtgataaacttggtgcctatgatttataaactatagctggatggacagtatgagagactatgtaaatatgttagaaattatgcaaatattgtatttagggaactgtgtgtatttatgtaaattagggtaaccattattttgtatttatgactcattataaataaaagattgtgtaaattagacacatggatttcatcctttgtctcttgacctctttttttcaataaatggaaaggggagaacaaggaggaagaactaagaacaagggaatcaagtaatcaacagcaaggaataaattttcatcaaattatgctaactctagcaatattgatgacaattatgtagtcatttcaaactaaaaaatataagcttttattttacaatattaacttaaaataactacatttacaggaataaatgagaatttcaaaccataaaactacaagaacttccaatataaaaaaaattgaaaggaaaagacagggaattcacctttcattaacctttgccttctcctggtaagctttcacaagcacccgagaatccccaacacaatggggattccccttatcaaaaacagttttgacagtttctgaatgaacaaatgtcacaaatccaaacatccttctctgctggtttggaattctgacttctgcaacaggtccaaatgtgctacaaaggaaatatataaaagtcagttcattaatgcaaataattaactgcaaagaaatgggaacatgcactttaacaacaaaagatgtaatatacttgaagtagtttgagacatcatcctctgtgaaagtgctgtcaggtgggaacgtcagatatatttgccgtgaagcactgatatttcgagcaaaatctcccttttgcatttgtgtgggagcatcttctgccagaaccactgaatgctgtccgtgaggtctgtaaattaaccacaagagaagccaaattagagtaagaaacatcaaacactaaataaataataaatgcaaaaaaaaaatcataagcctttacctgcctattagcctaatactattgttcagtcgtgcaagaagctttgtcaaactatagccagacttaccatgcctctggctctcagttaaataaccatctgcttgcagtacctttttatatttatcgtagtatgccattggcagggaagcaattgacattggaccgctttttgttcttaggagctcaataatttcagactctaactgtgccagtgaccccggggaaatcacctgatcctcactaatattgtcatttccatacatctgagagaatttctcagggacaacttgcccatgatagaatctgcagcaagttccatgcttacagaatcctttgttgaaatagtgacatatcttcaatggttcagaaaaccttctcccagcttttccacccaaattggcagcagaagcatctaagccatagtaatcattggcaatccctccagtcccagtttttacagcatctatttgattctccaaagtgagcatctgtgtctgcttctgaagttctacaatagaatccaagtaactagttcccataaagtttggattaacattgccagcagattgtggatcccaatagggaggaggcacctgaaagtttggtgaagtaggagttctaggggaaattactgataaatcacttaaaccttgctgagggtttacagtacgtgacattgcgagcatatctggtttagcatccaacctttggagttcctttctggcctgaactgccacttcacggatgaaatagtcagggtatgaagccaatttagccatttcttgttctccatggccttgaaagaagatataatcaattatctttctagcattctctgggtcaaatttctgaattttatcaaagactatacttgtgtagggagaatccataactcttatcttgttactgcaaaaagtccagcccgcgtaaacaaaatttagtgaatactgctcacaaaacaagcacaaagaaacacaacaaaaccacatctcaaagattcagcacaagacatacatagggtacaaaaaaaccagagtcccaatcttacaaaacaaaattgaaaacctaatataccataataaaattgactaaacaaccaaaaccaaaaaatagtgtacaaattctgaggaagagattccacaaatccaacagaagcaaaaaaaaaaaaaaaaaaaaaggtgatgctcttgtgcaaaaaggcgccctattccaagaatcaaatattataaaaagacctagcaagacaggacagagatgaagtcttagaataggaaaacactccacagtgcattatattttcctcaattttctgtcatcacccaaaaaggaagtaactttaatgcagcccagaaatgggtcttgctcctaatatggaaatgagcacgaaacacgctcagaaatatccacatgcattaatcacacacaccattagaaagtcgcaacagaacaaatggttacaagaaaacgaatcagcatttgcaaattaaaaaccgggcactgacatttcaacattggtgactaaaggtccaatttttttgcaaaacaaagaaaagttggtataatctcaaacgactatgtaaaccccaaagaaaaaaaaaagaacaaataaataaaaacaaaatcttcaaaagctgcatactcatcaaagagcaagagataaacagtgctgtaaatgtttcaagaatggaacttttttaacttttgctcattgaacaccaaactttttctaaccccaaagaataaaaaaagaacaaataaataaaaacaaaatcttcaaaagctgcatacccatcaaagagcaggagatgctgcaaatgtttcaagaataaactttttcaactttctttccacaccaaactttttctaaccccaaagaattaaaaaagaacaaataaattaaaacaaaattatagaaaatattagataatatatatttagtacttttattttgaatcattgttattataagatatatagtatttgacatcttaacttatttgttattataatcttaacttattttgaataattattattaaataaaatatatatatatatatatatattatttacagtagatacatcttatcttattttctattataattgatttcatataaacagtgatcctattatcaggaaataaaaatcaggaaataaaaaggtgcatatccatcaacgagaaggagataaacagtgctgcaaatgtttctaagaatgaaactttttcaacttttgatcattccacttcaaactttttcctactccaaagaataaaaaaaaagaacaaataaataaaaacaaaatcttcaaaagctacatacccatcaaataacaggatatacacaatgctgcaaatgtttcaagaatgaaacttttttcaacttttgctcattccacatcaaacttttttctcccagtacaataaccttcacgtacattcagagagctgtgacatcctaatccaaaaataaacagagtaatgcttttgaaaagactcagaatccagggagtagcaaagacaccatttatggttctctctcttcttttttgcaaaatcaaatatagtgacctctaacactttatattaaagtagtgactctgcaatttttatttcctttaaaatttaaaactttctagaaaattacggatgttgaatagtcagatacttaggcaaaatattttgcttaatattttaggactaaaactgcttggaactaccccaattactagaatcggctttttcatcagatgaggacttttatttttttcttaattaggagtgtgttttaaaaaaattatcaaataagataagtcatatcacgtttcgtatcatatcatgaggcacgatttctatttttttttaaaatatatatttaaatattatgtcatgtaacacgatttctgaatgaaaatttaaaaaacaaatattttattttaaaaaaaatgaaatcgtatcttgacactatttatccctatttgataattaagagaagaaaaaaaagcctccattcgataaaaaagcctactagaatcaaccttttttttcacaaaataaaaataataattcggaaaatccaacgtgctgaatttagtacttcaactcttcaactgcacaacaaggtcggcaagttttgtcatgcgtatatcctaagttttgagtcacacaaggtgggttttacttcttcttcttttttttctttttttttttctctatagttaagagtttagttttctttgatattcaatttaatgatcattaaattgaaaaaaaaaatcattaaggaattaaaaaatagataaagatatagacccaagttgaatgtgtgccattggataagatccttgagattcagaaactcaaatcttgtaaagcggggaccaagggagggaaaatacaggccttgcaaagaggctaaggattaaagggttggttgtggtgaaagaatggaacaaacattttacatttcaatttgtttgggagggaacacaacacaaccatagataggacaatgccacatcttctttaaatataaaaaaagttcataaataaatcaatgtcacacaccaacttggttaaaggtccacaccatgtatgcacacagcacactcattgagttgtgttctgtgatgttaaacggaggcccctcgaatttctgggaggacccacaacatccccaagagttttattttatgatcttgttcatgcagttttggcacttcatttttatattcgttatatatttagtttgaccctacctcagggaggggtatcaaatgaaaggcaacaattccataatcttatcctttcgggtggtcaaactcaaaccttgatttgtggccaatgctcgatcgaagtggtttttgttaggcttaattgtgattttagttctcccctttttagtttatgtatgtatgattttagttttttaattttaatttttcatatttaatttttatagttttctaattgtttgaataggtttattattctaaattttcatttaatatttcatacaaatgtgatatgagtgtgatctattgttgatttgtacaagaaaaatatataaaataattaagtgaaaataaataaataaatagtttgtgtacaatttatttgttatttaaaaatttaatttttttgttttatataaatcaattatacgtcatacctttgaattgatacatttatgtaaattaatagatataattttgaggtaaagacacttaatttcaataattaaaaaactgaaagtgaataattaaaactaaagaaatcaaaatcccgtatccctaaaatatttgaccaaaagtataattaggttatttaggtactattaagatgatttttagttttgagtttcaatttttttttaaaattacaatcaatttttagttttagttttttaaaaaaataaatcaattcttaaaatataactagtttcaaataatttcatttaaaatatttcttatcatattaaaattaatttaagaatgtttttgtatggtggtgacaacaatgatgatgtcagtgatgataatgataccaggtcatggtggcagtaccaatagtggtgacggtggtggtggtggtagaggtgacattggtcgtggtggaagattggcaatgacaacatggtggtgatagtagtattggtggtgacaacaactataacgaaaatggtattagtggtagtgacaacgaaagtagtagtagaaatgtcaatggtgtcggtgatgatagcggtgttggtggtggcagtgagtggtggcgatgtggtggtggtggtggttgcagtgacgttgatgatggggtggggaccgtacaatgatggaggtagtgatggtggtagtaacaatgacgataagagtgacaaggacattgatgttggtggtagtggtggcggcaatgatgttggtgggatagtggtggtgttgaattgtgaaatttaaattggcaacaagtggtgatgatggtagtggttgcgacaacattggtggtgagggtggtggcgagatacgatgacaaatatggtagtggtggtggtgatgacaatgatagtagttatgatgatgacattgatagtgatggtggtaatgatgttggtgacgacgatggtgacaatgacaatgatgatggtgataatattgttagtgatcgtggtggtgatagtcaattatagtagtgacaacaatggtaataatggtggcggtgtcaatagcaatcaatgacaatagtgataatggtattgacaacaaaaagtgtcatttacaaatgtgaaaaatgtgtgttttgtttttaaattaaaaatcaaattcactaaacgtttttcttagtttaaaaaaagtgaaaaaatatataaaacatgtattaaaaatcattaccgctccaaagagacgcttaatttttatatagagatcaagtgttttacttgtcaaatataatcgtgagtttgttctacaaagtcgcctgaatattcttttcaattataacaagtttattttgtttagcttgatatatagtgcgttagctttgataatattctgtataatgttgttatccatttagctttctttatgggatggcataacttttatagatttaatggaagaaattgaacttatcgatgataatccaacataatatttgctcagtgggaatataatgggtcagagggatttataattgcggtggattggagagtgcttcaacaatttagtgatggaggagttgaataattgtttagagagaaatgagtggtgacttgcaaatactaagacactctagtaagctatatgtttaatgtgggtgtgtagaagcttaatgagggagagatctaatgatgttatatagtctaaatgtgacgaaatatatagagtagagagagaaaataaagagtggcttaattagcaatttaattgggaaatattttaattttcgggtgagttgtatcttcaaaacacaatttgtataattagagttgtgcaattataatatcccataatataaatttgtcaaaattatatgaatatcttgccatcttaattgctttaggtatttttttactattttcgttagaaagataaaggtagtagcagtagtcattattatctctctctgtaaagttgccatcactatatccttattgtctactttgtctacttttatttgaacgagtctttagtgattttttcgaagaccaaaaaagaaaaaagaaaaattctactactactttaacagcaatactaaaaatgtggttgcaaacaagatgagagacattaacggtacatacatattaatggttccgttacgtcacaacctttccctgccccaatgtttcaaacacacccagtcttcatacacaagctacgtatacctatggccaaccttgtctacttgactaaaatattttggaaaaatggtccaaaaacacgtgctgccagtgatgtataatgtgcgtgtagtgaacatttttaggattcaaataatgcacaaatgttcttactgatccaatcaagtttgtaggttcgtaaggaattttattcaaagaatttcgtgtattgtactttggcttttgatcacatggtccttttccagcgttgtcgtggtcatatttttcacaaccatgatagcaccgaataagtgaccaagcatgtcaacttaaaagagggaattatgaatgaaagaaattaaaatgcatgccaataaagggagagtgactctcttgaatgaatcttcttgtcatgatgtgtatatatgtcactaaggttacagctgaattgcacccatttttctggaataaatcccaagatctgcaaatggagcagttaattaggatgcaaattaattgtagctagactagaaaaccacaacacctaattgtgtgtttgggtttctcttttcttggattacagcttatcttgcaaaattaagcccaaaactgattaaaaccacgggagaggattaaaaaaaatctctatcacattcattttatatttcttgggtaatatattattggtgtgaagtatttattaaatttactggtgattaatttacatcaaaaatttgactgatcacttttagtgagatttctcttctcaattacaacttttttttttcataaactagaatcaatcggacaatgactttttggtacattcattttatattatttgatttctctaagttttttctctttagtatttgattttttttacgatggtgtggactatagatgagaatattttcggaccactttgggctgcataaaaaaacaggttaggagtttaaatttctacactattcatttttccaatacacccaacatgaacagtataataccaattttacccttctcataatccgtaagttgcataccaacatacaccattcgatttcatacggatcgacaatccgtaagagtcatacggatcgacaatccgtatgaggcatatggattgtcaatccatatgactcatacagatcgacaatccgcaagagtcatatggattgacaatccatatgcctcatacggattgttgatccgtaagagtcatatggattgacaatccatatgactcttgcagatcaacaatccgtatgagggtaaaattggaaataaaaaaatatgctgggtgtattagaaaaagagctagtgtagaaatggaccttctttcaactttagttaagttccaaatttgtcaaactttgtttatgaattatcataatacgaatggaccttctttaaactttgagaactgatgtagtttagtttagccccatttattctcaattttatttctcataggttaagtcaattataattagcataagattctgatatatattatcagattttaatcgaattcaaatcaaatctaaataaaacaatattatcaaattatccgtttctcataaaatctttcaaacatagccccttgaaggctttttgctttggtagtagaaaacaaatttaggaagaagatgaagaaaaaaaaaaagaaacaatgaataatatatgaaatttaggatttacagctactactgtgagaaagggctctggtgcatcatcataaagtggatagttgaactggtttcaccatatgtttttcgggttttttcttactatatgttgactggaatgggctccgaaatgcaaagtgtgggatgaatgcagttgaatctggaaggaagccttgtgatcttgctaaagaagctcttcatgaacaccctttaattccatttacacttagcaaagctataattgttggatacttgggaatattttctatctattggatattttgcttcttgagattctttgttcaactaaaggatactttggatatccgatagttttactacaataagtaagtattggatgataaacatttgaaatgtattgaattcgaagggattgataaattttgcatgactcaagtctttttgccataatttacctttgatctattatggggaaagaaactgatcgagattacaagtcacaacaatcttctccaacccttgttgagcagaaagaatgtaggacacataaagatttcagctgagcaagaggtaccacagaggaacgtaacatatgccaccaattaatggcaatatggcccaattattgcagaaaacaaattagaataacgataaggtgttttttgctcaatgattagaggtgattataaaatataacttggagaattatctgcactcgtagaaaaaaaatttggcctagacaacagtcagtcataaactgttgtcaacttgtgttgctctgacccatctaattttaatgtttccttttaatcataggctacaaaaaaaaaaagatgagattatttccctgcccaaatctccccaaaacacacgagaaatatttaaagatatataaaaaaatagcaattacaaagaaacatatagtcaatgatgccataatctagttcaaatagatcatattgatcagcttaaattaggatgaattgtatactgtaccaaaaaacactcccaatccacacctaggtaaataattaaaaaggagtgtttactggccttaataaacctccaatggtactttcaattaattaatttatctgtcaacttgctccctatattgcttcttcaagagatgctcgaatggtttcagggctcaacattttatttatgctaccaaaaacacataaaacaatggatatggtaaggcacatagttaaaatagtaaattcaaaatagagaacacgcttaaaccaaaggaacttacaatattagcaaatccccgctagagacctgcttctcagaaatccattctggtgctagttcttgcaacaaatttagctgctcttcaacttcacctgcgaatacaaaccagaaaattttggtgttcagaaaactataaaatagtaaatcatttttgcataaatccgtgtcttacttctgtcagcaatatcacatcgacttgagattatcttgcttacaagctctgctttagtgataaaattccgctgtcgaagtaacccacgaatcatgtcaaagagcttagggaggctagctacatttttcactggagtgtcaaatttcaatgaccttgcgcaaggtgaacgccgagctaacttgttcaaaaaactgatagagtggtcatctgggctcatacgacgtcttttgggtgaccgcaaggcaggtgtggcactcatcgacctaattggagttgaaatgtgatgaatgatcttgagagacccgtctttgttttccgcgtgtcctcagtggtttaaaaagtctggcttagtctactagtatataagtgtcctttacattaaatattatatattaaaaacaaattatctttttaaatagattagattttatattatattattatatttctttttttaaaacaaaacgtaacagcatttgctttttttataatctacaaacctacacataaattatcttttttatcttttatcttttttagtagattagattttatattatattattttatttctctttttaaaacaaacataacagtttttatttttttattatttacaaacttacacataaattatcttttttatattttatctttttaaatagattagattagattatattattttatttctctttgtaaaacaatataacaaattttacttttttataatttacaaacctacacacaaattatcttttttatattttatctttttagatagattagattttatattatattatattatttttctttttaaaagattgatttatatcattttaattttaatatatatatatacttttattttttttataaaatctattataatgtttcaaatcttctattttatttttatcttttaaatagattaagttatttagattttattttatttattttttaaaagattttccttctcctgcaatttcggaatctccaaacgtgtatcaatattgtttctttttttaaaaagcctaaacgtgtacatgttgaatgaattgatagcttatgccgtggagggttaagttcaattccctcagttgtagtttcttctgttttcctttatcttttcttttctccacttaaccaagaaaaatgatttttatagctcgagcatcattagcaagggaattaaattatgtcttcttcgaatttaatttaaaaacgcacacatatttaaaggtaaataaaaattagagaagcaaaattcactatgcttgtacacatttatacattttgaggaaaacattgaaacaactaagaacctttcatactggctaaatttgcttttaaaggtgtcaaacgaaattttgtggaaaaaaaaaacatgtttggttgttgtttcctggctcgatctgtttgccccctaaaggtacatttgactacgttatgttaagaattttatattaagttccgtttcaaatttacttttaaaataaaaatattcaaacaaataacatcataatgaaaaaacaatgctattttataatatatttttatacaaaaatgtgttccttgaatattttataaataaagaattacaagcgggagttaagagtaaaataggattacttcaaaaaaagaagagagtaaaataggattgaataaagtacaaatttgaagttcactaattgataaggattaaaatttggtgtagagataaaaacatctatttccaactggttaatctggtgacagattatttcccagtgataggaagtgaaagttgtttctaattaattccattaaatttgtgaagaaacacaagtaaatttctgtgtttcagcagtgctaagctagtgtgtgtgtgtgtgtatgagagggggttggaaaaaatggtcattgttttgatcaaacctgacatctttattacaccaaagccttaaagactttcgttagcaaagactcctctcattcgtcttttgcaaggttttacatgcttgaactcattgcttctcattttgtacatgtatcataatttttccatcttataggctgttgcaaaaatggcacaaaagcatgccaggtataaagaaaggagaaaaatatgaagaacgaacaaacttaacctctgttagaattttcctgatcaactaaatattcactaggaatgtcatcctgtggtctctttgcaaatgtatctccgtcatattctgcatcattctccgagttctcatcactgctccattttcttttcatgattttggggaccatgcgagttactttagtctccaacatttcatcattattatttttgcgttcaaaccgaacagcgctcacctttctggcatttccagctagtatctgcaccaaagacaaagaagctgcgtgttttctattccaaagacaaaggggatgggggaggctaaggagaagttctagattcagtttattacttcatacagattgccaaaaataaaaacattttaatttgaaaccctataaatgtggctcacacaagttaaaaaataaaggattatgcaaaatataattccaatctcgtgacaacatagaaccctacaaaatggaaaagctgtagaattgaaagggtacaatataccgagtcctctgacattgcttcactaaccatatgttcaaaaagcagaaatcaaagcacaaacttgttgaacaagctttttgaggaaaatcacattgacatctttagtgtagcttgagtaaccgtagagtaataaaactaaaaagtggtacatgcaacttatgcaagtatgctgtagttgtgttatgctatcattattcattatacttgctgatgtaatttatgtgcaaagtgctaaccatccattctcttcaactttggactgtatatgcaaaaatcaataggactaccttgagtggcaatttaagatagcaacagattgattacctcaagtttgaaaatctggttcttctccttctgatcctgctggtcagcattggactcattgttatcatcttcatcttccctttcaagaactactttgatgcactcacctgtccttggaatgtatccaaatgcttcacacacaaagcctgataccgtctcatattggtgaccctgaaatagatgtcacctacgtatcaggaggcctgaaattcttcatcagacttagcaatatgaattgtaagcaaaattaattcaaatgagatcattgtttgtctcttatattcttagaatatatgagtttgggtctaactcaacctcaaaaagctagcttaaggggtgagggttgtccctcacttatatactctatcttgactttatctttagttgacgtgggacttgggtttttttaaatacacctcctcgtcagcacttttgggtttggtgcgtggataacatggtggttgaccctttgaatgaaatcttggatatgctctgataccatcttagattcttagaatgtgagtttggacctaactcaaccccaaaagctagctcaagggatgagggttgtccttcacttatatactctatcttggctttatttttagtcgatgtgggacttggatttttcccaatgctgtcaactcaaatctaaaccccaggattcatgaaacccaattgttatcagcataaatttctccaaaaatataatgcagttgcacattttcccaatttagtccacaacttgtgtagaaataacaagcaagcataagaaatgtgttggcatgatgcctatttgaaatccaatggagtgaatgcctatttgagatgcaaagatgggtctagcctatttgagatgcaaagatgggtctacaaagactctgaagggcaaattcatgaacaacttaattattgctatactactaattgtgatcttggattttttccccttttaaggataaactgactagatagtgcaactaagaaagtcacactagctccagtcaaataagcagggtcatgagaagacaaatatgtcagttgcatgtaaaaaaagggctaaacctctggcatcttgatgttcaaatcttcagagagctgatcaatggaagtgtttgcatccacatcaaaaacaccctcagctcgcattactatgtagccagtttttttctgtatctcctcctgtagaccaggacagaatgtaaaaacgttctttaatgaaaaattagcaaacaaatagttatagtcatcaacaatcaaatgcataattaggtgataatcgctaaattcaaagtgcattaatgtcctactgctgttagagacaatgacttgaacagttaaacattaagagtaagcaatgtacactaaacttataggaatgataaaattgaacaaaatgtataattttgttttttcttcctggcagaacttgcactctgcctactgagggtatcctgacacgaataatatactaaatgaaattatttaacacaatcaaatctagagtgaccacttacaactcccaaaaacagatgtttttgctgcattttgtttatcaaaaaggttattattcagcatacaaatcattttaaatcagttacccagaaattatgtgtagaatactagcaacctcagaatcaaacctagcttaaattgtatactgatctctgttttgctaacaaagttgaattctatcttgacatcttcccagaacccttcttgcacttacatgcattattatcacgtttacacatcattactagttaccctctcatttactttaatttcgtactcacaaatttacactatgatgctttggagagtttgtatttgaacattgaatatggccaagaacaatttatttacttttatttatttttaccacacaagaattcgtagttatgaaataacatcataaacccatcattcctcaaataaacacggatccatctcaatagtttgacctctttacttctggaaattctgttaatttatataaagttcgttcatgttgtattacttgaaaaaacgtgaaattttttaactgctttgaattatagcaatctgaagccatgaaaatagatagcctaaaacacaagctggacttttagcaaagcaccactagtagccattaaacagtagatttgtcagcatctaaattgttgatagttataagacaataaaaataactgagaaaggtatacaaagattatgcagtcagcacaaataaatattccatacaaaactgttgttgaacaaagagtgaagaataaaaaggatcctttgtttcttttttttggtgaaacagagtaaagatgaaggaattcaatatatgcttcactttcagttatttaaaaatatatttaaaagaaacaaagtaaagattaagcacaagcatttacctttgagtcattttcatcaaagatttcaccaacaatttcctcaacaacgtcttcgagagttacaatctgttagatggaaatatcaataagacatctatatttgataaactgaaaattgttagaacttataagcagattacatggaatggatttcagaagagttggagagtctagttacaatctaataaagtgttcgaagaactaaacctctctctcgatttagctatcaataaaagagatttatgtctacacccagtctttgctaaatgcaacaggtgtgtggaagggtggaccataaaatcatttaaaaacgaactcagaatcgaagaaacactgccattagatattcaaacttaattgtaacaagaacaaggaaagataaaggcaagtggaagatgagaatagtgggtaaataagaacatttagtaaatcagaatagcctgccttgtaaccagaaagacttttggttttattacaatgattttggatctgtaaagtaagagaaaaaataattaaattatattagagcacaagacacagcgtatggtacaacatattacaagagtacagctgtagcacagttagacatgtataaaaactaatatttctacaggattatttatgaatattcttgcaatagttcatgatgacgggaatgatctcaatgttgattctgtttgcttttatttcaaattagcataaaaaagaggttgataaacaattggaaaagattttgaaagaaactaaaggaataggaatagcatgttcaaattgatatctttcatatacttctttttgggtcaatggttgtaattagcagtgtatatatcaccagtgaatcataaatttacagatttatattcacatttatgtcagacaaaaagatccgagttggttgtattctggactggtgtgcacatacccccacagttccaccatactcattaagaacaaccgccatgtgaaccttcctgattctgaactctctaagaagattccaaacagacattgaatctgcaaatcgtaataataatttattaacattctgcaccaagttaaaagatatagatgtattcctatcccagacaaatcaaccagtttaacaattcaatttcaataggaggagaaaatcagggattgtgatcattaagttcagtcaagacatagcaagtcagctgctgcttaattctttgtccatacattaaggaataattcatcataaaatactagcacatgtccgaaagccaaattgttgaacattcccctgctacccttccaattggtgtgtttgtattataagtttatgacagggaattaaagatattacgaaatttatcaatgaaaaaaagatatcttgatgaagcaaagatagcatattagcatgtttaaattttaaaagaaatgctgaattggtcagaatgacaattcagagcctccagaatctattctgaaaatgcactgaaatatatggagcaacacaatcaacacagcagagatgacaatgcaatgggtgaataaaaaacttgctttaatgcaccagcaatttagattaacaaaatgctaaatgtaaaaaaagtctgacaatagatctaatagagtattgcttcttttttgttgttcctcacctagcatagctggcccaattatagacatcaggtaaaataaataatgttttatatgtactgtggctacattgcattgcatgaatacgggtgaacataggtaatctcaagatgaatgatgaaaaaaattaccaggtacaaaataagcaggcttgtgagccatatctccaactgtagtactttctagcaactcacccttcaaaatcaaacagattataattctacagactatgagattgggggatataattaataagtaaagcacttgtaactcaataaacatgatgagtaaaatctcctaaccttttgaacataatccagcagatccattgcatatgcgatacccattatattatcaacacgttgctcaaaaacaggtactctaggaaacacgtcaagatctagttagcacattggaaaattaaaatcactgtaaatttgaaatcaggaaatcttcaaataccttgagtactgatgagtgacccacaagtgatgaaagtctaccaggcttgaacttgcatcaattgcaacaacatcaacaagaggtgtcataacctctctgacatgtgtgtcttttatctctaacacattttcaatcatatcctgtaatatattatatatatgtgagatgcttaaattttaacagacaaataaaaatggattaaaatatctataacaatcaatgaagataaggcttttgcaagtgttataaagaagcatgacaatagagtaacatacatcattattagaaaatatgatgggggctcatttccatatgaaaacttgaaaatttatttatgctaatttattgattccttttcactactggaatccgagacaaaaatatttacatacaacattttttagaacaaacctattgatgcttagaatttagaatcaaatgcaagtctcaagactcctttcccctagcttgcttgtattggaaaaaaagttttttattttttattttttataaaaaacgtaatacaatatttcatttcaaatgttatcaaaataaacaaaattattacttgttacctattatctttttccttacaacataaaaactcaaattgaattgtcgtaattttcgaagaaaacatcaatcaatgtttaattcaaatctcaattcaaaaatggattttgaattattaatttctatattttttccttaaaagattagttctagcggttttttcaaatattacaaagtataaacttaaaacggaccaataacgaaattcctagtgaaaaagaaactttttttaattcatatcactcaataataattttttttttcaaaaacattagttcatttttttaaaactaatttagcatttttattacaataaacaatattgatgttctgaaatctttataaaaaggaatttttattttctataaatgacagaaaaggctaaacattttgaagacaaatatataatgatattattagaaaattaaacccaatattcattacctgttcttcctcctctattgccccacttaattctgcacctcttagcatcaattttagctcatcttcagttacatatggctcactggtaaagtaagcaatgacttcagtgttgaatttcaaaaaaatcaacaagaatatgtccaacaaccattgcttcaacaaacggatgccactttccacatgatttacatactaagttggcaaaccacagttgctctttcaaaccagggttcaacaatacataaagggaaggaaaaaaaacagttactgccttgtgctacattattcgaccaaattagaaaccaaaaaacagaagaactgttatcaaccatctaccacatataaacccctcataattaataaaataatctcatttccccatttgttctctttatcataacatttaggaaaaactcaaccttaggaaatgaacagttatcatggagcatgggtgaaaataaaagagcaccatccttaagatgaaggaactaagatttagttagtatcagattaaaattagatttcacaaaacatctataaagaagcaaaagaaatagatataatatgataaaagaagattagtctctggcaatcttttcaacagaccttattccttttaggccaagcaatttcagcatccccattgaaagataagtaacaattcttcctacaggatacaacaccagggaaagccatgccactggcctgacctagaggcattaggatcaatatcaatatttgttacaaaagaagttgaggcagaaatatcatgtaaatatgaatgatatgtgaaaaaataaacaaaaatgactaatcagcagcaccatttctgttcccaaatattataaaagaacaggcaataaattaaaaacttaccacaaaccgagccacttctgtggcgttatgaacagctatgctttttggagtgatttcagtgagaagcaaaatggcaaccttgtttgattacaaagagaaaagagaaatcagatatatgaggaaaaaaattatataacttgcacaatgcactgttttgtgatcaatttgatgcaatctatctgattgaaaagataatttataatactattgtaaatcctataacaaaacaacgaaaaatataacataaaataagacaggtatatcctataatgttgtctaaacttctgtctatggacagcttttaattcaaataacagatcccccccccccccgcttctatcttactcaaaagttagctaaggcacctttttcacaaattggtgataaagctagcaagctttacatgtaaaattcttgttcccaacacatcaggagtttgcaagtttaatgggcagcatgttgatatactgaaagattcaatgttccaaatgaataataatcaagtggcctagtgcatctgaattttagataatcaaatcaatgcataagccctttaagcatcttttgatgtcctagaaacagtagattttttttaacatttgagcaagaaaatcaaaacatacagtcatcactcctgttgctgcactgacaccagcttcaccaaacatagcagttgctgcttcagtgaccagagcagttgccccaatattgaccaccctgcatacaacaaaatactagcatgagaaacattctaaactgaaaaaaaataggacgtttttcaataataagatcaatgccaggagaatacgttgtgccaataagtattgttgtaaggaaccgagtaacatcacttcggagtagtctgaagacgccattttcagactccttttcggccaactcacgaaccttacacattgtcatcaacagatattagaattcaatgttcaaactttaatcagctaaattaatcatagtgaataacaaatctgatgtgcaaaaatctgcaagcatgtcaaaagaacaaaaaacatttttgaaaagaaaaggaaatataatagactagtagttgatccttaaatcaacagcacttaatttccttactaacatatacatcagttatgaaatccctaacttttagtcattcataaattctgcataattagcacaagaaatcttggtgttgcactcaggtagatggcagatgaatttctggtcagtatgatctcatgcaagatccaaacttcatttcttcaaaaatgagaaactttcagcaattggatatcaaaacaaatttcaccgtcagcaatgtccccatccaatcaaggctggcaacaatcctttggtcaacttccatataattatttaataggtctatactgaataatggcggtacaaaaaagagtttttgtttcctaggcatagctcctactttcatgtaacataaattatcattcagaaaaaggaggataacataaacaagatagataccttccaaggccaaagtgtagtgattgaagtctctgccatcgagaaaaaagctgaaaggcccaaaagcactgccaacaccaaaccttgctccttaaatatacaaagaacttgcaacactttaggccatgtattcctaagcaaaagaatgctctgtccaaaaacaccatatcctgcattcgcaaccccttcaacggcaaaaactcgtgaacatccaaacaccaataccccacaaacagttgcagccaggatgactcccctctttaacaattcctgtataaagttcaaattggctttggaaacggcatttttatcgctcaaacaatcgctgcaactacctaaacacctcaaccgagttctatctagtaacttggcatctgctccaaaacttgaagcctgaagcattgtaaaagtagatggagcaacacaattgggcacaaagggaaatgggtatctagtggttctacccaaaactttgattggtaagctctttcgccgattttcatgcgcagggcaaaacaatctggaactggaggtgaacacttggtgactgagaacccaagattcgagtgccataatcactcataacagaacaaaaacacccaccaattcaaaatcaaaatttgatgcaaagaactgtaaatgaactcaattaaactgagaaagcagttgtattttgcttagtaatcaaatgggtatcacagagtggtaaaagaataggttgtgttatgcaacacaggaaggggcacatcaaaaaagaaaagaaaaaaaacgtatatgcaccaaataatttatattttggggtgtctgggaatcaaaaattgcaaatgtgaaacggagaattggagtaaaattagggttttgaagggaatcgtggaaactggaagaggtggcgcgtgcattggtaggacttgctcgatcctacttgccagatcccaggttcggcgcaacaagtgggttgtattttattttcaattttatattttatattcaactatttcaatttttttcttaaatatattttaggtggatcataaattagtgaattttattttttgatttttaattaaatttttttatgaatacctaatcaaattattattattattatgttttaattttttaatatatctatttttattcttaaaatatataaatcatttattataaatttttctataaaatattttgcaaaattaccaataaattaggctttaatgtttctccttcaattttcattaacctattgtttgtttaaggcgaaataggatacaacgaattaaggagaaaatggaagttattaaccttctatgcttgtttatcatttttgtttcttttagaagatgtttcttcatcattaaataaaaaggaagtaaagaactttttttggatcctacgagaaaattgtttccatccctagagataaaattggttcatatgtaggcatgaaacttttttaaaaataaataaataaattttataacaattttttttaaagttattttatagttagattcacttgtaacattcatccaaacaacatatcttttatatcctattttgctttttattttttccttgttatttttctctctctatttaactcctaatacaaacaatgaataaaggtgataatataggttaggtatcaacatgatagaactaatttgatgaaatgtggacttgtgctttaaactttgatgaaatgtggactcataattcaacttacctaaactctttaataaaaaaaaagtaactagtaatttataatattgatatttcatattaatattttataatctaaacaaaataataataaacagtaaagtatatagagattgaaaaaaccaattctatatttttatatagaaatataagttttctagaaacataaaattcaatgtgtagataatattctatatttaaactttgttttcttaatagcattccattttataacatttgatttttatttgatttgtgttatttttcctacaaaatagcaagttcttccgatataaacatgtgtgacctaaaaatgcatttcaaaggaagaacgagggagagggaccaatgagatttgagagtgttcaccttataaaatgtgttggcatcgttaaaaacgtcagtataaatgatcatttatgaaatattatttgctgttaataaaaataaacatgttaacgaaataattaatgagattggtatcattcacacaaagtaaatattcataaacaaaatgggatcaattaattaacatactttattaagcattcatttagtaaataaatgaaaaattactgttaagtaaaatttaaatttatataacagagatgactttaaacctacatttacaatataatttttttatataatcatctaatcacaatttattatatatataaatttattaattttaaaaataattattaaaaataattaagacgatactttataattaaattacaacataaatcgtgaatacacattcaactattttaatatatgtacactgagcacaaacttgctagatttatatatcttagaaatagttttacaaattcacgacaataaaaacagaggaaaagaaaacgcattaactatgacagcagcttgagctgatttattcttccatgagtcttatacaacgtgttccttttcaccttctgattaagttaaggtccaacctttctcacaatccattgaggctttcctattaacaacacaaagcatcccatgcccactccaaataccattccacatccatatcctatggccactggttgccaaccaaatccaaatttctcttctctccaaagggtctgtgaaggtggagaattttgttcagggtccttactgcatttccttgacaatgggactccacataaccccaagtttccctcataggaatcatttgaaaaagtattgaactgttttccttgaggtatttctcccacaagatagttatgggaaagattaaggaaggagagaaagttcagattggttaattctgtaggtatcctaccattgagcatatttgaagagagatccaatgattccaagtttgtcaaatttcccatggattggggaataagaccactaagtctgttatgggaaaggttgagccctttgagtgcatgaagctctccaataacatttggaatctctccttcaaatttgtttcctgataaatcaatgcttacaaagtttgttggaatttttgtaagtggcatactcatgcctttcattgttacagtcacagacgaagcgtatgttccaagactaaattgcgtttgcatgtattgctgtgaactgctatccacttcatcttgaatgatattcttcatggcttcaaaattttgtatgtaggcttttggtattgggccgctgaagttgttggatgagatatcaaaaacaattaaactgggaaatccatggttggccttaaaactggcaatgagaccgtgaaacttgttggcccgcaaaaccaatactttcaaatgtggtagtttttgaagccaacggggaaatttatcctctatttgattgttgccaagatttaaaacctccagtagtgtgcagttggacaaagattctggcaaaataccttctaattggttatcattgagattcagcgtacttagcctgttgttccttgaaaaagtacttggcaaagtgccataaagtttgttcatttgaagattcaaaacttgaagatgtggtaagttcacgaggcattgtggaataatgcctgttaacttgttgtgatgcaagtcgagagcctccattgaacttgcgttgcaaattgagtaagagatgctgccagtgagtaagttgaaacttagatctaggattgtgagttggtaattccttgagaattggtccattggtgttgtcaacatgttatgggataggatcaaagcagataaagaatccattttgtgcaaccaactaggcactgttccattcaatttgttgttggccagattcaggattttcaaaattgggacttttcctgataattttggaaattctgttaagctcataaaagagaagtccagttgcagtaagctggagaaactataattggcacttgattcaaagttgagggataattgacttaactgcgaaagataaagacttttcagattttgaaagttggagaagagtgaaaaattgacaggaccactgaagttgtttgatgataaacataagtaagtaaggtttacaagactgaaaattgattctggaatattgccctgtagcttgttgtagcacaaaaatagagaccgcaaggaatatgatgagattgcaggtatatgccctgtgaactgattattatctagatataaatacatcaacgatggcaaagagaaacaccaagaaggaatggtcccattcagtaagttgttagtgaacactaactcagttaggtttgaaaaccctgttattttgttgggcagaggtccctctaatctgttaaatgaaagatccaagtaaatgagatgttgaagatttgaaagtgttgatggcagcttaccctgtatattattattcctcaaattcaatacttcaaatctgtttgactggtgaaagacatttgggatttgaccagtgagatgattaccatagagatacagaaaagttagacgtggaagggctaagagtaagggtgggattgaaccgttgagtttgttaaatgagagatccaggaaagtaagatgtataaggttagagaaagaaggagggattggcccttggaattcattagatgagatctgtaagatactgagagaagttgtgctacaactcaagttcggaagttggccatgaaggtcaaaattacctgatagatacaagtgttgcagatttggcaaacagagaatgtcatctgccaactttccctttaatccagttcctctaagacttagagtgatcaaagaggaagacaaattgagtggcctcattgaagttgatgacaaatctgtatgattcaaaacaagctcccttaaaactgttgcattttggagcagcctcttccaagtgctttcactccactttaatagaaactgataattaagtggaagagagagatcaagtgattgtaatttggaaaggtgtgagatttgggaaggaatttcacctctaaagtaagtattagacaagtttaggtgcgtgaggctcacaaatccaccaaagagagatgacaagggagatggatagaagtcattgttagcgaggttgagtgattggagatgagaaagatgaaaaagggtactgttcggatggatttcaccataaagcccactgcagctgaggtcgaggccggtcacgtgaccggagatggggtggcaggtgactccaagccaagagcagcaatctgttccattttcccatgttgttgtcttcaggttagtaacagggcaatcataagcattataataataagttgtattaatgggaaaggaggccttgaagtgaagcaaggcaaaactgtcatggggatggcataaggaatgggagaatgaaaaatgaaacagcaacaaatgccaacacacaacaaacaaccaccccatccccatgtatgattccattctaacttgtgtgcaactccaaagtgttcacacagatttactatgaaggaaaatatacatgataaagaatgaaagattaatatttatagccaaattaacaaatttagatgtggtttatgtagctaaattaaactttgattgcggtcctagcatcaggacttcaagagcccattcctcacgcaatgtcgcaaacaaacaaaattcattttgtaaccctacaataacaacattccggtagaccccagtatttccattctttgattttttatattgaatatctttgtttttctctctcttgattcttagacatgtcaactagaacttgattcagatagagcacattttgtaaaccttgagtgggatgatctctataactaacgagaagttttactagtaacagtagtttaatggaattgagtattaaataagataactccaataagtaacaaataaaccataatattcatatcatcatttccaattacatatgcatgtaaaaatatgtttcctggatcgatcattggcggggaaatgtgccttttcaattttcgagagtatggattgaattggtctctaacgtttaagcatgatttttttttaagtaaccatggtgacttcacccacttataatttcttcttcggccttcaaaagggaggaaagtatgacgaaaccttttttggtctcaaacaggcttaataacaaataaattgtgccactgttaccgaggtaacaaatcagacaccaagagaggcaaaaaaagattggtccacttggcagtcagggcggatccagaaaaaaaaaaaaaaagtaagggggcactagtggtgagagttcgaggacagccagaaattttttttttaaagaaaattaaaggaacaaaccattataataaaactgtgaaaaatgtacaattcaaaagagaaaaaattgacaaaattagcatataatcggtgcttaaaaataacaagagtgtgaccactgcattcataaaaattacaagcacacatacctacactcactcccctcttatttttcatcttttttattattctttttcttttcttttcaatttctcattttgtgcaaacatttaaactattttttattttattttattattataaaaaaattatctattcttgaaaatttaagagcggcagatccgtccatgttggcagctatgccataatcaaggttgatactaactagttaagtttaggttctcttaagctaaaattttctataaagaaaagaaaaataacttaaaataattgagctttttgcatatattaattttaacttgtgcaaaattttataaaagttcctccaaaaggtgaggtgaataaattgattttaatttatggaaaaaactcaattcattttactttctcaagtgtttatagaaaagtttatccaaacaagggacttataagtatgttaattgggaaacaaaaattcaccctgaccccatcccaggatgataaaactaaaccttactgataagaatgaaatctacctagaatttggacatctttacaaaaaaaatgttacagtaggtttcatgttagtgataagcagatttttcaaaattgatgttggactcagacactctgctgcaataagttgagcaaaaaaaaaatgacctacctctacagactaccaatgtatcttgggccatactactcaccaagtcctgagctgagtccaaagatatcataaatcacggtactgaaaagtatcatagttcaattaacagctttgattttggtagatcatttccattttccaacatatttgtcttcatataccagttttattttctataacagctttgattgtgaaccacttttgacatatctgtatatacgccaaatcatctcattaaatttgtcaaggactattcaaatggaataaaatttctaccccttctgcactgctaattagaagttgttgccgtcattaaaactcttccacatatagatacaagcatgacttcgtttcccatttcgcttgaatacgtatctccaaattaatttgcttcccatcatcttaataattcgatgtgatgcatggtaggacaatagggctaaagaagttaacaattcctatttgtcttcatatatcagttttatattctatagcaacttggattgtgatccactttggacatttctgtatatacgtcaattcatcccattaaatttgtcaagaactattcaaatggaaaaaggttctaacccttctgcactgctaatgagaagtcattgccgtcagtaataattcgttgtgatggtaagacatttggctaaacaagttaacaattcctatttgtaatttatgcccattgaatgtttactttagtaatagaatttatgtaatttgattttatagaacttacatatataagaggtagatatatatcaataagttttgaaactaagatcacatattgtatagcagcctggcaccatatatctacttaattagttctgaacttaatttcatcatttagtttgcatggagtatcaaatttctaccccattcattacgcacgctgatgctatcacttacattgccttggaagtcattgtaggcaaagatgggacaaaggtaaaatgactgctttgattttattgatctatgagatttagagcttttatatcctcaattaactggcaattattatgtctaaaaaacatctttttctactccatctaaaacccaattaaggttgttgccagaaccactagtggagttgacttggaagtcaatgccctaaataatgggacttgggtttgattttgttgggttacactcagaaaacaaatagttgtgtagaagaaggaagacagaatgataaagcttgtagaatgtttattgattcattttgtttatttcacataagcactctatcttatacagattgtacatcacaaagttagttaataactagctaaccaactctatgtaactaacaaaactaacctatttgaactaactaactaacaccctcctttaattcaaagaggtaaaactcttaattcctttcatagcttctcaaatcgctcaactttcactgctttagtgagcacatcaacaatttgcaattctattggacaatacacgatttcaatcatccccttattcacctgctccctcagaaaatgaaattttgtttcaatatgtttactcctaccatgagaaatcgggttctttgccatattatagcatacttgttatcaactaacaactgcattggcttcttcgcttcattaccattgcttttcttttataaaaaaattgatagctgtagaatagttgcgaagttgggtatgttcttttttttttttttttttttttttttttttgtggttaaagaagtagaaggtgacgtgcaattgtgatcgaacattaaaatttcaattttctataatcgtctacattaaatattaatgtatccacacaaaaaatcaggcaccacattgtcaaccctcactttgttcaacagcggagcaggttgaatggatgatgttcagcagttctctgattggctatctacatggttgaatggatctgattgtgaagtgtagaaatatatgcgcaacagagataaaggaaagaagaattaacatacagattttaagtagaaaatcctttcagaaaaaaaatcacgagcaaatgagaaacaatttactatgttgaaaaaaaaaggtacaagagaacgcatacaagcggttaggttacagcagcatatatattttgtaactgctaatgtaaaaccttatcacaataaaggtccatacagcagggatggctgctaccactacagacccccgaaaatttctcaaaatatttttcaccaaaaattcgggtcaccaactctaacatgaagaaatcattggctatttgattgagagtagattttggacagtggagcacgttaattattgcaaaagcagatatatactgtttcagtctttaaagtggcgcatgcatgattttgaccaataatctttagaagtttccaccccaagatgtagttaaatgcaacattgatgccccagtgaaaaagaccaaattaaggtacaggatttggtataatttatctttcgagattggagaggccgaccggtgatgttttagcatccgcaaccagatgttgctgaggtacttaatttgtttgagatgggccattataacagctgcgcaggcattgttctctcatgtgatgtttgaaacagattgcaagaaactgcatgcatgatacatggcagaaacctagtaatagaaagagtcatagatactttgcatctttgaactttggtagatgaatgcagaattaattttagcccgaggactttattcatttaattccttatctcatacatactccacgataattttagtttcaattagttttaaaattttcttttatattattatttttatcttaaatctcatttacttgtaatttaaattttttttcttttaattttctttaaaaagtgtttttaattttcttcttgaatttacactacttgcttagtggttaatatttttagttaattatttaaattaattatatacagtatatgtattttttttataattttaaatttttttcttgttaaatttacacggaatactgcatgaaactattcccgcctttatttcttcttgttctcataattcataaatgctcacgggagaacaaatattatttaaaaactacgaattaccaaagtactaccaatcaagatcaacaaaccaaagtactaccaatatcagaggacctgattgatgtgtccaccagttattaactatttcattggttattcacatttctaattattctttaataaatttagaatcttactaagtaatacttttagagcattaataatagaactaaaatgaacaaatatttattgtgaaaatcatatgaaaatgtaaaaaagtcagtcataaacagtataattttatgtatcccataatttttttttttaatttcttaacccatactataaagacacagattactatttgtcacaaatttattagtatctcatgttatttggtaaatctaatattgaacttcccctaaatacagttgttttactattatagctggtaagttcccaatggaactactacgattgaggaaacataaataaatgaagcatttggcatcaaagaaacaaaatagattcaattttagatcccattctttcaatcctattactattttagtaggagcataaagttaagccgctatgattaagtaaatgttccaagaaaaagagaacttggtttccttcaaaatgctcataactcattttttggtaagtcacccctcccccatcacccatgttcgtatttctttaatttaaaatactttattactttttctccttttgtccttattatcttcttacattcaacttcaactatacaaaagtattcaatcaattctgctcaagttaacgttggctacttaaaattggtatcaatctcctgcttcaaaacgttaggttatcttggtacttaatttatcgattttcaaaattcaatagacctttaatcactgagatgaatctaaggtaagcaaagatatggacgtaactagatattggaatgcacagtttctctacatatctcgttatgcatccatacataattaaacacatatattaggtaacatagaatttatcagttaaataaagtacatttaataaatacaaacatactgtgactaccatatctgcaatatacgattccaacatgtgaatacttttaaaactaagcactaatctaaacttctgcatataagattggctgggaacctcctgctctagattttgcgagtgaggaagtaactggacaaacaaaagactgagttagttgttttcaatataaccacacaaaagggtatatggctaaggatatttaacatagctcattgctccatttaccttggcaaagagtttactccagaactgtctggcgcagtttttcttctcttgtgaggattaccttcgtcaaactcaaatgaatcatcatcatcagaagatgtggaagtagaattctgcatatcagataaatattttgttttgatttcttcaatcctttgtgcttctgtaaaaatgcttttgtgctggattgcatacgatgaacttggatgttcattttctgcaataatttgagaaatggctttctttccatgcaatccttttgatgtacacccatcaccatcatcatcatcatcatcatcatcatctaggtttatgatcttattttcccattccaatttgaaccctgcaggcacagaagagatatgttaaaacttacataaaatttatttttgttaacatgataattcaagcaaaagctaggagaataaagattagtagattctgtaatacaaatagaaactggttgttgcctcagcatttgatgaaaatccagcctcaagctcttcaagtgattaacaatgtatacttttatcaaattcatataatatgtatagaagggtatcatgtaatcttgtttgtatgggagaaacaagttatcttgcctgcttttatttgttctttcttttgttctcatcgaaagaaaattttatcaggggaaaaaagaaaaaaatcacaagagatggcttgcagttttctaagggaacaaaaatataataggactctccaaatcaaaccatgtgtctaacatcaaaggaagacaacaggaacaatactgtgttttacttgagataacaaaggaaaattgaccttaggcttcttttcacaagtagacactttaggctgaaaacgggtaatttggtgctataaagctccctgtgtgggggtccaaggaagtgtctgacttacagtgtggatcaattgtgggcagccttaccttgcatttgcaagtagacaccttaggctattctccaaattaataaattcattgtgtaaacatggtcaatcaaacttgaaacttatggggaactgtgacattttcacttcaaaaacaagattggatgctgtgaggagtgtatgttcttaaattgtgtctaattataattgcaaactgtgatgagcttttaagtattttaatgtgatctggttcagtcaccaattcatccaatttgagcaataattagtggccccaccggctcaattaagttactaaaacatggctcttgaccacagccattaccaataaataatcatcatggttcaaggctcagctaccaagaaatatgaacaaaatgcattataaaaatgcaatttgttcatatttcttggtagctgggccttgaaccatacctgatgcaagcagaattccatacctgatgcacctagagcatccttattccctttgctacgagactgagcatcaattgagtgacgagtatcttcattcctttggaaaggaacatggcccccagtgtcattttcaagctcgtagtcaccaacctcttcaactttgacagtaattccttcagcttttaagcaatctaacaaagactgtgtagcatcttccaacttcacaatcctgacaccgatttccgcaaatttactctctaaattctccatcaatgtctcaagtctgcacttctcatctgccaatttaccattttcggtcctcaacccctctatggcggtcaatttaatcttgattgcttccttcaattcactgttctttgtgctaagggcatcaagagcactcttctccccaatcttctccccctccaaaacatgaatcttgctcctaagttcagccacatcatctagccattttttctttaattccttcagctcacagacttcacattctagagaaagattctttttccttaacctctctatgtctgtcaaattcttctttatcgattcctccaattcactgttctttgtgctaagggcatcaagaacactcttgtccccaaccttctcctcctccaacacactgatcttgctcctaagttcatctagccatttttcctttaagcccttcagctcacaattttcacgttgtaaagcgaggctcatttttcttaactcgtcaatcatgtttttttcaaccaaaccatttttcttcacttccttcaacaactgctcatagttttgctgtgctcttttccccttttcgcattgctcatctctatttttaagtttttcttcggcttcaatcctcttgagcctctccacctcgatcttctcccggagtggctcaatctccgccttaaatttggcgtccctgttcgccaattcttcctcaactttgtcaaaatcctccgtttgaaacgaaacacgcaaaaccgagacaagctgagaaatgctcatctctttgtagtttttctgggtggtggaagtggacataggcggagacctaggttcgagtttgagttggaaggccatgagaatctcaaaagtcgcaaactttgggggggaatgggcaaggaagaagcttgcgttacaattgcttgctacaagtaaagttcctgtgaaaacgaaaaaaagaaaaaatcagtggcagaatgagactttcttatcagtatcagagaatgaaggaacgtaagaagaagtgagatttgaacgtactacgctacgctttctatgtcacaatgataaaaaaaaaaaaaaaacacgttttttcaaggtagggagagtaagaagatgaagtgagtagcacaggaatagggaaggccttactgaacaaaaaccaaagccagttttgaagcctatgaaaataaaaaggatttgaatgagtaaagttttgtgtctgcatgtcaaataagaccaatacaccttttcagtttcggtaagctaaaaggacgcattcctaatgagtaaacacagtgtgtgtgttcacacccaattggaatgactaatatactcatgcatttggtcaaaaacaaaaaaataaatatatgatcatgcattaattcacattgcttttaatttgactttgactaatatttttatactcttcttttctgcatttcggtaagttccgtttttgtctttcattttcaaaggagtttatacctttttaagtgaaattaatgtgtatagaaaaaaaatacacgagattttagccctatatactactaggatttatcacttattgggtgatgatagttgttcttgaaacttcaaatattcattagtactaacacttacgtctccaaatatccattggtttggcggatgaggtgaaggagtggtgtgtaagtatgttaaattatagaatcctttctttactgattgtttatcaaggattactgattgtttatcaaggattactgataggactaatcttaggttagaggatgttgaataataataaatttgatttaggtatattggacttagttgttaaattgtttaatatctaaaaatattcaagaaatgttcaatctaaaatctagaataattcactctagatattttcataaaaatatctagaaaataattgtatctaaaaaccacaatcataaatatataagctaggagagtgtggagaattttagagaatgatttgtagccattagatgagaattgtattgacaaaatcctactcattgattaaggaggtgatattaatataaatatgaaagttcttcaccattttatatcaaccaatagataaaaagagttgtgtaataataaaatattctcttccttcaaatctttctaaaatttttattttctcaaatatcctctttccaatataggagtcgtggcaactggttaatcacaaatttgagaagagtttaacgttgtggaagcataaatatatttctcttgggagagggtttgtttgataagttccatcctatcatccatatgactatttttcctctccttttcctaaattcctacggtagtgtgcgctaaacttgttggcaaactagtttccaaggttatttttaatctcggaacaaaagttggagctggtctggaatatgggagtttggaggaatggcatatggtcttgggagtttttggtgaagagagccttttgagtgggagagggagatgtttttacaactaacaactcttttggaaactgtgtaggcgcataacaacattgttgattcttggatttagagagcaagccctttgggcacttaatctacaaattctgcatattcacaatgaacactagatggtggcttagaggccctgcacatcaccttagcagaggtatggcggataaatataccaaggaaagttgcatttttaatctggagagcattgagagataggcttcccaactaaagataactcgtggaagaggggaattatcacagatgaagctgagttgatgtgtccactctgtaatcaacaagtggaaaccatgcagcatatactcttaaaactgtgaagctgtgtttaattaaaatctggttagaatgtcacagttggatttcgccaggttttgctctagctttaccggaatcacttcaagatcatttttggctccactcgggcattggaaggtcttcagctgaatgcaatatatggatggttatatggagtgcagtaattttttgtgtctggaagaaaaggaataacacttgtttttaatatagattctgctcaaagttctgatatggtacaggatgttaacttctgtgtttggtcatggttgagatcattgacaccaggctttacttgctgttttgtccagtggagtagcaacaccatcacttgccttctttgtgcctaattggaatgctttggtgagttgggccgagggttatacactcgagatcaacattgtggtgttgtgttttgggttgcaatgggtaagactaaggtgcagagttttttgtaacagaagggatatgttatctggggtgggtataattttctgatatagaaatatgcagattccttgagatgttcaggctgttagcttgaggttaataaatattcctatgttagttgatattaatacagcttaacctcattgcttcaagttggatattctctttttgtaatatgttttttatttgggtaccactggtaccaagttaatgatatttgtttgctaatttaaaaaaacaactaatacgtatgtctcatctgctggggatttttttgtcttttatgtttaaaatatagcaaaagttagcatgatatcaaactaaactaatttttaaagtaaattattttacacaatggtcaaattatatgttctaaagatacgaatgatatagtataaaattatcttaattccaaatttagataataagattttaaatttaagtcaaccaatctctattaagtaatttttaagattatttttttaatttatttaaaactataagatctataggaaatatatagtacatagaaaatttaaaatttttagtcaaaattaaataaaatcaagtacaaatattaattattgactaaaatatttggtaactttgtaacatggtgcatatttatatgaaaatatatacacagagtttttcacaatctatctattaaatagagtatttcttttgacttcatatactttttgttttgtcttgtcgcaaagtaccaaaattgaaatttggatagtttttaaaagaaatactatatacaaatacaaaaataaataatatgtttattctataatatcataaaaattgaatattaccagaatattatattagttagaataggatcattttaaaatattactaattcaattagtcaaataaattatatataacaaattttattttttatctataaattattttatttcataatggagatacaaactttttccaatggtaaaaaatacatgtgcttcaaatcaaagtcaatctttaaatacatattttgaataaaatataatatcattaatattattatattatttacctaagagtgattctttgaaatgaagaaaaatacatgtgtttgaatttaaaaatattctcaaaatatagaaatttcaaaattttatattaattatttcttcaaattattttcttaatggtatctataattttaatgaaaatgatttttttaataaccaccataatgaattatgactttatataaactttcctttcaatattaagaattttgttgttttgaaaataactttatttgaccatcatccttaaaagaattagttttataatcatgcatttaaagatactttatcagatataaaaataaaatctacctagaaaatcatataaaaaaatatttcatattaaaatctgcaacaatttagatataaaaaatttcaaataggtgttattatgggtaatgcttaatgataagtacacaacaccctaataataataataagtacacaacacaaatttcaaatatttgactagcatagagttcttgactattgacttagtttgacaaacaaattctaatctatatggtgatatagattgagactagttagtttggctaacaaattgatgtagtcaacaatcaaatgaaatccatgctccattcacacacaagaaaaaaaaaaaaaaaaaagaaagaaatccatgctattataatgtttgagagcaacctcattttaataacacaatagttatggccttaacttgtagctgtgtggtaagtgataggaatcaactgcaaatcctgttttctttttactgtcaagccaaaggattcagtcatatcaagttcctcaggcctattcccttgagccattttccagtcaaaatggaaaagcaaatttgcaagtgagaattcaacattaaccatgccaagattgatgccagggcatatccttcttccagctccaaatggaataaactcaaaatcaccacctttgtaatcaaatgggctatcaaggaacctttcaggaataaatttctcagcatcaacccaatagttaggatccctcccaattgcccatgcattaacaatgattttgcttttggttggtatctcatacccattaatctcacatctctcactgcattcccttggaagcagcaatggagaaggtggatgtaaacgcaaagtttctttgataactgatctcaagtatttcagttcatgaatacttgtttcatccacatatccttttccatcaaagacccttcttacctcaatttgcactttctccatcaccctcgggttcttcactagttctgacattacccaaacaattattgttgatgaagagtcgcttccagcactgaaaatgtcctgacagaaatgttaaggtgttagtattacgtttctaatgagattaatcaataataaccagaatttatcatagaaagaaatttatcagtttaatttaatgtaagtcatagtttaagtgtgaataacttaaaaccggctcagttcaaaacattagatcaatattcattacataactccatataaattaaaatatgaagtgcacccaggacagctcttgatgactgatgaggtagtctactaaataactcagatttggaaattttggacggttttttatatgtaaaatattaaacaataagattgctttgatacactctttctaacgcactcctatcaagttcggatcctctctggcctgtttagcaacatgcagcctttttgacatactttctattactagttaaaatttattaaaaattgtaaaatcataaataaggctaataaataagaagtatgacctacaaatatgtaattttaataaatttcagtaaataaaaagtgtgttcaaaatattgtattagagaatttgtcattaacatttctcttgtaaaagatgttcaagatcaatataatcaatcctattttgactgcatcaaatcatcaattgagagaagaaaaaaatcatacctagaactatttgattggatataattatctttgccttttgcatagatttttaagaaacatactgaccaaaatggttgctttgacaacagtgtcagacagggggtgttggagttcaccattcttctgaagccttaaaagaacatccactagatcttcccctttttcttcaccaacagcctttgtgtccaaagttttttctctgtgatccctaacaatgttctcaagtatcctatccattcctcgatggatcttctcaattctagtcctaatcccagtaagaacttgtagaagtccaatggaaggatacaaatcagcaagagaaaaccctgtaactgtctcaatgacatccttcatatgctctatataagcctgttggtctttggactttttaccaaaagcaatccgtgatagtaacccatatgccaatgaactaatcttctcactgatattaattggtgacccttcactcaaagatatctctttgacaaaaattgacaactcttgttccctgattgatctgaaggactggacacgcttttgtgctagtagttccatggtgcaaatctttctcatctgcttcaaataagttccttgtgggctgaaggtcatgcccttagagccataagtgataacatcagcagtaagcacataaggcctattcgcaaagatgatatcatgtgtgttcatcacttcttttgccatttcgggcgaagataccactatgcagcaaagctcaccaagctgcatatgcatgagagaaccatattgacttgccaatcttgctaaggacctatgaggtagagttccaagatgatgtatgcttcctatgaggggtagcttccttggtcctggtggcaacttggagtttgaattcttggtctttgatctccaaagtgtgttgattagcatgaacactaagaggaagaaaggaaggattatagataaggaaatatgaagctccaaccccattcttataaatcaagattataaccttgaaaaagtatggtttggctgtgaagtaatgttgaggtttaaaccacaaattcacagcttggtgctgaaacgaggaaatatagctggtactggtgcggctgctgctggtttcttagcttatgagaaaatggactgatttttaattagaaattaacaaagataatggttagaaaagtcgtcgacaattaatatttcaaaaatggctgcaagcacgactcttggccatacgtttaattttcgatgctgaggtttatctatatagtcattagattagttcttcgaaatgaacagagattataatcttaattcttatgatactgtgtatatatatttaagataaatgataatttgtaatataatagtttaaaatataatcattagaaaaagatttatttacttacttcttgaattagtattattgaacttaattgcttggttgaataattttttgtaaacattaaattctgggttagtttttttataaaaaagttagaaagaaaatgattttaattaaattaattttgaactgttaagtataattaagatgcatgtacctatttaaattgatcttaactataaacttatcataaaacatgtttttaattaaaaaagtatgaaaaaataatttgtaaatactaaaacaaataggagcttcatcgattcaatcaatgattgatagtccttgataaataaattaatggaaaaaaacccatataatttgatcagaagtggtgtccatctgtgattccaatagaagtgacgttgaagaagttgaagctcttgctatttagatgggtctcatagatctattctttgaatttgatagcaaactggtggtggacaaaatgattacttcatcagcttatgcttctcaagagtgtcgagccttattggatgttggttttgtcagcctaatgatgttggcacgtgtcttgttgttggggctctatatagggagctcatgataatgatataaaaaatttaattataattataaaaatacttttattataattataatgcacaaaataagttataaaaatgtagtaaatattaaaaaattcatttttttatttgagtttaaactagtatttgacccgtgcgcatacacatacattagttatacatttaaatgcacattatcatgttatgtaaaattggaggtgaaaaaaagaaaatataataaaattcataaatgtgaaatataacatgcaaaccttgtaacataagtttataatgttaattacaaaacatatgaacatcaaatagatgtagttaaggaacacaaaaaataaaattagagtttttaattaggttggttatacattttaaaagtgtgtaatgtaaatattcatttgtaaaaatcatatgtagtaagattcgataatgtcaaatataatgtactgaaacattgatagataaattgataatgttaattacaaaacataacatcatcatataaatatatttaatagaaaaaataataaagttagggttcaaaactttagttgagttaaattagaaaagttacaattaatcaaagatttaatttatttgttagcaatatttaaaatttcttatataatactcatgcatatatcaaatggcaaattattttagaatttatcataaataaataaatgttgaatgaccaaatttttaaaattaagttttactttaattaaacattcaattgaaataccattatttatacaatactctatttttgtaaataatgttagttttcaaaatatttataaattaacattaaaatgttattaattgaaagaaatgatctactaaaacaataacagaagttctaatagtattgcattaaaaaaagttctgatggtatttacactctttttttataaaaaaaaaaaaaacaaagataatggtttttacactctaaatctcgctcaaacaataactttattatacttttgttctttccactatgttaatttgatgaatttaatctccatttttttcacaaatttaatctcgctcaaacaataatttttttcacaaatataaaaccactctattgtcaaaagactcaaaactaactgtcaacacagattgtggcatagtatttcaactgtacataaaacccctcccttacacagattgattcctaaagttgtcaacttgctagcaagtacgcctgtcgaaattgtcaatttactaacaaagttaatctcattatagaccaatttatatttatataaagcttgaaaagtcaaaacaaaacaagtaacatctttcatcaatcaaattgtatatatttgatgttttgttaagcattttctagtcaaaatccaaccagatgaagaaatttgaggaataacttgcaacaatctaattaacttcaaatattttttggtaatgaaagccaatgttgtgaaagtacaataactaaatatcacagccattgcactaatcaagtttcatactcaaacaccaaatattttttggaacgattgttactcttccataacatctccctcaattacttccaccttctccttcaacggggtaatctttgttaagaggacctctgcaatggagaatgtatattagtacagtatgtaaaataatttctataaaggaattttctccatactgtttaatcagctagaattaaaaaaaaaaaaaaaaaggaaacaggagatatgggcagacacagaaagggcaggccattaaaggtttaattattttctcaagcaggaacttcaaaaggaaggagatatggagtagatttgttataggaacttcaaaaggaaagagataatcatatttgtgtttcatggattgggtctttaagacccaaaactcatccacacagtaacacacaaccctcatttaatagagcactcatctcaacccttagttaataagtactcatctaacatattctttaatcagaaaaacatgaacgtcaaattgacaactctgtcaaacgtcaattatttaatcatatagcaacaagttgaaaggggcttgtctaacttgagctattatctaagtttgatacttcacaacaccaaattcccaagattatcatatttgtcacaaggtgagatacaatgtcatgctagactacaaactattgacggttgacacacaatactaagcaaaacaatatagttttattgcagtctcaagtatattaaattagcaaaaatcgcaactaacctgtctttttggggaaatcaaagccttttggattgacataggtacgaggatttggtagaaggtggttcctgagatattccttgtgtccctgtgaagcattaatgaagaaattgtgcagaaattagagttagatgactctcatcaaagaacaacctgtacaattgatcatcaaagcactcaccttggttatcacacaaacatcaacattacttccacttcctaggtcattaaatattccagcgcatatcgcctcaacaactatcttaatgccttcatccctctacaccacatcataatgtttatatcaaattaaaatctctatcaaaatgcagcatttcaacatgataaaaagttacaaacaccaccagtatcaattataacaaatataatgcacaatttttacatttagatttgaaattgacatatttgcttcatattcttccattgaaattattataaattgaacagctttgacagaatattatcaaatcagtgttatcaatggtggaaggcaagaattctgccatataagcatgccattgtggtctatggcacagccatggcaggcctcccttcacaaatagtaggcagttagcaaaacccatcgcgccatggcacctccatttaacaacaatgtatcaaatgcactcctctaagggtgaatttcctcaaaaatactctaacgtagagctttactaacgtatgaggctgtgagccttaaattcttacttacactcaaactttccttgtacttggactcaaatacagacattgcagcaagtgaacctgatcccattgtagcaaatgggagggtgtcagttgacccatgaggataaatctgcaaaacaagtcatgagaaattgagctataggcatccaaaacaaggaaacttgagcataaaagaaaagttttaagcaatgaactaacagtatgcaaatgaggtccagtgatatcaaccccaccaagcaccaaagcagctgagacatgcccttgataactgcacaatagtttaaaagagtcagattcagtggttgatacagagagaaaattaaattgatgagaaaattctgaaactcaacttgaaaaggtgtttcttaagaagggtcagtgctgtaacaactcttgattctcgaccagtatggtagcgatgtaattgcagctgtgagctaaccatgtctacagtaaataacaaacttctcattttcaacaattttactacatcaataataacaagagcaaaagctaaagttgtggtccatatgcaactatccataaggcataacgtaaaaatgtgtaacaactaacaagaaaaatgcattttaaacaaatacctgttacagcctctgtatcagcagctgtgcctgctccacagcaatatatgttgggtgccatataatgaattttctcacagtttttatcagccactataggtccttcagttgccctagtatcagcaccaagaatgacaccatcctgaggcagatttattaagtgggaaagttcagctttagattacaatatacaaattaaacattaaaaataaatatgcaatcaacatatgaagtcataaaactttgtttggaatagataatattgccatgaaaagtctcattaacagcacaaatacaaatgttacaattcccagttagtggactgtttcacaagaaagcagtctgtactctgtagacggagcaacttggtttcaaatttatgatacaaaatcttcatattaaacctcagctgtaacattagaatcacaaccgcgttgattgttccccagctagatggaacaatgtagacaagaaaaaagcttaaccatgctcaatatccaccgttgaggtcaatatgattagcagttactgaagtagccacttatatattacaaagtttataaatcaatgcaggagctttatgactttatttcttgccaattgtttctaaagtaaaatcattcatatactttagaacaaaaattaacattttacttaaaatatttttagaataaaaaatcaatcaaatttctcagagaaaagagagagtagtaatagactaatattactactttacagatagaaattgagttcaaaaacagtcacgtagattttcaaaacatacaagtcaagatatccagagccagactaggcttcccatattctcttgctataaaacaatgcacaatttcagaaccaactatttccctaacataaaaataaataaataaaaattcaacattcgcaacctacgcaaatataacacccaaaacttatagcatttacataaggtgaatttccttcacccgcacagcgaaacctcacaaggccagacatctatctaccaaaacaaattatctaattcattcgagatgccaagcagaaccataacttcacatcatgtgtctggatccattattccattggaacccactcacaattacggtataaaaaaatcaaaataaagaagcaaataaaaaagagtgaagataaacacgtagaaaaacaaataaaaacccagcgatgtttaaatatataataataagaaaaaattaggttaactagacatgaaaagagcgagggaatgatttcagacctggaaaactaaaccgacaatagtggtcccagttttgagaaaggttggggctttgaggcccttgttttgaagcattgcgtttcttcggcatagatcaaaactgaagccacccttgggaggaagatccaacgacggagacatattcaatggaccctgcaaaacatatagaaagagaagtttgacggtgggatcggaaagaaagggagctccaaaaacctagctagggttttgaatacataatgagaagagagaaagagaaagtaggataattaaaaataataataaaacgatacgaaacgaaagtcacagtgacagagaagggaggttgacgttgaagttcttgatcttgagccccgtatctcactttgaagtttgaaggaagcaaagttcttcgaatttgggtcgcttctttcttcgatacaaatgattatgaatccccctcaattacttgcacaatgggtcacgtgacaagtttatacaaattgcaaatcactccttgtatattttgcaagaaaatatctcaagtctcaacaaataattattttaaagtgctaaattcataaataaataaatagaaaactgatcacataaaaaatagttaaattgacccgcaggtctcatctttttttactaaatttttaactaggtctctgattttttttttcttcattagattcatattagtaaatatatttttttacaaataattgataaaaattaaacgttatttttaatagttgatcattacttaataataaaattatatattttacgccgtatcaaattgtgttgctatttgtctaattagaaatattttaaagtcaaacataaaataaatttaagaaaataagggaaaaaaaaacataaacaagttttaaaaaatagttttacttggttcaaattggatattacattcaaatcaaattgaatgagttgtatgtttagttcaaatgattttttatgtaaaactaaattaaattgcatcacaaataagactgtttaaaactattgcaaatctctatatcaatctattaaaatgaaaactcataaaatcaaaaacaaaagaaaaatattatatttatatcccttatatttaatagatatttaacattatctaatattttttaaaacttttataagtaaatgttagcaaaaaaaaacttttataagtgatataagatgtatttgttttataaaaagtttgtaatagagatgaaaatagattacaccaaatatgttttgataggtctaaaagtgacttttattacataaacaaagtctgaatctaacatatttatttattagcagcattttttaagatctagtctaatcttcgtgtttaaaagtatattttatgataagacttgtaaaaaaagaattataagcttgttagcctaagtagacctattctacccatgaaatatatatgggttaaagaaaaaaaatattttaaaaaaaaaatcctcatttcttatacatttttatttatttatttatattattcgcgtcattttatatacatttgttttctttccttccacttaagtatacaatcaaacaacctataaaaccatccattttccttttattttttcctaaataaatatactttttgaagaaataccatagtaggtataaaatcatattttctgaaaacagtgcacatttggttaataacataaacatgaaggatcttgtagcattgtgtaccaattgttcatactagtgttcgtagctgtgattaagttaatacaagaatattcatattatcttaaccatttgtatttggcctgcaacattcagaatttctattagccattttgttgcttgtttatcatgttccgtcatgaaattggctttcataggatgacaagctttttatgcagtacattcccctaaagactagcagttagaaactttggacttccaatgcggcgagtctgtaccccaaccatgtccatctgttacttgtccaaataccatgcacttgcatacaccatcaaatccttttaccaaacatagtgaaagccaaaattgccccaggaagggactaagtcaaaattgtgttacttcaaaaaaattgaaaaatttgtgttaattttatatccgtttcagtgttgttcatatatcttccttcaaattttggatgcttagcaatttaataacttccccacaagaacttcatctttaaaattagaacaacatgaaataagcttgtgcattgtctattagtctatgcttttaatttgaagagcttctgctcttgcttaagaggacatgttagattacaaaaactatgataaaccaacacataaaagtagaggtctgaaagagtaattcctttgttctacctctgaaaaaatacctcagaccacgataactagaaataaaaacaacttagcagggataagaatttgatgttgcctaagctcttgcaaagatggtttgatgttgatgattgaaagaactggcttttcttattcttataacacccagtcttggacttttatattaaaaaaaatggaaatttgaacaatcataaaattataaattccaaacgatcgagtgctcaaactgagaacagcactggatgcacgactgaaaagcctatcagcactacccttattaacattaaggtgcataccatccaatatatatcttcatggcctacaatctacattaattttattaaactacagcccagtgagactaccactcacacattaatctccaacaaggaaaagcaacataacaagaagaagaatagataatgaaagcaatgaaaaccaaaattcatatacagcaacttacaacaacacaatcatgcatacacagtggcggacgcacacgggggcctgggtccccccaaaaataaaaaaaaccatcagggtttgaatggcagaagatagttgaggactgggatgattggcaaaagtggataagtattcgaggtggtattggtgttccttcaaataagagttgggagttatggtggaatgaggaacaggagcatctgcagcacactggatttctggggtggatatgtgagattatacttgacctgcgtttctttgtctatcaatttgaattggaccccccatgctcaaaatcctgggtccgtcactgtgcatacatacacaaatacagcttctgtacatacccaacaataacatcatgtaatcaaggggtcctgttaggctgttactattattttcgcttttattattgttagcaggagaacatgaattctctattactcaaacaagaacagcaccagtagccaccagagttggcctaatggttaagagatttgagtagtctacatgaagtcctaggttcaaatctcattgctgctattgtacacactcaaatagtaaaaaagaacagccccaatcaaaaatcaaaatcacttcacctaaaatcctaaacacaaaactccaaatcatacatgcttgaggattattacattacactacactctaaagtctaaacacaataatcataaaagtcagcaatatgggaagtatggtccatggtgaagctatgaatcttatccaacttaacagggttgttcttccctcctaccagcttagccgggttcccgacaacagtagtccttggaggaacatccttaataaccgcagaaccagcaccaatcttagccccatcaccaaccttaatattccccaagatacaagttccagcaccaatcagcaccctatcaccaatctttgggtgcctgtccccagaaaccttaccagtccctcccaaagtgacactatgcagaattgaaacattgttccctatcacagcagtctctcccaccacaatcccagtcgcatgatccaacaaaatcccacttctaatcctagaccccggatgaacatccactgcgaaaacctgggaaacccggttctgaatcatcatagcaagaatcttccttccctgaagccatagcttgtgagccaccctgtgagcctggcacgccagaaagcctttgaagttcaagaagcagtgcacgtggcttatgcaagcagggtctctctccttcaccgctctcagatcactcttcacagcatccatgatggatttatcggtctccaaaaccgtcacaaaaagatcataaagtgtgctgcttgggaggcttgagttgctgagtttgatggcaaggtgattggccaacgcggtttgcagtgagttgtgagagagaatggaagtgttgtagtaataagacaaaatgggttccacagtgacatcgagtttggcttcttcatgcatcttcgtccacaacacatccagttcaacggcctcatccgcttcaacatgttggacggtggaaccagtgtgcaaggtgtttaccctgttgtgattgaaactggttttgaaggttttggagtgattatggttttctgtgacttgttttgatgacggagtcagaagggtgtgagtgtgaggatgatttattgggttgttgttgttgtcgccaacaaagaagagggacccttgttttggtgatgcagtcacaagggaatgccttctcatcatggttttgtttccaggagaagatttggaaggaatgatatgtgatatgtgcccctaatctaagggaagaaacgttgaaggttatggagatacaagagaccagattccaattacactatcaatttttttaaagagaaaaaatgcatgcaccatcattatataaggtgaaggaaacgtttatcattgatggattgtcaaagatacagtttttgtttgtccctactaataactaataatatctttgtatgcaccataatatattaacaaaatttatattttctaagtttaataaataaatattcttaaacatataataaataacttaaattatgacaaagttttttaaatgttgataattgaattaattatttaaatttaatttagacatcaagataagaaaaaacattacacctaaaaagatgaaatacagacaaaaggctaaaaaaagtaatttgagatagttggaagaaatttttatttttatttcagtaatgctgtaaatgcacatctaaaagacaaagaaagttaatattaaaaaaattaattaagaaagtgagagtgagtaaaagtcctatctctaagttatgtattataatatataatataataatagatttatcaagtaactattatttcgttttaataatatatatatatataattaaattcttaaagtattcttctatgaataattataaattaggtatgcatattacaactatagttttaagtttttttaattaatcttcgttttgattatttcaaaaaaaaattacggaagtttaaaaactccaatgtaatgtatgatatacgtatgaactgttatattattattttcctttgacaacaattaaaactataaaatattttgtgtattataagaatatgtctaaatttaattcaattttcaaaatataaactaaaaattatttaagagaaatatttaacattatgaaaacgtataaatgcaattcatgtagattaatctttgaaacacgtaataatatatgaaagattataaaaaaaagaagtaagtatgaataaatttcaaaaattaaatttagaaacacaaaattacgtgtcagttttttgtagggaattgtacaaagagactaaattagtaaattattcttagaagaatatagtacacacaaaagtaattaatttgagaatataggtattagagagtaagaaataaaaataataccttaacaagttaatattaaataaagttaaaaatatattcttttgacgtatagaaaagggaggaaatacataaattaaactgattaatttttttttttggaaagcataaaataatttcaataataaaattacatacattaagaataaaaacaatataataaatttatttcactctaagaaatgatttgattttataaaggcgaattatttaattatatgttgaaagtcttagaacctgccagttttgtaaaaggaaaagtccacctttggtttcattgagtcaaattgtttcaaaatatacattaccacccaattcccatccctcgtcattcctattcccatgtaacccatgacatcaccattatcatagcttcaacacattcatgctccttgggcttagccacctccaatatatacatattaaagagtatataaactactctataatctatatttataacattttattatttgattagcggtgattttaacatacacgagagaatgaatgtttttgtaattaatatctattatcaatgtagataaaatgaaaatttatacatactaacgagtggttgatttaagtagtatatgcttaatttttaaggtcccgaaatttgagttttacatgtgaaaaaaaaacttgtttaataagaatgatttcctattaattttgtagaagatacctatagtatagggaaaaaaggtgaaagatcacgagatttatttccaaaacagtaaaaaggaaaatattgtagtgctagagaattatggattgcgaatgttatcgtctctaaatagatattaacaccaaagagaaaattacagcgacatcttataatttcttgaaaccgcataaaacatttatattttttaaccatcattacaatattttatgttaattatttgaaatacattatattgacactgttattttctaaaataaaaaatatttaattacactatgatataatcataaattattaaataatttgtgttaaaatgactatatattattttatactacaagttcattatcattagactcttaaaaaaattagatgttagtgtaatttgttgtactattaaatatgtataggtatattaaagagtttaatgtttatgtattctaaaatagttttattaatatttaattataaattattgttaaattattttaagataattattttaaaaattaataaatttgtcattgaatgattattcaattttttttactaaattttcaatgtataactcttttttctatattaaatgtagtcaaatatttcactatttattatgtctggcaatatctattttatatcatatatatcttgtcccgtgcgagtctttattctttgtttaagttgtttttgtatcatatggcacataattaaactgtttacaaaaaaggggtatctttcgcgtatgattgatatctgagctcttcgaaaatattttttataattaaacttgtgtattctaaagataactgtattgttgacattgtaaagtaaaggacctaaaaaattaatatttcttttagaccaaacatggcagtcgagacacacttgtctggttcctacaaggctggtttatataaaagtttgattgcacttctatttctcatattttaatttacttgagattttaacttttatttgttattatttgtgtttagtttatttttagtttttaaaatgaattatatttaataattaaaaaaacataatataaaagtgactttaggtagcatttgaggaaaaaattcatcagaaactattaaaataagttattttaccaaatacatgctttttgcctaaagaaactttttatctagtaaaataaactctgaactaagtgaaaaatgttgccaaacacattatgagttttatggcatgtaaaaattatatactcttcttattattggaaatgagtaaataattgtcattcttagagtttgtttgaatataaggttaaaaatatttttgagagtttttttattaaaaaaaatattatatttttaatagagaagttctcaaaaacacttttgacttatattcaaacatgttcgtatttttatatcagcatttcatgcctagccaagtaaatctgatttctgcattattgaagatgttgaaccaataaccaccaaaactgtgcatatttgatcatgttgattgttgtgtaatatggttactccatgtctcgaataaatcccaaaatctatatatgcccaatatttaaagttactagtcttttccagttaaaaagccttgatagaggataaaaaaattcaagaaaatagaggttctacttcaagattaaaaaaataaaaaattcttgaaagaaagcttatgcagccaggagagcaaaacatagtcaaataaattcaagaaaatagtgctccagcaataactgaggtgtagaatgtattagggagaccccactaggaacaatagccagtattcaccaaaatatattggcaaaggatcaaaaagcttgacagttataacagttcttttctaaactaagcataaagaacagcatcgtgcataactttcaaaccaattaaaataactccatgagcataatttactaggaaaaaaaaatgtacaaaaattcagaattaaataactgtatatggtatacttataatatatctgttaatgacaaaaggccaggaaaaaaaaaagattcatttgcagtgaaatatacacaatattataatttctgttaatgatttgtatttcttgactgctactatgtcaaagctcaatttcaattgaaggaaacaacaagaacataagtagagaagggaaagggagaacactcaaacttttcttacaaactcacttcatccgatttcctggattttcttttcttttcttggcttatatgcaaattcactattacgtgagtatttctaaattgtacaaggcacctcttggtacagtatacatacattcaaacaacacaactcctaaaaactagatggtattaaatgcaagatacatgaataagaaaaatactatgaacctgaagaatcaagatacatgcatgaacaaagtagattaatcaagtttaattaattaatttagtagttccattttccaagatcaatatggttaagaacctgaaatgggggatatgcttagagcttgtcaatataatttttatataaagttcttagatatagagtcaaagtattcttttatagtaaatatattaagtaattatatttaaattaacttttcatatcaaaattcaatttcttgcacgggaaaatctagacgaaaaaaaaaatcaatgtgtgaatgctttctcctctattgagccctcctgttgttaataatctgatgacaatttgtttactggattccttacacaaaacccccagtctatccagttggaaaatatttactgaaacttgtggctaagaaggtcgttctcttattatatagtattagatatattgaaaattaagagtgatgataagtgaacatcttcacatagtatacactttaattaatactctatgtctttctttgtatcatatcgcatatatacatcattttctcttctctctttctatataggtgttaagtaaagattggaaaacactaatctttttcctataacaacaatagatgaaatttgcaggagttggatgtgggatgagtccaaggacgtctccattgggcttattacatgggttctaatctaaataagaacaatgtttatttgggagcaactattaggcacaaagcatgtttaagcatcactgcttaacaccgttagtgcaatatggatcttctcctgcatcttcatcaaaattttctctttagttaaaatcaaaaccagtcactatattctcacttatttaattgttgtacaatgatcaatgaagggctgagatgctgcaagatattgctagaggggaatttgggccagagagaatctagactccttgctggagaaatcattatgtggtcttagagtatcccttgtcaatggtctcgaattaatctttatgtcacacatgtttaaatttttaacttatatatgaaaaaaaaaattaataacattggttgaaagtcatagagattggttaaaactatatttgagtcataaaaattataagatacttgttcaaaactttttaaatagtaattttacatccgtatataattctatgaccaaatgtatatttctcacggtattaacatgaaatttattccatatatatgtgcatgcacaattccaagaatcttcaccggaaccaaataaaacagaagttcccattccttgatattttctaactctcatttccggtacctttatccatagccttttactgttcttaataagcaattcctttatttttcttatgtgaaacggtggacaacaagtaaatgaagcaaattcatatctgtgaatctatgagcctaacaacttcttgcctataatataacgggggatggaagcgtgtgtgtgagagagttatgattcatgacaccatcaactcgtgactcatgagtgaagcttattaattgtttttaccttaaatggccaaggactgtaatgaagggagaatttgaaatgatttttggtgttgtaaaaattaaggtgatattcactatcgtcactcttcagcgcacttatgtttttatattctaactcttgtactctctctctctctctctctctctctctctctctctctctctctctctctctctctctctctctctctctctctctctctctctctctctctctctatatatatatatatatttgaatacaagttagaaatatttttttaaaattttttttaatgaaaatataatatttttttcgtataaaaactctcaaaaatacttctaattttatattcaaacaaactctctatgatcagtgacatatctacgtataagctaaagtggataaaattaaaatcaatttttttttatcttttataactaatcatatttatcttgttaaaaaattattctgtgaggacaacatctattttttttataggagtaaaaaatatttatttaatatattcaaataaaaaaaatatttttgtgaaacaattaattccattacctaattatccttttaaattttattgtttttatttttttattatcatttttaataaaaacatataattttttatttgagaaaatatcagaatatttttaaccctcacttaatttttttatttttttttaatccgccactttctatgattatacaatagctgcatttattgtccttattttcaatcccatcatttgttatgttttctaataaagcaggtggaggttcctcaccaccactttaaagaaatggcttcacgctattagaatctattttctttatgtgcaatccaacccaataattgattaaatattaattgaaaattataggatatgaatataatgtaattaactaataatgaatggactgatcaacttttaaataactcaatatgttaattaccacccaaaaatcaaattagtgtccactccccgatcgagaaaggacaattgctcaacacacgttaatttaaaatggtttccaatatattaaagtcaagcacgaccataaatatctattaatttttacattgatgaaataatttcacttgcattttatgtatttgatcccatcatctcatctcataggtataggtatacaaaacaattgcaataattttaagtgtcactttgtcacagcccacacaaaagtttaggagggaccacattcttaattcattaaaatcattatcatgaactgaacattttctctgcaggaaacacttaaatattcgcattaatcctagaagtagctgaaccataacttaaaaaatctatctcatactgcatctattaccagatgaaaatcaaacattcaagattgtccaaaatctcatcattcatagcattattaattcaaaatgtcaaaataattttttgctaaacgaaaattaaaattgaacaagtggtgacaattaacatagtagtttatgattctataactatcataaagaaaataactctatttggtgtttttttttttttgacatttttatctccaactattaaaaatcagtaaccattataccatttcattttaacttcaaactgcatttatcttttttttttaaaacaaatcactgtgtaaaaaaaaaaatattcacagttaacttccatgccttcatgagtattttgcacttagtatatacacaaaggagggaaaaaaagaacatttgaaaggcatgcatagagaaagatccaaaaccagttcaccaaaacaaagagaagagcatagtggggggcagttgcacccaatatccgcaccccatgaatctataaccgctcttcttctataaaaataaatacactctcagttactcaacactctttctatttctactgatgcatttggcaagtctcataagttattcaacttttcttaaaacaagaaaaaaaagatttttttatgttgcttctattaaactaaaaaaacaaaagccacgtttattttcctagctattactctccttctttataattcatatataataacaacatcaacagatgcatgcctaatatatcaggattggaacagacgtatgtatattatcaccatatataacgctcgcatatttattgcaatcagctactccacgcttcaactctaaaaccgttactctactatattcatcagtaacacaagctttttgttctcattttggagtttctttttcccactttgctcctataataataacacatcatcaacagtttttaacatacacaaaccttcatgctgagtttcttattcgttgcgtggcaacgcaataatgatgatgatggggttggtgtcttccagagttttgttcttgtttgttgtttcggttttcgtgatttgggctcaggtggtggatttagcagaaggtggtgctgttcgaaattacattagttgggaagatttgcaggtggatgaacaaaggttggccgtgaagtcgtcccataaccaggttcaagttataactgttaaccagaatggtgggggacattccaaaactgttcaaggtgctgtgaatatggttcctgataataacagacaaagggtcaaaatttacatttttccaggaatttacaggtcagtacttaactgcatattttttcatactactttttgggtgttgttttattattataaatggagtttcaatttcagtaatccatatgctaaagattttgattaaattgtcaacttgaattattgaggtgaaactctgattttgatcgaagaacaactccaaaatctaagttttgtcctttttttctgaattatatgaagccagtaaacaaacatctaatccatggatatttgaacccgagtatcaggaaaaagcaaaatattttatgaaaaaataggaaattcttctaaacagtctgctataatggaaaaaatcttatattttgaaattaattcatcaagttgatgataaaatacatggattaagaattatattctattgtgtcattattattcagttctaatcaaaagaagttgttttaattgtttgccttgattaatccatatttttgaaaaaatacatttttgtttttgtttttggggtaacggagctgggtttggttggtgtttttgatccaacagttacatttatttggtttcctaaaatttcatgagtcatcaaggccttgaacttacatttttttattttatcattaaaaacttgacttatgttattttatcctttgtgtatatgcaatttgtgcagagaaaaagtgcgtgtgcctgtgaccaagccttatgtatcatttatagggaaaagaaatcgaactgcaagtcctattattacttggaacagtaagtcatctgacaaaggcccaaatggcacagcattgggcacctatgcttcagcaacagtgggagtggactcagattatttctgtgcaactgggatcacttttgaggtaaggacacacaatttttgctaccctggattccctgcattcacttttcaacacattcaacatttcagaactattgggtgaagattaaacgacagtggttccaaattagtccccacagattcaaataaatgtagaaaaatttccgaaattagcttttatgattcacataatttgttagtttcatatagatcctgcgtggtatcattaaaatgcaaagtccctacatataagggataaactgcattttaatgataacatttgaaactaacaaattatgtaaatgtaagaagttattttcagggatttttttttttttttaacttattcgaattcagggactaacttagaatcactatacactttcagataccaaaatgaccattcagccttaaacgactcttattttctctcagtcaatcaacttaaaacacacatttaaaaatctgagtcagtccaattttcattcaatggttataaatgtactgaatgtgtggaaaagtgactgcactaaatccaattccaacacaagacatgtgcattttggactatgtcaaatgccaatctttgggtgcatggttgcagaactcagtgattgcatcggctggtggaaaagggatgcaaggagtggcactgagggtaagcagtccaaaagcaatgttctatcgagtgaggattaagggaacacaggacactctcttggacaacacaggaaatcattacttcttaaagtgtcgcatcataggaaaagttgattttatctgtggcagggcaaaatcactctatgaggtaaatataagaggcaaaaaaattaaattattgtagtttaaataagaaattaccaatacatagcagtttggaaactaattgcaaatctatagcaattaatcacgtgcaaccaagacgtgtttaaacacgtcgtccctggacgtgtttaaacacgtcgtaccacgacgcgattcagcatgcaatcacgtccatacaggacgtgacccagcaccagtcacgtcgtcccaggacgtgactctgctcccctgtgctttttagtttgatatatgccagttatgctaatctgctccaggataagagacttgtgttgttccaaaagcagtatttacttttgcgtacactaaaatggcttaggcacatttattacctcaaaaaagttttctatttaatttttaaaagtatagttgtactaaacaacttgcttaatatttgtaaaaaaataataattgttgtattaattaatgttgtcataggtaacattttataatttctgtaaaaaacaaaagagtaagattttatatctttaatgttatgagaaatgatcaaattttaaataaatatttcataaaaaatattattttaaatttttaacgttaattaagtgataatatatcatattataaattaatatttctaataacattaataattatgatggtcttctattgtcatttaattaataataatttaatataaaaattttaatatatcaaataagaacataaataataataaaattattaaaaataaaaaataaaatcagattagaaccttttttttattttattgtaatgataatataattttaatatattagcttgaaaatgtgatcttttattatgagaattgactcaattggtgaacatattttttcacgtgaaaggatccgctttcaattgaattcaacttgtagttaatttaattataaatacaactaattcaacttataactaatctaaattcttattagaactaaataaataagaagtaatataaatgttttactaataaaagaaaaataataagctgaaagttaatggccatttagttaagaaccatatatatatatatatatatatatatatatataatagtaacattattccagctttggtttttcctcggtttacagcaccccagccttccgaatagttaccttagcactcacccatattattcataaaataataaggttatgctacacaacccgaaaacatccacaggcttagacccagctactatttcgctcccgacaaactaagaatagctctataagctataccttctcacgtagctttagttcggtcagtttaatatatttatcccggcaaccatgcgagttcggtcctacttcgttatctttcccacatctcggcactactcacttatctatctcatcatttctgctatagtaatgatttcctatcacctcggcatcttccctagcatctatgcacttcggctcgtctgcatttccggggaacttcctgtacaaagcatacacaactcggcaaaaccagccatctcgtgtgctatgcacataccccggcaactccaaaagcacctcggcaagtccggccataactacctcgacactgccggaaggccacttagatcccagcatctctatccacttaccataagtgcacctcggccttccgaataaaactcatgcaccataaccatctcggcaaagcatacaaaatcggccatagctatatgacatcaaacgcagtacttatgtcatcaaacgaaacaccacatgtcttttgccctcaaaattgcgatttagtctttgaacacccaaaaaatttcttgttttccaatttgggacttgccagcggcttctcctctccattttgagcgcgtggccaccggtttcgcctcaatcggacgtcccagtcaaaagttatggtcttccgaagtttctacgcgtcgcgccgcaagatgacacgtgtctcaaaatgacacgtgtcaccccctccttagtcacgtcctccctcgacgtgattcaacccccaaacacgtcctcccacgacgtgattaaacacgtccacctacgacgtgtttgattgctatacatttgtaaatagttttcaaactgcaatattttcgtaatttcttatttaaattacaatattttaatttttttgccaaatataagatgaacttttttctctgttactaaaacaaaactagtgaccaagtttattgaatttaattctgatccttgagaactatggagcagaagtgtcgtcttcagtcaatagctgagaactatggagcaatagcagcacatcatagggattcaccaacagacgacacgggtttttcttttgtagggtgcagtattagaggatctggcagtgtataccttggcagagcatgggggaactactcaagaattatatactccaaatgtaatatggatggcattattaatcctcaagggtggtcagactggaatcattcacataggaagaagtatgatagtattattatttgctccaagtactaataactcaatttctaatatatatttttaacacactctattattggttaaaattcattagaaactacaaattgtgatttccaatacattctaaccaatagtaaagtgtgttgctagtttttctctatgttttaaatatgacattattattccattctagaattcatagtgcagaatatgtctaagcatatatggtacttcaggactgcagtgtttgcagagtatcaatgcaagggaagaggagcagatagaagacatagggtgccttggtcaaaatcattcagctatccggaagcaagtcctttcctgtacaagagcttcatagatggagaccagtggctcagactgtagcattatgatgcaccaattacatgacaattattcattattagtttatatgcttgttattactatgttacgtatcccccaaatgatcaattttgatgcttactctttatcttgcaagggatttttttatatgtatgactcctgacgtgctcttactcttgtcgatattaatatgaaagcactatcattgtcatgttatttgcaaaggaaatgcctctcttatagaagtgaggttaaccattacctttataaactatatttaaacaaaaagtgaggttgtctcattttgaaattaaaatatgccacaaaatcactttataatttaatttatttgaaatttttatataaagttatatataaaacagaataatatgcttaaagaaaattagtatttaaaagttaaatttcaatctcattttcatctatttcataaataattttgcattaataattaaagggctttcatttgtgttgtgtgatactggggattagggacagattcaagggggcaaaaaaggaccctagtctcccccctccatcaacactttctttatataaaaaagaaagatattaataggaaaataattgttgattttataattttctaccagtaaagtaatagatcttatctctaattttatatatatgtaatcaataatatatagcttatatacgtcactgtataacaatgaatgcccaaaatcaagaatctgtacctagatcaaggcgtcagaacagaaaattccaacaaaataaacaacaaaatcaagtaaattattttatcatgtcaatttagtttatggtcatccataacctcttctgcgcagagatgtactcaaggttaaatcacctcgcaagaaacatccattgagaactccatccccaaaattaacaagtgctttccagcaacagaattacaataggcaaaaaggaaaaaatggtcaagacatgagatgcaagacttaagtaaaacaaaatctacattttctctatttaatttaatcacttgtcaacttgcagtgacttcaaaatcttggatgaactgactgatcaacttgtaatgaaacagacaatctcattatctaccctcaacaaagatcatttgtatcaacttgcaatgaaactgaatctcatttccagaagtaaccacgatttttttgttcttgcattctcctgcatcatttggaaacacccagagtaaaaatgtgggttgaacacaacacaggataaatcattagtgtaacgtcagctatatacacaaaagaaaccttcaaccaccaatatgaactcagtaaaaacactaaattctcataactatcagtgaaaacataactgaattgaaacaaaccaaattcccttaagagcgcatttcacttgttctcttgttattaattatgtttttgttataatcacaaattctatactgaaattttgtattttcaaaatttagttaaggaaatactgaaaatattataatcttcaaggtttgtaaaagattaaatattacctttgatgctccttggaacgcctgatgaactcacttggaatatcacatccttggtaagaggctagcactggtcttatatcaggtggactactacgggcaacaactgcaaatagataacagagaaggtaatgcaacttttacaagcataaaaagtcaccacagtaacttcaaacataaattcatttataaacacatcttaagggaatggacttacactcaaggagtgatgtgaaaataaaaacaataattcaaacaataactcattcttcaatatatcttaaggaatgcttacactcaagaaatggtataaaatccaaaagagctgtgtcatctatatcttgctgctgccaagccttaatagggagacagttctcaggttgtaggcaactttccaaagcatggccacttaaataaagaacttttcctggattcctgtttagttttgagaggtcctgccaagcaaacaatggaaaaaggaaagaacaactcattataaaaatatccagaacaccactagtacactatgcatgtgatgtatcaagtatcataataaaaccataggtcttttattttatattcttcaggtgtaagcaaaattacttcgctattattttatagataaaaatataatatttccaaggcacttgttcttattatttgccatgattggttgtactccttccacaggtatttatgtatataattaattctggaagagaataatgtaagaacataaacacatactctgaagtgtttcccatcctgatacttagtagctggcctcgatagcctgtatctaatgcaatgcttggtatccagcctttctataacagggtctacaaactgcacaaatcaacaaatgtaagaatatatgaatatgaatacctatacgagtaagtatccattcagaatatagagaagaatcagattaccatattttgttcatctgtgtacaccactatttcgtagaactgagctaaatgttccaagaaggcatcaactccaggtcttttaaaagtctgccaacctgtatctcgctttacataccataaaagtaaaattcaatattgtagtcatacctctataatatgtaaggatctccagcaagaagcaagacaaaaagagatccaatggattttttatgacataaagtacataaaggaaagtggaatgtaagcaacacattctttactgatggttgaaattcatgagtcttactccctatgtagtggctcctagtctcctactactgatttagtcacccaacatgaatttcaaccaataatgaggagtttatcaaatttctaccaacaaaaaagggtgaatttgcagtagacgtcttaccgtccaaatatagtgaatcaatgtctcattgagatcaagaacaagtgtaaacacatgttgctcctgaggaagcaaatcaggaaggagcttgtctgtgtatggttcagtataactctaaaaaaaaaaaagcaaaagagaacagtattaaaacaaaggaaggaaatataatttattttaaatgacaagtgtcaaaaccaatatcagcatattaaaaagcaagcacgtaccctaacttgttcttcaattagccttcttgcatccaaataaagctctactgctttagcaggcactggggtatcacatgcaaaagaatcagcatgctgttaataacagaggtctaaggcatgcatatatataactaattgggagttgaatacccccaccccccaagaagtgcatacaatgctaatttgtctgcactgatcttcttcaacatctacaatacaacaagttcttgccactgctcactttccttttctaccccctaccctccaaaggtggtggcaacaaacatgcttatatcccacattctcatccatttgcaatatttttctgcagcaaaagtaggggcatataatgactatgattgggcagacctatggtttatttgaaaatgactattaattttagcatttgtcgcacttaatactaatggaaacagtgttttccccatgggacctttacatactatttttcagttgagtaaaattaaaaagatgtccatgcttatcgataacaaagagcacttcataaaatcacaaaacagaaatatagaaccatctaaatgacgagctcaagttttcctattcatataacagcaacacttcaggggaacaaaagttcacgtgaagaaacaaaagcacaacttatttaagggaacataataacagtaatacaggataagtgtgtacggaataaagctcggggaacacacctgtcattgcagttgagtatagcaaaccttgaaatttctgcacaagatatggactagaacatgtcaccttactatacattaaacttaagaaacttatcattatcatatcaaaaccaggcagaatccaacattaagtaaaagtaaggtccactgagggcatttccacgaagcaaaataatagatttaatccgatatcactaaagtgtttcacaaaatcaataaaagaaaaccactgtatattttgacgtagggcgacgaaacagtcacgcaaactatacaagcaatgaaatggagccaaaagtaaatttgttgaacaaatgtaaacgttaaattcatagcatgtgcagagcatttcatataacaagaaacaacattccaatgaccagctcatcaacccaattcaggttagatatttaaacccccaatatgattctaaaacatagaattagcaaagaagaatgaaagtgaagaaagcctgagaaatattcaatactgacatcgagagcagtggctccatcaccggcagcgtacttggccgattcacgaaacgacctcgttttctcttctacttcttccaaactgtaagctgcatgtttcattccaacaaaaaaaaaaaaaaaatcttcaaccaacgtcatttccagatcagaatgattcaataacaaccctaacacatcagagtgacaacaccgacttaaaggaaaaaaaaaaaaaaaacagacacaaaaatgttactagattctgtcgatcaaccctaaatggctactctgaaaatggaaatgaaggaaaacgaaccgtaagaggcgtaaccggcaaaggcagtgcctccggtgagagcgccgacgacggcgtatttgaggaagttccagcggctgggagaagcggcggaaggaggagggggaagaggtgcggaagcggcattggtgcagaggaatcgcttcgatgccaatgaaatcgctggcgatcgaagaattcccaacgacatagttgtgatgtttgtgagcagtgacgaagagagaaagggttcaagtagggttttgctcttgtgctttgcagaaacaagtagaaccacccatcaacttcggctatgccctgtttggctaccagttattccatcatttcttatttcgtaagctcttatttcgtatgctaagccgtgctttggacttcttaatctttggttgtgcttagggtattctactgttttagttttattttcctctttggttgtgttttttatgaacgaatcaacagataaaaaggcccgcccaatcgaaaaacaaggcctggcctacaaacagacaacccttccaccaaacagttcaactgtacacgagaaaatctaaataagtgaaaaataaaagaaaaaaaaaagtttataagtgcagttttgttgtgttatttttcagttaaaaatttcacataaatcgcacaaaattgcatataattgggttacatttttgcaacaattcatcaagataatgcattaaaaccttaaagtggttctattaattaatatatgttgtaaattgtatcaagttataaaaagcaaaaatttctctccaagccatttttgaactcgaacttgaaacaattaattaaattaaaataacctaaaatcaattaatatcaagcttaatataaggtgaattagatagttaaaaaaatgaaaaaatgaaaagaataataggtcttttgttaacaacaattaatatcccgaagccaggtgatatgagtttcagtcttcttctctggaaagcgcccagatccatcatcctcgaggaggaggaaagagaagtccgattttttgaatttccaaaagtgaagattgaaactgatatcatccggctccgagtggaccatactcataatcttttttatgatcagactcgattatattatgtatgaacaggctcagtaagatccagtaaaatttagccataaaaaaattaatctccacacttaattgtatataatatacgtatcaggtggtatgtggtttgatcaattgatcattgttgccacttattataatgcatgtttggtttaacttttgtcatttgtaatccgcgtccaatctgaagcatctaaatggcttttggatcttcttaaatttttgacgcggaaatgaaaaataactcacatagggaacgctgaaacacaaactcactgtatccaacagtcacaattactcaatacataagcattgagcagttaattttaaacttatattatgggattaaagtgggaggtgactttggaggtgattgtcttcctaagcttcattctctctctatatggcccctactttgaaaaattccacttgacatgtagaaaacctcaaacaggtgaacttgaagaaaacaattgtcaatttctgttacgaatagtactctgacaactggatactacccttcatgacaattgacaaagtctctaaagagcaggtgagcctaatatgctatctgcctcacaataattttccatccaagggcatttttggaaacccaaaaatagaatctctcaccccaccattgtatataaggaggcctccctcatacaccaaaccacaccatctcacagaaccagtgtcaccaaccctccctagtgtcatttcatttccttaatttcctttaaacactatggattatcaacttaaaaaccaaaatatagcaaccatgactcaccacctaaaagctcattactatctagttaagcttactcaattgttcgtttcagtatccgtgtgttccttcatcttctcaccttcttccttgcttgttttcctacattacttcaaattctatttctctacattccctttccaactttatacacacaacatagacaagaactccatgtttctactttgcaatggtatccttgtttttgttggtataactaaatctctctccaggtctagttgttgtcatgataataagccttctacgtatattaaaggtgatggttcacaatctcggttttgggttattgaagccaacgagctaatgttggagatagtagaaactgaggaacaaactagtgagcctgatgaacagaacactgcagttgagcaagtaatagaaatagaaaactgtgctgaagaagaagtacaagaaaacattgagaagatcattttggtagatgaaggacaacaaaaaggaagtagcttggttttgaaagaagatgagaaggaggagctagatgaagaaactgaacaattggatgtaggtgatgaagaggaagataaagggtcgacagaaactgattacattctgattgaagaaagcatagaagatgaggaagaaaatgtagaagaagaagaagaagaaagctgtatgttgagcacagaggagttgaacaaaaagtttgaagatttcattcgaaagatgaaggaagatctaagaattgaagctcaacggcaattagtcatggtttgatttagtaacaaccatggtcttcttttttttctttcttagggaggcctagttatttgttaggtctttctccttttctgttccacttttcttgtactttagttgtatgtagtatgcatcccctgaaattttccaaaattatttctatgcttttctcccattggtagcaacaaagaacaggctttggatatgaaaattttgtttaaattgaagtcataaaccaagcacatgatcacaatgttaatgaagtaaattcgcgtatatgacacattttgagtatataatcaaaactatccccttccactaaactcatttaatctatgcgatacactgttaggatttaataacatgatgtcatgcatcgaaatagaaataaatttggatactgttattcttaaatgataaaatatgatcttaatagggtgaaaaggaaacaaattttattatgtaaaaactcacgtgatttttttttatcataggaattgaaaataattattgaaacatttataataattcacgtatcaaatttaatcaattgcctcaaaacttatgtgattgttgatagggtccattattttgtattttttgataaaaaaaaattgtaacatttcagccgaaattttatctctggcaacagtattttgtcgtagcttgacatgcaagagagaaattatttgagagtggatttgatagttccaattgttttattaaagaaaaattagtaatctgaatgcaaacaaacaagtgatttaagaacagagattgatatttaagaagaatgtcagtactatactatgtttatagcaacatgttcaattagttgttgaaagatgagaccacaaatacaaaccacttgtctggttattagaacttatattattgtctggccaacaagtggtatctagatcgaagaaaacctgttcaactgtggttgaacttaaacagtctttttctgtatgatccaacagtattacgaataattgaaaatgatttgcgattttattagccagagcaaatggtacacgatcacaaatctgattcatacaggtcagcccatcagttaggtactggcttatagctaagaaagataatgcaaagtacaaaactgtacgattttattatttatattattattattttaatttatctatttggtttattagatgcctgttgcgaaatcgacaagtataccgttcgttcaagtaataaaatgataagtaagatatcgttcccacgaggattagtacaccgattcgattataacttaaatctaaaagttggatgaacaaatatttggtaaaaatgttgatcgtttgtttgaacaagtaaaataaaatgatatttgaaagcataaactaagttatgaacaagaaaataagttttcacagtataaacgaaacgtagccaaggcacccacactcgatgttcctcccaaatggtccgtattgcgtacttatattcgattatttaagctatttagcaaatatgtgtatctaagttcagttgtttaccgattcctcagtgaaacaaccctttaacccacttgaaagttctaatcccttagtcaccttcctagggttaagcattaagtaacataatgaataagctacccacatacattctcattcctaggtaatgtaaagcaagctaccacacttagttccaagactagagtcccaacattcctattgtgaaccctagctctaaaacctttaatagattgatcaagtctaagaaagagatatgaacattcaagcaaagtgtagtaaaatagctttagataaatgaataatagcattcaatacaacccaaatgagatttacatcaagtgtttggccctagctacaaaatagaactagccaaacctattcatggttagccctgagcttacaaaatgaaacatgcacagctgaagcacaaggaagaaggagatggagatgggtctccacttgaaccttcaactctcaagccctagcaaagcttcccaagcttctaaaacccttgctttttgtgtttcttcagtccaggagcgtccttcaatgctgggagtgaagcatttataaggggaaggtgaaaatccaattctaccccttatcagcttttaaaataacactgcagcaacacccgcgctggtggcgcggagtccacgctgatggcgcggacaggcagacaccttggcgccaatggcgccatgttcacgctgatggcgcgagatcctttgccttgatctccttccattgtggcgctgatggcgcgaatctcacgctgctagcgtgagatagcagtgaaatttcccctggattggcgctggcagcgcggcactggcagcgcggctctggcgctggtggcttgaacttccagagttgatggcgcgagcagcgcgaatctcacgctgatagcgtgagattcttagccaaaagccttcaattctccagttggcgcgaacggcgtgggaccggcgctggtagcgccaatgcttttcttccagaggcttcttaaattggtttcctgctacaaaaactgttcaaatcaatggaaaagctagcaatgaaggatttatcaccaattatcacaattataggcaattatggactgtttgtgcttgatttcttgtttctgttggcttggaaagtatcatatgctaggcgcatatcaatgcctttttcccccttaaaaaaaatgtagttacttttacagtaatttaatttaaattccttcttttgtgagagctactataattttagttagtgataagtggtattatgaagatgtatgcatgaaatctacaatttactatcgttgttaatgtctgtaaaaaacccaccttttacaccctacaataatattaaacaatgatcatttgtataaatttcgtaagatcgaacacttttagtacacatagtaggtatgggaatttttttattataaagtatgatacttgcatactatgccaaaaaccaggtcttttgtaagtacttgcatgtttagccatttatgaatggttatttatctataacgaacgttactgtgtctcaacgcactgtcctttagttattattctttttacttccatccaacacggaaaattcacattttatgctttagaaagattgaagcacgtatggataagtctcacaaagtggccaggactaggagcaaatgcaagtcaatgattgcatgcacccagcataagacgaccttatgaaagtgaagtttcacaaatatcaaatcggaagatggcccaggaatatatcaatacatagttgacacagttctttcagtttcatagaattgatacagaaatcttatttgggaaatctttctaaattcgataaacaaaaacttcccgcaaatctcaaacgtttttcttaatttaatccaagaaattctctagtcaagagagtcatagactaattcttcaaggtatgatttaatattcgtttaaaaaactaacatcttctaatatatgttttcatacacttaagatttaatttctacccgcatacttatctatcaagtatttacacaccatttggtttggtttgccctttaacgttaataggtaacataatactcttgaagttgaaggcacttaaacaattgagcaaaaacaatgatatttggacatccaactttttcaaacattttattaatattcatcatttctctctatcttttttttattatcacattatatcacttatcatattatatatttttctctcttttgtgtcttttattaggtgttaaataggcattttgtctccaaaaattaattttgtaaacaattatagcctataacaagacacggttgtgaaatttctgagtggtaagtatagccaggtttattaagcgatattaatgcctatattttcatatgcataatgcatccgcaaggaacagaatccatcaatcaaacttagcatgcaataacttttttctttgcaaccagatacccccatgatttatctatagtttcacttttgcataaaactgtaaacaaaaatgtaactttgatgtggcaccttcattcccacacataaaatgtaacttcacccgaaagtttaactcagcactaccattttctggacccttctcaaagtcaaacccattagaccatgttacagctctgggatattctctgttgtccatcccatattgatatctgtgccaggaccaggagaaatatggtcctagacggcctaaaacctgagggattactcttctgtgctcaatatcaagttgctaatatctattcatgtataaagacaacaaggacaacgcatggtatttgggaatagtacaacttagagacttgaaacaactacagtaagttagtataacagcataagaatagagagagttttgtttttttatttctgaaagcaacacaagggtttgtcaattacatgctatggtacatatggccaaaaattcataaatgtcattacactgataaggcacataaaactatgggcctttcattttcactgccttaaatggattttgatcaaatgaagctaagtcccaagtggatcctccctaccaaagtgaagtcagtctcgaaagtgaaaggttttttgtttgatatttctctctgtagagcggatatcaaggtgggtgagatctggaaagaccctgccaaacttggtgggactaagactaactctcacgagacaaaaactacataatagtagtaaagtctaactatttaagatatcttccttctagataaaaactactatccttgtgtcctacaaagtaccgattcatgcatgcataaataaggcaataattaatacaacacaaacaaagcaaatccaagatgaagaataaggaaaagtgcatgtatattgttacataaaaaaagggaagatgagcgtccacgtgagcgctaatatatcatgtggcaagggtgcttctcacagataaaattattgattagttggcttagaagaagtcgcttttgatgtgtaaaactaagcatatgaagttgtgttcataaatcaccttgataatgacagtagatatgattgtcccttcgataccaataatgcatttctatatatattcaaaataatgaagtggggtcttttaattcggtggcttagccccttgaaaatagagttattaatctcatgaagagaatgagaactgggaggtgtatgcttgcaattgatttacatcacagattttatgtcaataatgcgcttgaaagcaaatacatgaatagaaatctaagtggagtgcacacgtggtgtacacgacatcttttgggggactcttgaaagtaactactagtgttttctgagatgttctaaattctagcatcggtagactctgcatatgtaatgttaagtctaacaaagcatgttaaaaggccaacttaagtatatctcgagaaaacttattaggattttttttttctaacttgtgtttcacacttacgtgcatccacaacttttgtcttttaattaagaggatactctttgtataacattttttggtaacacttttttctcgctatttctattacattaattatcttattccacccttctctttctcttctttatatctttccttttgttatacacaaaattgtataaatttattatacaaaaaaatgaaagaaagttattaataagtttatagatgatattatgagcaaacccgtaagaaaaggataacattatgagtaaatatttcttttctaacaaaaaaatgtcacttatcgtattacgattcttaattaataaccactttgtttgcctttttcaataacttcggatctcattaatctaatttagaaacatatacttaattatttaatattgtaagcgttaaaacaaactaaacttaccagagtattgatcataaaatttaattatttactacactcctcaaaggttaccatttttttattttggaattccattacatttaatattgaaagttttaaatacaatacaccaattaatatactcaatcaattaagtaagaaaacatggtttcttaaacagacacatatatatggcttataaaataatattaatcattttaaaaattattgctttaataaaatttaacttaaaattaataatgcctcagcaaagtaaaaacaaattgactttattatagttaaaaaatactaaacaaaactaattatgataattcagtaaatatttttatatcttaaaacctgaaaaaaaagctataaataaagttagaataattttagtaaattatttattaaaaaaaaaaaagacttattataggattcactttaattgtggcatgaaccccaaatcatagcaaataaatgccgaagaccattacgttccatattgcttataaaaccctgtcttttttataacataaaaccctgttcgatgttcataaaacctttaaattgggtagacaaatttgccccaaagatcctaaacagacccatttctaccccgacatgccaataagcccattcccccacggacaagtgacaactaaacttaccatttgcaaaacaagcggaatttcgaaaacacaaaacaaagacacgagtaataactttgtgtgggacgcgagtcagctagaaatcgtttaatcttccagaatgcgtaacaaatggcatgtactgattatgccctagtccagttgctggtacagagcttgacacataaatgtccaacatgctacattatcaatttacattcaattttcgttggtatgtaagcctctcacaagaatgaaaatgcgtgcacagataaagcttcaatctcaaactttactcctctttgcagtatcaactgtagctccaaccttcataacaaacaataagatacacagttgaagaaaacgacaaatgttttggaatgtatatgaacaatacctccattgtggtacctccctttgaaggtagcatctaagtaacatggcttcaacttttcttttgtctagaaggaatgttgagaccacggtatttataagatcagatatgtaactaggtcgatctgacgcattacaagtaatatccttatttaccttcagcagtcaagggaaggagacactgatttggaacaaaatatctctcagaatcagaaggaaaagctccaccaagccagtgtatctccgggacacgaagatgtttcgtgtcatacgccatttgctaacataatcgtggggaatagattagtcaggcaggatatgaactttaactcagccatcacagagattcaagtgactcaatgatcctgtacattttatattcagatccctataatgatatacatgttgatgcatatcttaattaataaacttataaatactaaccattgaaccgaatctgtaagtggtcaagatgtcaaagccatagggatcacaatctaccaaacaataagcaggtagacgcaaattctcaaccagaagccgcaaaaacctgttaggatacaaacagacacattcgcaatgcaatatgaaaaggcaagctggcaagtatatgaaaacaaaagttcgcaccttcttgtaggaatatccgggtagcctcttccctgtataaagatagaattcaaacaaagaaatatcgttgcaaacgaaactaatgtcttcagaaattgcttacagtgatgacaatacagcgatttgcattgcagaattggtcgtttgctagtctttggaaaactgaaagtgaagttcaacatggacggtcttttcaatagaaagtaagttggggaagaatcttgtatttttttcctcttattgtctccaaaacaaaaaagcatttgcttacctgattctttctccacaactaatatgtattgagcaacactaatgatatctatgcacaaggttaagcaacgtttttctccatttcgaatcactttgcattttaagttaatatgaagtaccaaataaaattataagaaggaaactaaacgattgcagtattttcacccagaaaataggataccttgaagttcttcaacgtgaacaggaacatggtgggcctccagaaaagccaaatgcctgcatataatttaaatggtaaaaataattactacattaagatcagttcttagttcttacagtgttgggagaacttatgcaatcaaatatcctttctccttcagtgaatcttatccagcccataattaacctacagcagaaacaaacttgatccataagtcttaccacttgcttgttaaacacattagcacacatcattacaatatgaaaaactcaataaaaggcaaaactatcagctttgagaaaattaattaataattactactgcagcagtagaggagaattttgatgacagaatgccacatatgccagccttattaatgtacgtttaatggaatcatattttctcactatcataaattataattataatatgaataaaaacaggggatctcataaaaatacgtgtcttttgaacttcatgaaaaaaatttagacacgccagtggcgagattgtattttatacaaaaatgtacacacattcatgaaacagtattatatgtgaaaataaaactactactgttattattattaagaaaattctgacaacaaagtgaatttttccaagattgagggtgatctcattttgtacccgttccctgcagaaaccaacaaaaaatgaaaataaaagaaatataagcatcccaaacatttaaaccttaaacattgataactttctgtttcaaacaaataaataatagaaaaacaagcatatcagaaactcagatagaagttttattcaccaaaatccaccaagagccataccaaaagaaaaatggcaaaaaacgatagtgcgaaaaactaccgtattaaggttacggtgattgcattgcataagaatacatatatcattaattgcttggtcaaccactgactgatctgcattgaaacaaaaatcagtatgtcattttaatatatgaatatttgattgaacaggttaatttgttttggatcaaggttttaattttgcataaaaaaaattgctcaactttaccgccaatttcttcctagcctcttacgaagttacgtccacttcagtttaaaaaacaaaaaataaaaatagtaaatagtgtaggatttaaaactcagaagtcagtaataaattattatgatttatcccttttagataaaaatttaaaatttattccggtaaaaataaaataccctctaacattaatttggccccaatgatactttaaaaaattactcacattgacacttggtaattggctattttctcatagtttacatacattgctttattttgctttgtatgaaacaacatttatatttaagcaactcacttgggacttgggttattaattactgtatctaatactaatattttatagctgttcatatttttctttgatatcattatctttttaactttaaaaataaaaaagttaaccaattttttaatgtatctcacaatatacccaaattagatcatcttatgccctgttggctattgtttttgcaacaaaacaaaaaatcaaaaggaaaaacacgaaaaaaaaatggagaaagaaagacccaccatgtagaaatgaaaagagattggatagagtaggggctagacattatccattatcccagtccatgtcctgaaataccttactcttctatattttctatctctaattattcaaaataaaaattttgggcctcacttttttgtagagaacagttgctatccaagggaccaaagcaactcaaacattttctctctcatcctatggttgctctcaaatggtcaaatctagtaaaatgggttgttgacagagttatttctatttaacactttgtgatagaggtgctctatatgtgcatatatttgtatcgactagctgtattttaactgattataaaaatgatgaatataaaaatattgattaaaaatacaattacaattcatttgacgaactattcaacaatcttttaatcataattaattaattatagaaaattgcaaacatatgtgaacacaacactgaataaccatttaaaacgagtcctaaaacttcttagtcttaagttggtattctctaaaatatgtttaaaaaatatatacattaggctgattagttgcaattgtaaaatctaaattagtaacatgattatcatcaaaattttgaaaagactataaatatatatctttcaaatgtaaatattactttgaaaagattataatttataattttttttattaacatgttattagttcagagtatttagtggctttttatttatttatacttattttaataaatcttttagtatgtcttatctaaataggttccttttgtctcattttaataaattttattattaaattcttaaaataaatatcatttaataaaatcttactgttaaataaaatataattaaacaatttatagtcggcagtcatccatgaataaatgggaaaccatgtcctttttcttttccgacaacaagcctcaaaaaagaagtcaaaatatggttgaaactcgaaagaacaactgccaagtggggcgcatatatgggaacttaatttttgtccttttcaaataatttatttatttttatattaaataaacaaaatctctttaacgcggaattgattcatgattaattatggagaagctagatcatatgggatccacttgcattgaatcacaagctttcagaagccttcgccatactcaaatctcatctccttcagcaacaacaacaaaccacttcaaaggttagaactttcctcgcaattacgaattacatttgttgttattgtgatgggtttgttttcctcttggcttcttagttcaacacatgtctttctcttactagctcgattcataattgattggaatttccactgcttattgtttcgttttaattctcttttgcctgttcacttgctattgattagtcatccatgacctttaaattttgcagatttattctctgtaaaaaagtgttagattgaacttgtgtagcactgttgctatttctggaaatctaatgctccttgacatgaactgcagttggataagtctttcacatgatcaacctttaagtattaactgttgtcctcaactctgatccactttgttaatttagtttctcccaaatttaatgcatcattattgtcttaagtcttagtcaaggaggttttttttttttttttaacttttagattgtgatcttcaaccatatttcatttctttctgatggctcttgcaagttacgattttgaagggatacaccccgacttgtttgtgtaattttgggtcactgtttttgggaactttttttgtcttggaggattgcccatgaatagaggaaaatacttgtgatggtgaaattctgtgagatgactaatggcccttttattctattttttttgtaatgagaactaaactgggaatgttcaatatgatgaggctgatgtaagtttcattagaatttgaatggatttgaatttgaggttaagaaattgagcggtaaataggaagtcctagttcactagttgcgtttgctctatgattattatttttttggcatgtagagcataatgggcaaattcattgtatttcaatgctattatgctacttttatggcctattagttattttgcttacaaagtcactaactcagaagaaatggatgcattttctgccttttctttaaatgaaggcacgcaatttaggagatccatatggctcgtatcagttgtaagtgatgatccaaatgatttcattttgcatttgtggtggtaagctcaaagtagaacttggattgatctctggcacctattattatagtatatatttgagcatactagtttatttttttgtgaaagctctttggatgaatttatgtttcatgcttcatcatttaaatacttaaaagtctaacaatggcttatggatgttcatttacatccctttcttatttgactgatgttgctagtttgaactgttttgcaattgaatcaggtcctatattgcagatccttgttttctaaattcctctgcatggccaacaatggtgtaaaggagcccttgctgccggtatcacttgatgcgactcaaaagactaaacagcagctaaacaagagaaggctcctccgctttagaagtgctcctcaagcagaaattgttcctactgggacaaatggcaatgaatcaattccccgtagtgcgtccatatttcagaatttacatccaagctttaaaagagtggctatctatcttgcagtctacttaggtgtaggtgctttaatcttctaccttgtcaggaaccagattaaggggcagaaaacagatggaattcttgatgctttgtactttacaattgtgacaatgaccactgttggatatggagaccttgtgccaaatagccaccttacaaaactacttgcatgtgcttttgttttctctgggatggcattgattggactaattgtaagcaaagcagcagactacttagttgagaaacaggaatttttgctagttaaagccatgcgcaagcaccaaaaagttggttcaactgaaattttaagggaggttgagaccaatagaacaagatacaaattatttctagtctttttccttctttttattctcatcatcgcgggcacaatttttttggtcacggttgagaaattggatgttattgatgcattctactgtgtttgttctacaattacaaccctgggttatggggatcaaagtttctcaactcaagcaggaagaacatttgctgtgttttggatattgacaggtactattactttagctcagcttttcctctacattgctgagctaaacactgaaatcagacaaaaggaacttgtcaagtgggtacttacaaggaaagtgaccaatttagatttggaggctgcagatcttgatgaggatgggactgttgggttagttgagcattctttcaaagtcatatatattgttatactatcaattataaaacatgtcttcattcatttttatatcttttgttttgtttctcatagggctgcggaattcgttatttataagctcaaagagatggggaagattagtcaagaagatatatcacttgtgatgcaggagtttaaacagcttgatgttgatgattctggcacactatcaatttctgatataactcttgctcagtcatcttagactaacacattacattgcaccaagttggtgcagagtgttcttattttccactttgatcacgtaatgcacaacacaccagagctttgatgaggatggaaaatctgaaatttcttgaacggactggcgattattggtcagtctcatgctatcgaattattgactacttgatcaaggagcttcttatacatatcatatcatgtaagtatataagcttaacagtttacacttcagttcagagtcttttgtattttacagcttaatatacatagatcaacttggaacattcaattcaaaacacactttcctcctccttggtttacactttttcttcgatcaagtagaatgagctcggggcacggatttggaggttcaacaacatcaacatcaacaacacatttaacccaagttattacatgtaatttttttgggtgggtgttgacacacaaaaaaaaattgagaatgtgttgcatcaatgcatttggattgtgccagcaaaactaggtcatgaacaaaattttattatttcttcaatttttgttaatataaatacaagtccaatcttatcatcattacatgaacaaaaaataaagatttttttttattgctccttttctctctgttttctcttttgtcaattattttatactttaaatttttttgaaaacaaaagacattttatttgttttttcccccacaaataatagctcacaaaagagtgtttgacaaatcacttttgtataattaattatcaatatcacgttattagagatgacccaataggcaaatatctctattgaaaggttgtttaatagtgtgtttggaatatgttataacaccatgttcattccaaaattcacataaatgatgcagaagctacttgattttgctttagatgaatgtgtggaaagagaataatgatccacattgcaaaaatcattccaaacaagtactaagagcatgtttaaattaacgcttagaagacattatttaagtttatggaccaaacatgacttttgcattgaccaagatatttggatgtttattgaaaacataattctaaattgtggactcaagtcttgttgaagcatttgaaagtagtttttgcatcaagtctgactagagtcataaaatttgttcaaaatgcagtcctctttaatgttaatattgtcccgatgaatagcaaggcaaagcacattttgttattaaaacaaaaaatcatgttactacgtgctcgcatttacttaaaatcaagtcaaataaacatatatccaaatacgctctctaagtatagtaacttgcttgatcatattgtgttttgatctcatattggtttgaaacaaaaaaaaagttatttattcaaaataaatttatctaaacttgcactaatttttaaaactggtaaccttatgattaaatagtacaattagtaagcaaatgatatgtaaaaagacttttccgtcatagagataatttcgatgcgaaggtctaaaggatgaattttagcagtaggattttaaaaggtgaataagtatctttcatccaactcgtaaaacattagaaaggaatcagggaagttattggtatgaggaataaactaaacaagatttccaattaggttcttcaacgagaataaattatcaataaaatttgataaataaatatttcttacaaataacacaataatccaaaaataaaaaatatggctttaaacgttttatttacgaaagctttatgaggttaatacttagtcccgagtaacagatgaaaaattgtgctattattcatggttgagcaactattaatagtgcacaaaattatagaagtaaagtttggatcaattttacccccaaaaatgtttttaaatttcctttaagaattgtttgaattgtttaaagttttatatccaaaaaggctttttttcgtcaataataataaaaaagacgagagattttttttcagaatcttatgtggtagaagacttttattttctaaaaaacaacttttcaaattattataaaaaattaagcatgggttaaagttgtccagttgttatctactactactggttttttaaccctttatatatgatctgatcagaaaggttcctggcttgtttgttgtttgcaaactgcagtcaatttcaaaaaatgatattggtccaccaataacatcaccgacgaatttttcaaacttaaaaataatggcatttgcgtacccattgtctcctatgctatcagttatgcatcacttttacacgattatacccatctgtaaagacatataatccgattcacttgcaaagacaaatagctataaatagattcaacacaattcgtacataaaatactaataaatttggttttgtttcaattcaatcttatcatatcaaatttggttggtgtctgacattagcagcttggcaaaaactcttttgtttgcatgaatatcattgctttaagtaaagttaaatattttaaaatattcttaccgggttatttcagtgtaagattaacagattattactaaaaagagtaaattgcgctttccaagttcgatatttaaattacatgttttttcatttttaaaaaaaatatacatacatcttcattaaaagataaacatatgttatatatgagttttaatataaatgaacattttagattattttttcttatggcgattctcaacatcattaatagccttttttaaacatctacattttattttgtgatcttataaaatgagataaatattttagataaacaatttaagttaataataagtgtttaaaactttactttattttctaaaatattaaataatatttagattttaaaaattaattgttgaattaagttgtaaaaaaatcattgaaacacacatttatattttttttctgaccaaaacaccagtaaaaaataataactatcaacaataatgattaattataggctcacactttcatatttattcgtcaatttgaaaaggtttatttatatgcaaaagaattaaagtatcacttatattaatctctcaagcgaaaagagtatctattataaaataaacaaatattaattagtgtcctaccaaatatactagtggagtggatagcagaaggtagctcccttcaaaacaagatgattcacaatatgcaaagataataccacattaaaataacaatttttggattaaaaattgtagtatttactttagaattaattaattaatagtattatatttttttctccccgtaatattactttttcagggcatctgaattctgtcccctggctagtaattgacaaatgagcattcagcagcaaatatggatggcacatggtgcattgtcgactacgacggttccataaattcgagaacgattattatattcccacattaaagaatacactttatttagattaacttacttaatactattcaaaataatttacaaccaaaatctatttaaattttaaaagaaattagcaactgatcaaacttaaaaattttggtgtttggttcaactttgaaaagtgcaaattatatttctaaacagatgctaaactttgactattatgatggtgatttttttcatgaacaatgtcaatgaacatgtacggcatatgagcatatctcatcattcacgatcacaccctcactcaaacactgccatcactcaaaaagactctgccacagtcgcaactccatttttcagttcatattttagctaaaataattttaaggaaaaactaagagagttataacaacattaattagtacacaactcaaccgttaagatggcccgtcaagacatagttatagttatccttaacaaaacacaaaagaaagctgccagcttgccaatgatagtgataattataagaaattaaaatcgagtaaaattctgttttgggcttgaaatattcaaaaaatccctcgtatcattagtatatttttaagaataaaaaccatcattctcgttgcgattaatttaactttttaaacattaattaaatgaaccgacattttttcactagttttctactaatacaatcatgcttgaggccgacaccacatgtacactacacacctctttctacgagattaaaattttgattcatgatattgtagactaaactcattaatttcactgatatttaactatcgccttaaattaatacttttgaaataaagatagcgactttgatctgttgaaacttcacatgacttaacttagcatgagaagaagtaaatataattagtgttagattacagccccgtagagttaaatgaaaggattagtgtaaagaagtcttagcaaagaagaagagaaaggcaaggactagagctgtggagaggaagagtggccagaaataggcgaagagggtcatgaatcttggggccatcagtataagagagaagagcagtgccccgagaaaatagtatctgaactttaccaacttctctgggatctccatggccatgtggtgtggagcaagtgagtgtgactcagggttgggttttctgtgcagagattctttcagacacaacaactgtttcttctgctcgttttttggatttggactcaagggaacacactcatttttcactcccataatcatcattttgggtgaatttattttaaaaattaagaaacaaatattcaatgagtttatttaaatttatttgttaaaataagtaatttttatttttttagtatgtttgactgaaaaaaaaatagttttttcttattttaaaaaacaaatcccatttcttaaataatcacttatttgaaatttttaatttaaacaaaacttatcaagtatttatttattaaaataaataaaatattattttttaaacataaacaatttagacgaacacattaaaaaaattattttattaaaataaacatttatttcaataaataaatttaaataaattagttcatgatccctcaaaaccatactaatatactagcatttttcttcgtgaaccgttttgttccctagagtttttacttaaaattaataatgctcgcacacactaattttacacacttcatttctcaaacgtgaaaattagtctattacatagagtgtgtgtctagggtggcagcatgataaaaaaaattgtgaccaatcccacggtgaagttcgagcaacacatagttgtttctcaaaattcacggtcacaccatgatttttaattccacaatcgattatgaaaatcagtcaattacattgtatgcgtatttggagtggtggcacgatgaaaaaaaaaattgtgaccatgagcaacacatagttgcttctcaaaattcacgattacacacacagttcttgttcccaaaatcaattatgtatcttatccaaacacattgaaatgtatgattcaaaaagtgatgagtttatgatcttatgaattgaaagtgagtcttcctaagtagtacatctgtctacaattggtgtgtccctcacacgcttgcacagtttgcattgcactcctctatatttccatgtctttagttgatgaagaaaagtttgactgaaagaatcacacgagtcttgagtcatgactttggcggtgtgatagtagatttgaacattggcttgttacctttttctcattccttgagcttaggtctgcacgtgctaggtgttgccctagttgctcatgatcatttattattttcggactatatattgctaatattttgctggtaagaagaagaagaagaagaagaaagagagaacaacattttaaatttgaaaaaaaatgctataaaaatagttctcccttcgatagaagaagaagaagaacgaatcaaggaagaagaagaagaagaagggactggtggacgccataggcaacacgcctttgactcggatcaacagcctctccgccgccactggttgccaagtatttatgttctctatgatcacttcgcttccattctctttaccaattccactctcaacctatttttatttctcttcagattctaggcaagtgcgagttcttaaaccccggaggtagcgtcaaagaccgcgttgctgttcaaattattcatgaggttaaacaactgctctctatctatttatttcaaccattcgcatcttctattattcactgtttttcatacaattatcagaattgctttcttttggatggaatatcaatttttcattcattctcaatctgatatacatatacatgtaccacctatacaatccttctatatataattgcctcaattatgttattttcacctaagcatatgctatgtttacttaaatacttacatgatatgcacaacttgctgcatgatatgaagatatctggaatctgcttgataacatattaacacacatgatttaaattatgagttctacatcaagtagaataagaagtttaatgtgatatttaagtcatgaggctctccaacctgatgaactagtcttttgagttggacttccctcttatgcttaagtcataacaatatcagccttaagattgtccctatgattgattgcgcaggctctagaatctggccagctacgtccaggtggaataatcactgaagggagtgctggaagccagtggcggagccagcttttacttttaggtagtgccaaattttattttttaggtagtgccatggccccgctggtttcaatgtggctccgccactgctggaagcactgccattagcattgccaccgttgctcctgcctatgggtgcaggacccacgtggttataccagatgatgctgccattgagaaagtattttataatgattgtaatgtaatcaagtaaattctgttatgaaatctagcgataaacctctaagattttgtgtacaattgatgattgtgttgcatgaatcaaccttcagtctcaaatacttgaagcccttggggcaactgttgaaagagtgagaccggtgtccatcacccacaaagaccattttgtcaatattgcaagaagaccagcatctgaagcaaatgagtttgcattgaagcgtagaaattcataacaattgaatggcaaggaggacaccgagaaaataaatggttatgaatctaatggatgcaattacagctctctgttttgaagattgtcaaggtggcttttttgctgatcagtttgagaacctagcgaacttcagggcccattatgagggtacagggcctgatatttgggagcagaccaatggaaagttagatgcatttgttgcatcagcgggtaccggtggtactctggctggtgtttctaagtttcttcaggttcaccacatccccccttcctccaggttgtagatgttgtcgttttgagtgtgaaagttatgtgagttatttctggttctatattcaacaggaaaagaatccaaacatcaagtgcttcctcgtagatcctcctggctcttgtttgtttaagaaggtaactaggggagtgatgtacaccaaagaggaggcagaaggaagaagactcaagaatccatttgacactataccagaaggaattggaattaacaggataacaaggaattttgcaatggcaaaacttgatggggcctttagaggcaccgatagggaagctgttgaaatgtctaggttgttacttactcttttgtaaaccatcctacttttcttatttttcgcggttttttgttcttttctgtcaaacttgaagaaatgatgaaataaagtgatatgttgtttttgatgtatcaggtttcttttgaagaacgatggtctcttccttgggagttcttctgcaatgaactgtgttggagcagttagagtagcgcaagcaattggcactggtcacacaattgtaaccattctctgcgacagtggaatgagacatttgagcaaattctatgatgctgaatacttgtctcagcttggtttgacacagaaagcaactggtttggagttcttgggcatcgagtgagaaggtttcttcagagtataaaattttaatgccactgccttagctgctatatgcttgagtgcttagtcttggatgagagtggacacctagaagttagaactgagggtgttgtagttattgatatagaagatattacacttattaatacaatgttttgggggtattacacggctcattctttgttagtcttcatggtttattggtttattaactaggccaagatgaccaaattgttgtaaactaaatatattcaattcgaactaactatttcagttcggggatgaattaggcctgcggtcttcgttttgaaattaatgaagctggaaatagtgcacggcaaaaatcttcgaatacaaaccaataattcaagtgtccaatacaatcatataatgaattgtaaaaaagtttaatagcgtggaaaatgcataaattattgaagttggacaattaaaatatatattgtgatgacatgacattcaaatttgagtttaatggttaatataaaaacttgcattggaaatcaataagaaatcatcttaactattataaaagttaaaaaaaattgtggatacataacagttatgaatgatattgtaaatgtacattttttttaacaaatattgtaaatgtgcattgagtgcataatttagtttctctttattgaaaattgtataattttttaatcagtaataattacaatttgtacaattgaggttcactcaatttaataattttatcaaaaagaattttcatgtaattattgttcatttatcctttaattcttattatatcataatagttcatctcaaaatctatatatatatatatatatatatatatataaatatatttttttttcaatctcctcgtatctaacattagattcatgtatcattgattttaaatgtgtcattgatgttgatatcgtttaattcttgttgaatgaataacaataacttctgttttaaaagacttatatttggaacatcttgaactaatagatattacattaaatgagatttcaatgttaacagtcaataaggtaggtgaaccttagctccttgatatttttccttgatcaggattagttggcaattgagatcaaggtaagtctccaattcccacaaaagaacagtttactatgaggcaaaatacctttattatcaaagcactaattaataaatttattgtcagagtacatgacctcatacttgggtctcgatagattagatcaaattgtataacaaaaggtgcttaagtggacaatcccgaagaataaaatagctcaaaaaagcaaaatctaccgtgactaagagggcattacctcctctcaaactcagattcttggcaatgtggatctaaccaatccttgggagattcctttgcattgttgacatttaatttccccacacccacaagctccctcaggttatccactttattctccctacccatcccactaattctcttgtcagcttctttcagcttttgcttgaacttttgcttccggttagatgaaattagctcttgctgctttgctagtgaaggaggcgctccatgtgggcccaaatagatgttttcttccttcttagcctagaacacaaacaaatgccagtatcaacatctaaaacctgaaaattatatagtctctaatattaggaaattttctttagctgacctttgatgcagaattagaagattctacatcaggaacatgaggtttattttgatctgagtcttcaattcccaaacttggaatcacaaatccatcagtgtctacaacaaaaaaaaagtccaaccattcaacatcaaaagcaaaagcatttttgtccccatagaagtcatcccaacattgctaaatagaaagaaacaactatccctagtcagaaagtaaaaaaaaactccgaacacagtcacagacttttcattttcatagcaaaacaaatagcacaataaattgcaaaactgaaatatatttatgcataagtatagacataaacaacatgtcaacatgtaataacaaacctatatcaatgataaattctctgtatgctaggacattatgattcctaccctaaatacctctaatttacatgaaaatcaaacagtgttaaaattgaatcagctggatatcaaattaagctagaacaatatgccttacacacggatgtgaagcaccgagcgccacaagcaatatctccggaaaataaaatccagataacatgacgaactctcaagcaatagcagtgaattaattaataaccaatccttgtcaaaatcaaatgagatcctcatatatgcaataaatcaacaaaattcaatctaatgcagaaacaaataaataaataaataaaaacaacacaaaagatcctaatttcccccttctctgttccggtttggtcatccagagatcaaaagagaaagaagaaaaaaaaaagagacgaaattgaaggaaaaatggcataccccactcgtcgtcttcttgttgttcaatctgatgagagagatccatagtaaactgacgaccatggatttcaatgggcgataaagcccgattgaatagatagcagcaaaatttcacaaacacaaatctcgaaagaataaaacacaaaaaataaatcaaattagagaaagatgctttcttgtggtggaaattgagaggacaattaaaccctaactatagggtttcactgtgcacgtttgtttggtttgatagctggtaaatgtcatactgattcggacagaattgtttaaagattgaagggcagttttgtcactttgattctcaagtgggatattctatgtagtatatgtttttttttttttcctttattggtagaataattgatagtttataagagataaagattagcaattgtttattagataatttttaaaagttgtccttatatgatattattattttaattccgcatcaacattttagtattaaatgaaaaaatgtccttgttaaaactttaatatgatattcaaatctaattaaatttctttcaaaaaaaacattataaaaagtatatcattaaattttttaaaaaatatttatgaattaattcattttatttgtcaaagttgtaatgatattaaattagatatttatttttaatattttaattttgattcttgttccaaaaatattttaattttttaatttcttttttatataaaagattaattaatatcatttttattttgactcttacatggtaaaaagaagaccggtaaaactttgactgagacttgaaacatgaaattttatatgcagagttcttttaatgcataagttaaaataaaataaaaataaaaataaaaggattaaaattttagtttaaccttattcgtttcatcatataactctttgggaggggaggggtgtaagaaatgccaattttatgtattaaattaataggtgatttgatattactttgttacttatatattaaggaaaatgtacataaatttcaattttattgtttttttgtattgttcatagattctattctaatcaaatacaaattggaatacaaatatacaataaataataatatatccttattttaaatttcatcattatttaattatctatgtgttatatataaagtgagtacgaaactaattaagagtgaattgttttaatttaacttatactcttaatatgaatctaaagaatgtatgtgttaaaacttattaattaggaagagttttaccacctttaatcatcttatgtttgacaactccgaataaggttattaaaatgttataaagtgatatgtagagtacttaggcctctttattttgcaccagtaataaattatttttattacgacatacattttgaatgtaaaaaattataattgagagtaatttagacacttatcttaattatatggtattacaactcgaaatcaattgcactcaactttctgcagattggcttcacataaatggtgtattcacagcaaattcgtgagaggtcatgcttgtggttgtggagggaagatggatacatgaaatatggtaagcacatggattttggactgatgggcatgatgtctacacgaatccagtttctataatattatttaccttgagtggctttctgttgggtgcaaatggttatggttctttttcattgcaataaaattttctggccttcccaagaaaaaaaaaattgcacccaactttcatataaaaagaagtttaatctcacggtttagcaattgttaaatttctgtttggttcattaatcaaatgatgttgcacaaaatattgataaaaggttaataaaatcaaaatattattaaataaatgatgaaaagtgctagacttttataagaacattaatcattaaggagtaggcataataatcaacaagattttccaccaagaaacacaatcaaagtcacgagaaagcgcttgagtcatgcgatgtctttttgtgaatggcctctgtttccacgattttcttgtcttttgttctctttcgtttctcataataacatcatttctttgtaggcacgagcaaatgattatgagaggggattaaggctaataattgaatacaagaaggtaaaaaagggtaaaaaaactgacagggacattcaccttgtttctgatatgtaattgcaaatgcttttctagaaatcaataaaaagataatatgaattgaagtctcttaccaattttttgcttaaacatgagaaatatgcatgtacccaccttgagtaattgtcatctgtcacctatgcatatggtacattattaatcagtcgccatttaaaacttcgaattattcaccaagatttgatatacttatgggacagaatatttcaacattattacactctgacacgtcataatattaattgtgtgagcattatccatcacaaaattgtatttctaacacctgtcctaagttttattgatttttttgaaattactgacacgcttaacagcatgtgtaacgcgtacataatcacactaacaatagcacaaagagatttaaggttgaacaagaagttaaaaaaaaaaaaaatcatagtttcaaatctcgatatttttaataaaattaacaaattaatatttattgaataaaaaaaactaacggtagcaccatcttactataaaatagtaattaagaaaatgtattaattaattttctgcttcataaaaaatagccacataaataaaaagagtcttcttcattaaatacaagtagtagtaggtttagatcgatctaattaaaaacaaaatctaggcatctagctgtataagttgctgaacctacgtcttccttacgcaagctcttgaaaccttgtaccaattggcaactgtaactaaattgtcctagtagctgatatgttacctagtgtggaacaggatatatagtaatggggaatacctaactatgtagttttagacatcttctgtaatggggcctccactccattaaagcctgcatgagcatgacatgctgaagcagaaaaggacttacttcttcatggctcaacaagagcctaaacaataatagaaagtgggtcattgttacagaatattgattacttaatgtgcctttgttaattaggaattgtagttgtaggagcaaagttttgtcaacctgccatcacactcgaatcctttcattgctaccaaaagaaaggaaaaaactaatatgaagtcaaacgtttctttgatgtatgtgatggggggaaatgtcatactaggaaagtgtctcaacaaaagaactcccacaaagaagtgttgttttgagaaatttgttgttttttcctgatttggtatattgagtttctgtgtggttttgtttggttgtgagtaaaatagagggagaagcaaggcccttcttgttcttgagttctcttttgatgaagtttgttttgttgggttcggtatcttggcatgtgtgggggaggggtcagatatgtctggcacatgcattggacaaatccaaggctttgaggttgtaaatattgttggaaaacaaacacctttgctatctccaagaggatcagatgcagataataaataataaaaggttttgtgtcagaggaaaaaaaatagaagaaacggttcggttaacacttgccagttggattcctagctagtagagttgctcagcagtggaaaggaacttgatctttcaaggatcagatgtcactaaatgttacccttgtcaggtttggtgaaaaagagcatatttttctttggggttcaagccatgatcttttgagtcttattgaaaatataattttccctcctttgctccctgtttgacattttagcaactgtttattacaaaataggaagcagggtaggagctgaaagttatcagcattaacttatagcttaaaagactcttttgactgtcccaaattcctttgtagcacattgaaatttttctctatctttgctgtgtcacaatctgtattttaaagtcataaaagaagtacagaactacagattgaacaaattttcagccacttctttttagtctttcccagtgatcttcttctccttttcaacagtacttcttgcagtctttgttgggtgagttggatctttgcatttgctttggctttgacacaacaagttcattctagtgaatgatcatggtgaaagtaacaaagcaacaaatctgtcacaatctgtgttgttattttgccagtttcttaccaatcattctagttcttgtccttctattttcaatttcctttttcttttcagtttctgaatcctctccttcccttcttacactactgattgctcttctatctaccttgtttcttgtcacactggcaaagaaaaaagggtccctacatgaaaatcttgtccaagataaccaaccgaatttggagttacagccttcattgggagatgttactatccaacaaaatgaaacttctgagaggcaagctgaagtacactcagagtcctcatttccattagattgtgaaagaagcaatattatggatacaagttttgaactaagtgctcggaagtatgagcaacaagctgatccacagtcagatacttcacttccatcagatagtgaaagcactgctagctcaaccatggatgaagaaagtattgagattcatcgcaacagaaatcaaaatcttgatatatctgatagcttggtctttgattatgatgttgatggggaggaggatggcttgattgaaatcaagcttccaaacaaccacttttcagagttcttgccagaatccattttcaagcagcaaggtctcacagagctcttggcagaaattaatgagatgaatgaggacgaaaatttaattgagattgatatttccaagggatccacaaagtatcaagatttgagattggagaaggagttggtttgcagattagatcattgtgttcttagtgattaatcttttattactaattgttatcttgagctgttattttaggtgaggttttagtcattagctattgtccttcttgatgtttaccaaaattttgttctcttctattaacttggcgttttaatcttaagccgtgttttttttaattaagagttagttcaaatctcaatcaaatctcctaattttatctgtttcgtaacattaaaaaacacagtatgattatgttttgtttgtatgactatagattaggagtgaaaatatatatcagattttatataaataagtctgatttattattaaaaattaaggtgtagtttgatctaataatctatcaacgactttttttcttttttttttttaagtttgatttgtcttttttaaaaagtttagtatgatctattagtttacttaaaggtcttttatctcaaatatttattttatttgacataaaattattaacttattaaaatattaaatataaaagcataatacacatatattaatttttattatatataaataaattagtatgctaatctatcagatttaatagatttttttataaactcacgtctaacctatttaactaaatgaattttttttaaaacttaaatctttttttttattaaacgggtcagaccaaagtgattgactctatgcatgttaaacctatttccttccctaatttagatacacaaaggaacttttgtgagtgcttgtcatcaatttgtcttattattttcctcttttccttttctcttcaaatctcccattccctctcatatccgggaaactttatttactatgcaatcatgtgccaagtgtatctgctgactcaggctgtgcactttgcatgttacaagttgcaaaatataggctttttttgccataaagtaaataacagtgctttaacaaatactgttatttttaaatcatttaccaaactactctcgattttaataagtagttggacaaatatattatatttgggaaatctacaatttactatcttaaaatttgaactaaaggttttaggaccatgggtgacaattactatttttaataattggtgattataatttaaaagaaattttcttttaagagtagagaaataggtaattttgacgagcaatttgatagtttattttttcaaagaagggtcgttacaaatttttttcctagctattgtttttctagctttacaaatatgaatccatagcattttttattaaaaaggaatttatgcataaacaattaaactagtggcgtggtcctaagaggacttatgggttattagcccgttgtttacatgggcttaataattctctgacccataaaataagggccgagcttactctgcagcagtcaaccataaaggactcactggaaagaaaaaccagaaaggactcgagtcttgactgaaatatatacatatagaaaagaagacacagaaaggatgcaatcgagcatttaatctcttatccaaacatccctttctttcggaatatcaacgcaggttgaaggggtttaaatatcttcagtatttaattttttaacttgtgtcatttgactttgtttctaatacttatctaattttgagagattattttcttacttatcacgtaattaagaaaaatattgtgtggaaaaaatcctttctaatttaaatgagcgtcttaaaaaaaataacactattcaatgttaaattatataaaaaaaaatgcaatagctattttttatttatttttatttgagaaaaaaggatatgcattttatatactattatcccataataaatttccattatagtagatttgttgactttagaactaattttaaattcattaacttaatatttttttaatgaaaaaaaggaacgttgtatctgtttgaaggttcagactctatatatttagagtcgaattatgtctatagtatgacacgagttacttttaaaatactacattacatatggacgtataataaagacttcacacgagctaaaacatttaaaactcaattgaatttgatatattctagttttttgtatccctaaaaaaaatatgcgtaagaaaaagagttgaacaaataaaacgaaacaaacacaaggtttggacatcacatcaataatagaaattaaaccaatgatgcaagggtgggtgacccacttagcacccctaataattgatgtttattagtggatgcatatatgcaaagtcaccatatgtgtatgtgaccactgactataactaaactagtgtcacccatttgcttacttgaaaagcctatgtctccaaatgattcaaattattgcatgagagtgtccgtgggtgggtgggtgatgtgaatatataactcactgtttttttttttttttttttttttttacaaatatataactcattgttctgcacctcttgtttgacctattgtaccacaagttagatgactaacaattaactattactatcactttggaggccattatgggaacgttttcttcttcatcgttaatgcaagttatgagccgattgttgattcagtttgtggtacgaggttgtcatttaagggtatccttatcttaaaaaaagatataagtagataaacatttcttttaaatatttgggaagtttaactttcttctagttgaagatgaataatactaagtagggatgtttatgaatattagatatatgcatatttgaattgacttaaatgaattcaaatagtttgggtttttttgtgtttgggtcaaattcactcaatccattttaatttgttgaattttgggttagttacaaattttaatatatgaactagttgatttggcttattaatttgtattaagttattattattattatttaaattaaaaaaaaaatcaattactatttatatcatacataataactaaaagtgagattatttatcttttcttagttttcacaagttcactcaatcactctcacaaaattaaggttttaattctcagttgattgtagaatatctattttatttttaattttgtattaaaactattttagatttagttaaaatttcagctgcactactcatttaactatttgagaatattaaaattttaaaactatgatataacaactatagtttttgtatttttaggcttcatgagtgtgattattgaacttgtttattatgtttcaatttttaaactatatttaacataattatgttgacctatgtgatgatgatgacaataatgtaattcctctccttgtcttttcttccattccttgtcttttcttctagtatttaactacacgtaataattataagtaatgtattcggtattccatttaataaaatttttagcttataaaaatattaaaatttaaaaaataatagataaatttatatgttttgaccttgttgactcaacccaatccaaaccgtttacaaatgggttgatttgtgttttaaatttttttcttggaaaattgaccaaaattaatttgattggattagataatcaatttcgtcaaacccaattcaaattgatgtgtgtacacccctaatgttaagttcattgcatgaaaaatagtaaaatatttgtagttaaaaaatgtatcctaaatatttgttagagtgtaatgaattatgttaaaactaaaaaagaggtgtagagagattgaattcattttatgtgaaaattaatgcaatacaaaagagagatagaaagaaaacactattaatgttaataaacgataaattttgtttgttagcttttgtccaagtgcttagacatgtttgaaataatttgattgtttttaataaattttaataaacgataaaaagtatgtttaaaacaatttactactaacaatactcctttccagatttttggtgttgtttaatatactcctctccagatgctttgcaatgattggaggtgatttcatagtagtgatcaagtgactaaagtctcaaattcaaataaacttggcagatgcttgtcttgtattgtgttttgaaatcacaatttgattgataatgtaaattataaaaaaatataaaataaattaacaacttagattgtagttataaatcactaattgtaaatatttttctgttagtagcttaattaaattcaacaaaagagattattgacatggagtgtaaatattattataactgtcactacttcgcaaacgttgcattgaacatcagttacgagaacggccaatacatccataacgcgaattttgtggtagaaaatctagattctaggagtgttataagctagtataactttaaaatacacctttttttttccacttggaaaaatattgatggactaaatttatatttttcatctttcatcaaatcaatttttactacatcatactttggaggatgaattttactatttacccaaaaataaaatgaagtctaattctataaatggttagagaatattgtaattacgactagctaagaagtatacatcataagaattaaacacataaataagtaaattttaaacttataaataatacatataaaagttatgcaatattaaaataaaaataaaaactaaaattagaacaaaatattaataaactcacttgtttttacatcctttacataacattagttaatgtaaaggatagcgtttggttgtgatgtggacaccggacaaggaggccttaaaactcaaaagactcaccgtggtatggccaacaccgacacatctaaatgatctaatcacaccttttttttcataaataaaactcaagcattaagattcataacaagagtaatacattatattcaaaattagattttgacataacaagtattgtttaattaagtttttcatatttaaaattatttaacttcattaaaagatcaccattttaattcttaaaaatataaaaataagaattaaaattataaaatattatttagtattaaaaaaaccatttaattgtctacactacataaaaacaagaattaaaaaatagatgtttaagaattttaagaactaaaataataactttaaacaaaatcggggccaacatagaagtaagatcatgaatgaagtaatcgcaacttgtttgacatgcaaacacagctattgaaagtctccaaaataataaaaacccaaacctaacatataaatatatcaggctcaagttgaggtaattgtagatcagaatctcaaacctcgtgtttaattagaccctaagttgccttgaatagcccaagtgaatcaaagaaaggtcataacaaaattattctactgttataaggaccaccgtacctctgattctattgtacccttgttacagtggtaataaagtgattaaggagatactgaaacaataacaccagcaaaatagatcactattataaatgacaaaataaaattttcatgcacatataatctcccttcctttaccattacttgctggaattgctagtaactaaagtgttggagcattcttctatagaaacactctatatattcatccatcaagaagacatcattgattttttggcactaaagaataataaaatccctacttttgtatatttggagcttccatggaagtagcggcgcgatagcgctgcaagatttgtcacccgcaacgctgccatcggccaccactggtcgctactggaaaccgtcgcattatgataaaaaaagtagcgattggatgccgcaacccgccgttgaagcgagatagggctgctattttaatctaagatttcgagtactactaaaaccaacaaacaaataaaaagtataagttgggggtgcgtccgtgtggattttacaaacacgaaacatttaccttattcacagcatattgttcatttatttatatcatactgaaattaattttaaactgttaataacaagtaactcaaatttatccaaaaaccagtgaatcttgaaccttatatttaagatgtgtgggcataaaacaacaaagttgctaaataattaaaatattagacggaagaaagagaataaacgagagaagagaggagagcatgtagcagatacgaaaggaacggtccagatgattaatccgacatccaatcccatggtgggaaacttgtccgtgcttatcgacaaacaacggccaagaaggttccacgtgtgaagcagataaaggcttattaacgaagccgatccaacggaccctgctcagtccattcttgctattttttttttcttttcacgaactctgaagtcaaccgaactcagaaaagcagagcagagtgttgaattgattggtttagttaagaagatggctgagtcggacaacgagtcgggcggggcgcagaacgcgggaaacgagggggggagcttcagcggggagttgtcgcctcgggaactggacaggttcctgccgatcgcgaacgtgagtaggatcatgaagaaggcattgccggcgaacgcaaagatctcgaaggacgcgaaggagacggtgcaggaatgcgtgtcggagttcatcagcttcataaccggcgaggcctccgacaagtgccagagggagaagcgcaagaccatcaacggcgacgaccttctctgggccatgaccaccctcggcttcgaagactacggcgaccccctcaagatatacctccagcgcttccgcgagatggaaggcgagaagagcgtcgccgcccgcgactctaaggactccgcctccgccgcctatcatcattatcagggacacgtatacggctcccctgcttaccaccatcgtcaagtgcctcctgctgcctctcctgttatgggtaagcctgggcctgggcctgggcctgggccttgtagacccagatagtcagatacataccatcgacgtgctcctctattcgccgctccttttattattttttaaaatcataataacgcatgactcactcctactctttagtgcttgcttgccactgggactcagagactaatttcgggggctgaagtgaagtgaaggaaagggaaagaaattattctatcattattattggaaaaatgctaatgagtttcgatagcgttaggatattttttaaggaattaaaagaattttttatttattaaaatgcataaaattatattatttataatttttttacaaccttaattattattattacaccaagaaataagtatggattttattactttcattggtcattgggcactttgcaaagtttaaaaagtacagtgtttcttttctttctttttgtaccatcacatgtatattatttattgttattattatttacgtccatcccatgcacattgtcaaatattcctttttctagctgaatatacatgtgattggaagtgttttctagctgaatatatgaatgatgaaacattttttattagttgtgttagaatttaagtgtgacgtcaaaatctcatattagataataatggaaaagttctttaacatacaagtgagaaaagatccacaaaattaagttttaagattttgtgttaaaggtatgaatactcacttggatataaatcagaaagttgactaatatacacgaagaaagtatataatttgttcattgcatgcatcagaaatgaagcaattgatcaaactcgtcaccttaatttgttattattaaacatttctacaagtattattaattcgaatcctgccactgaataagctgacttcaattcctcaaattactcattgataaaggtaattttttttatttatttataggaaattagcaactattgaaattgatataggcgatgacagtgtgctgccaatacacattcacatcgaagaatataagcgatgcatggtgctctctacctgaaaccatcaaatgtcctggataccaggggcggaactttgggggggggggtataagggtgggccaccccccttaaaaaaattaataaaaaaatgaaaatgaaagagaaaaaaaaaaaagagaaaagaaaaaatattaaaaaaaagtaaaaagggaaagaaaaaaatataaagaaaacgtagtaaaaaagaaaagaaaaaaaatatgaaaacaataaaaaggaaagaaaatataaaagaggaaaaaatatataaaaaaggaaagaaaatgtaataaaaataaaatggaaaagagagataatagaaaagaaaaaaaggaaagaaagatgataaaacgaaaaaaaaaaataataaaaaggaaaagaataaagaggaagagggagaaagaatactataaaagggagaggtctggacacaaaggagaaaaaggaaacacaaatcccaagagaacataaggagtcaaaaaagttatttcatttgataaaccagtggaagataagagtttcaggtatcccctcattcctttcttttttcctctttttctctttcttcttcttgttgttattcttctaaaataaaataaactactatttgcgccccttgtttttacacatgtacccctaccatgttgggctgaactcatttttgtgaaatctgaaacgaaataaaaaaaaacataaactattatttcggttgttaatgttgtgcaatgtgatcttatgaaccaatctcaacatattgagatattggttgaaaaatttacttctcaggagattgcaactaatcgtttgagactacaagtttatgtggatgtgacaagatgacttgctcttcaaggatatgcttttagaggtcatgacaaaagcttaaattcacttaaccatggtaattttcttaagatggaaatttttttagcttcctataaccaagaagttgcagcaattgttttagaaaaaactcctcaaaatgcatcatataattcccctaaaattcaaaaggaaattcttcatgttttatctgaaaaggttaagaacataatacaggaagaaatttccaatgccaagttttgtcttattgttgatgaagctagtgatgtatataaaaaagagcatatgactattgttttaagattcgtagataaaaatagataaaaatacatcatgtgattttatctgaagtgattttaatttctgtaatagttttttttatattagatttgtattgtcttcggagtacttttatttatgatataattttttttatgttcaccccctctcaataaaattcctgattccaccactgctggatacataaaaaaaacatatataccactcacaaccagtaatttgatacagagatttatctatatatgttaaatcatttcaaccttagagaaaattcaatccataatccgtgatagtttctttgaagttatctgtataaactaccatttctttattctatcttatagcaaaatgaataaataatatatgcagtatgcactgacattgtattttaacacacagaaccataaaatttattgatttttataataattattttaaaagttatatgaataatgatttttcattaattaataatgttaaaaaatttacaatttctgtacatgcatattaaaatctgacaaaagatgggggaaggactcgtgcttttacttcatctggagctttgtttttctttgggcctttaatttgtttttgtcagggctatccaatgtaagctgttgtatataggcttggttgttgatacaatccaagccagcccacaactataccatctcgcaatgaatcatgtaaaactctagttgctgatttttttactgccataataattgattttgtttagagaattgattattaaatctatatctttttttttttctcatttgtcattttataaactattattcttagattatttcaatttattaataacaacatttttaaaaaagttgtatgttcattatataatataaaaaaaagttgaaattttgagagtagttaaaataattgcatataaaaaaatatttttattcagagaatttatttattatttttaaataatcaatgatatttgaaaaatatatattcttacaagatataaaagtataaaactatttaacaaataatacatgtttattttaaagtttaggtttattgtccattttctattatttatatttaatgttattcaattattttatgtccaaaaccaattaaagtataagtaattaatgtgttaaaatcaagattgaatgttggataataattgaataaaatctttaacaaaaataattttttgatgaaactttccttacctaagaaaataagatatttttttttgttagtttttgttgaaagaagaaagagtgtaatactgtaatgttatctatcctcgtgccctttctccctcgtcatattctctccccatttggcatacagcatccaaaatcgaatcttcgtttgaaacatggcttcctcttccttcctctgccccgcagcatttaccttctcacagaagccacttcaatccacttttctgcatcccccctctcttctcactctaaacattcttccaaagaaattgagaaaaccccaccaactgagaaccctcatagtggccaaatccaatggcagtgactctgctgatgttcctgaccgtttaatttcagcactttgctacttttaccctttctttgatggcatacagtacggaaagtatgtaatcacacagttctaccctgttcaagccattgttcaaccattggttcctgcaataagagttttcaagagctttccttttaatggattccttgtgtttttgaccctttattttgttgtggtgagaaaccccaatttcagtaagtatgtgaggttcaacactatgcaagccgttgtccttgatgtgctcttgattttccctgacctccttgaaagagggtttaatcccaaggatgggttgggattggatttgataatgactttggatagcactgtgtttttgttcctcttggtgtgcttgatttatggttcttcttcttgcttgctgggtcaaatccccagattacccattgttgctgaggcagctgataggcaagttctttgaatcaccaatccgttattgagataatttaattgtatagcaaagcaacttcagcctaagtagtggaaaagtttgcattttcacttccttaatagttaactatcttggaaagtttctgcaaaacggattttagttgtttcttacattgctggattctagtatgtctttctaaatcaggattgaattattgtaagatgatgagaaacttccccttctccattgttaattgaattcaatattatatctctctggatttactgaatggttatggcttttgagttgtagtgtgccacacatacatgttaatttcttgtatgtttaacaatcctacaatcagttatcttctcttcttagttcttatgtcgttatgttttagtttgagctattcttctaagagttcagacttcagagtggtgttttgctataatggttatgcatagcggaaataggaaacacatataggggtaatttgctgaagttataatcttttcctcttttcttttgctggaagcttggaaccaaattgttattttggcctgttaatgaacgagggaaaataagtaaatattgaggcaggaagatccctatattagatcttaaagtgtttagttactttctcacatctgctcgattagtagcatgtttgattgatcaaggataatctatgtgacaattttagattttactctcccccgtgtctttctagtttcctttatatcctaaaggcttgtttgggtgagcttctttaaaagcacttctaagacaagaaaataaaaataagaaaatgagatgaacttctccataagctaaaatgtgctctcaattagctaatttgtagaagttctctcaaatagcttttctaaaggatgagaggacatctacaaattagctatgaagagttcattttagtttatggagaaactcttttcatttgttgtttcttatttttttctcctagaagtgcttttagagaagcatatccaaacaagttctaaacacatgtagagcagtcgtgatagagtgtgagcctgagttgaatgtgcaagtactaagtactcttgaaatatgtatgacagaagttggttaatagatacgacaagcttttctgagagatacaagatggcgtcaatgcttaaaggttgttggactaggataattctggagatgtttaatcaatcttcatttagcatcttgaggtgttacatggagcataaactctgatatgtggatgtaaagttccatgtctcttcccaaggttaggagggcctgaggattgacaacctatagtaaggatgactacatatccatggtaacttcagtgtaaaatcaaaggataacaggatgtcaatatgctatctgttagcttctccttgtgtccaaccaatccaattctgttctcaaatgttgcattgattagttttagaatagttttgcctttggtctcagcatccactttaaaaagcaatcgggatttcatttgttcgttgttatactcctttccttatttatcaaaatgtccctcaagtgggatctataggtatccggctacctatccaagttgatgttgataaaaaaacagcagcatcaaagctgtttccagaggttctattacttgacctcatctatagtatctgtgattagctttacaatactcatgtctgctgttcttagaaaatgcttaggtgttggacccttatcaactactctgtataagtcactcgggaacaatctaaaaaaaattgctattttgttgcggtatcatggattcaagaatcatacactgcatataacattcaaaaacaggctctctcatgtgtaatgcttttatttatttcttctcatatacttagaatgacaacttgccctgggccagatttgtatcaggggctctgaagttgccaaagaaattacctaaattttgtgatacgaggactgtaaagcaaaaccatttcatcttaaaatgcctcttcgcatttttgccttttacctattggtagacatgatcacatgcctgcttgaattactggaatgcaacattaggctgaaaccatttctagaatctggatcagtaaccgttagttagctgtttttatcattaggcagattttctccacccaaaagttttaccttgctagagcaatggattaaccgcgtttccgaatttgatatgttgttactctctgttaataatgagggagacaacggtgattgcagtgattgcaattatagcagtaaaaataatgatagttgtagtaatagtgctaataatagtgacaaatatgttactatctgttaataatgatggggacaatggtgattgcaattatagctgtaataatgatgatggtggcaaaagaacataaataatacttttttaataattaattatcaatttgagactgtttggaaagtaattacatatctggggcaattggttacgctcagaattgggcatgatcagtcacgcccagctccaggcgtgactagggggtggtcacgcccaattttgggcgcgttccacttcagggcgacacgtgtcatgcacagatggagcgatgcgtatataaacttcggacggtcataacttttgactggaatgtccgattgagacatagtttgtgtcaaaacgctcgaaattgagagtagaaaccctaagcaaattttcgaaggggttttggtcaaaaaaatttcaaaaaaatgtttctaagtacctcaaaattatgatttaatcttcgaacatctaaaaattttctttttttctattcttttaattatttggtcagttaattgcatgctattttttatttttttaattacctcttttaatttcgagagttttgacatatcgtacacctcgaccggaaatttctatcaaaagttagaccaaaaacgttattttttaatgttattttctatcaaaaaaaatgtttattaaaattattaatagcatgttcccattctttagaagcaaatttcatgtgtataattcttgtgggatttgcctagggcttctactctcaatttcgagtgttttgacacaaactacgcctcaatcggacattccagtcaaaagttatgactgttcgagtttatatacgcatcgttccatctatgcataacacgtgtcgctctaaggtggaacgcgtccaaaattgggcgtgaccacccgtctagtcacgcctggagctggacgtgactggtcatgcccaattttgggtgtgaccaactgccccatatgtgtaattacttttcaaataatccaaattgataattaattattaaaaaattattatttaggattttttgtctgatgatggtagttgtagtaatagtgttaacaatattgataattgtatgctaccactatcatatgcaaatggtagctataaagtaatggtgatgatataacaataatagtagtagtaactagtagggacagattgtaaatgtcactggtaacgaggacaaaggtaatacaatgacaacaatcagtgtgagaatagtacaaacaaaaatgttgcgtagaataagagaattttattatatgctctgtgtttccaatcagcttttccttaaaataactttaattttgaactaatgaattggagttaaattttggagaaaagctaaaagtagatgggggagagaatttgttctctccatctccctttcttaaaaatcaaaataaataacaaaaacttcataaaattgccttcccttcccccaaaacaaatactaaattagccacaaacttgctaagaaaaaagatttcttgctatcatattcataccaaaaagagggtattcataaagggaatttaactatatataacaatggatattgaacttggagaggatatggtatataccacatggagctacacaagatgaatatattacaaaagcatttataactattgagtattgacaacaggatattatacgacgataaacaacaaaaagaaggcaaattcagactagaaaaataaaggaggaaaaaagcatgatgaggggggctataattggcagaaccatagaagcagggccttgaccttccccataaggcacataggtgtaaggatttggaggtccataaccataaccataagtgtaaggtgcaggaggggtacaacactgaacacctgcagcaggaggacacttagattggcctgacttgtgtggtgatggtggtggtggagcaccatatatagagtagccagaagatggaggagctggctgtgacggtggtggtggagcttcataagaaggataaccagaaggtggtggagtaacctgacaattctcacaagaagttggggttgggatcacatcacctactgcatccccataagcttcaaaattaaaattggactgtgataaccagagagttacaactacaactgccacaaactttgctccaaacatttctttttctctcaactttaatgttttacttacttcagactagaaaattcatttataagaaggaaaggagtgtggagctgggagataatgggaattgcaatgatgacctcataaatgttggatatcgagccatcacacaataatcgaaaaaagataaaaagataaaagaaaagaaaaaaataacacacagaatttatctaattcacccaatgtagactacatccaattattcattaaattttgttacacacttatacaattatactcaaattataataaaatatatagacttaaaaatattaaatataataattattcatggacctaattctaaactacaaataaataaaatacaaatctaacaaacaatattagaccttgaaaaaagttctgagacgttgtctcctgtccctgttgggaagacatatcttctaaaattacagtatgaatcatacccgaaaaaaaaactttagaaggaaaagagtgttctagatttggatgttttcatttgcaaccagcacctgtttttaatgcagtcttggatcattcgcctccttttcttctacactagggagatggtgccgcatggcagcacatctgtcatgatattattgaagtaacacacaaatgtcttcctctttgcatgagtctctgtgctaacggattgttaaaattttcaacctttccttttcacttctactttctctttctttaattaaaggtgttttttttttcttcttagaacttatctttttcatcattgataaatgttgcactatcgctgataatggagttcagtacaatgatgacactaaaagctgaacaagttctttcaagtaaatgcttcttttaactagagatttttctttattgaacaatgacgatttggggggcaaaaaattactatattttttctgccatcttcaaaaaatcactatggttcgtttgtaaaaaaaggaaattgaaagatgaaaaaaaattaaaatgaagacaaaattttcgggagaaaacattgattatttttttttatccaaataaacaaaatatcccccccccaaccagtcataagattattttctgtgtaggaattgttaaaatttcgacacgacaaagccgtaactatgtaagtcttgcacaacatctaattaatcaaaatgtaaaatctgtggtgttaaaagaaatacatggcaaaaacagagaaattatggtttattagacgcaatgctaaagttgcacccgatcaaataaaatgaagcctagctagtgtgatcaattggtcataatcaccgtgtctgtgcctaaacatgaaaaatccaggaaacaagaacgtgcagctaattaacatctgaaatgtgagaaacagatatcattcaacttttgtctaagacccaaagcgttgactgaattggaagacttgtccaagtcatggctatttaaatatagataactcaattgctcctttaaatatgatgagataggtcgtggagaaaatccagcatagcaccttaatttctaactttgctaagcataattcattttcatacttgaagagctcgtgcatctctgtaataggatgggcagcatattcctcaaacggcatccactttgtgacaaaaggaagaaatacatgaaaattgaagtcaaaagaattgaataatatacagataaaaaagttaagttatttatataacaagtttacataacatttatttcttttctctctatcactttaaccaccttatctctcattattgtatagtttttttcttaaaaaaaaaaaaaaaaacgtagaaatagaaattacaagatgattaccaacaatagcactacattagtacggaaaacatcacttagatatggcagtgtaaagttaattagtcagcatatatgatttaagttctttagagaaaagggtattaccgtattaactatagttagaaaaaagataaatgaacacttcaaatgttattaaacacttagtaggtgagagaaaaatgaaaaaatataaatattatagagtttatgatatgataaaaaagaaaaataaaatgtgtcgataggatgtttgaaagaatgttcgtatctaatttaatatggttggagaggctcaaaaaattgtaaccttaaacatgtagaaaaattgccaacaaatagaaccctctatcgtatgtgcatgtattaataattcaagaatccacatcattcttatgagttgcatggtcattttccaactatgcaagggacgtgatcgatccgaacctacgcacgagataattatatgatgctttatgggctaaaaatgtggggacaaaataatcacatgtggatagtggtcatataatccttataaaaattttggtcgcaattaaaatgtctagtaatgcttaatccaaccaaacacagtttggcgtgtaatcatatatattcagcagagtaatccaactttctatcatattatgtcacacaaacttcacgttcacgcaccagaatgaaagtcattttttgtttgccattgaactttaatttgttgtagagagcatgcgcattaaaatgttaggtgtaaatatatatatatatatatatatatatatatatatatatatatatgcgtcgcttggctcatctgttagacaattaatactagctagtcctaaagaaggatgcttcatttatgtgtcttgtcatatatatgtcacttcttatgtgatccggtcttatccttgcaaaatatctatcatttgttgggtgatgagaacaaaaactactttgtcacttgatatataaaaattaatgataaactttgttaaatgtagacatgcaaaacatgactcgatcagatatggcaatatagtgtgtaaagttaatcagttagctcattgatcatttgtgacatctttacatccaaaccaaataaaagaaagactgtataccttggcagcatcaatttccaaatcttgctttttgatgtcagtagaaagagtacgcaacatgcaaaggaaaaacagttctgatttcccaaatagtgaattatgtgcgtgcctacaaatcataaacatgaggagcagcttaaaacaaaattaaaataagagggaaagaagaaaggcagattttatgagaagtaaatctcaatcatcagtgaaggcaaagacaatttatatatttacattctctaatgctaaaatcatgatgaagaaaaaagggtaggagacagacatttagttcagtttctaaagtaagtttgaggaagaaaattgagacctgaatgccagtaactccacaaattctgtatcaatctgaacaaggaaagtaaatagcaaagttgagttatattaatacaacataagaaagggcgcgcatttaattaacaacaaatataaaatgcaacatagcaacattttacatatcgacacttactcccgtctcttcttttacttctctaacagctgcggctaaaagctcctcaccctgaagttaccatgttaatttcatgtttctacacaaattgaaatatttatttttcaacacgtggggaggaatttttggttgaaaatgttcataccgcttcaactattccagtaggtatcttccacaggccagtttttcatggaatgtacctcttttttttcctggactacaagcacctatatataagcccaccataagaaagaaagaaaagaaaagaaaataattaagagaggaaaagtaattaaagttgtaaaatgaaacctactagttgaaagcaaacaaggaatcaattataaggaggcaaccatatattatatattgttgttatattttgaacgaacctctttgttatcatttaagacaagaccaccgatccttacacgcacggtgggatgcattgggagggattgtgcagcttgtttcaggaataatccaataaactagcattagatagtttggttcagcatggtggtaccggaaaccctcctgcatcatgccaccaacatatatattcattgaaaaatttatatatctgacaaaaatgagataacatttttattgaaaatagtttctctagctcgatcccatccattcgatcatttccattgtgatttcacgataaaattgtcttctgatactgatagtattcatgatgaactgaatcagtttaatataaattacaaaaattaaattaaataattgaaaaaactgaataatattattaaattaaatttccaataatttcctatttaatagtgaaaactaacatgatcaagtttaaattaaactcatatatatatatatatattgaaaaaaaatcaaatctcatatcgactaagataaaattaaaatagagtatataagggagaataatcctaattttttaagctagtttttgggattgagttagactcaaactcatattttaagaatttaatcttattgaactagcttttggggttgagttagatccaaattcacattctaaaaatatactttttttttttaagaaaagaaattagaatctgacaaacatttccatctggatttgaaaattagataatttaattaaaacaatcttatgtagctgaatagatataccttatccttgtacaaggttaaagtaattaaaatctgacacaaacaggaaacattaccttaactgcagtttcaacaagattaactaatgctgtaggtaacttgatccaaacaccgcattttgcctgcaacgtatattataattgataagatagtaggattaatgttatggtttctttacaaatcatttggatagtatacttttttcaaattcataaatgttgatactatcttgaattaaaagttgttcacattttccggctgaactagtctttcttagtaagctgattatagtatgcagatattacatgatctgtttttcaaaatcgaagaaaaataaaatgatgagattgaaaagcctaatattgattatataacatcttgtttctgattgcaaatatatggagcatctaaaaaatgataaaataattcatggtttcacacgtggtttcctcattcactcgtctctcccattatctctagcctcgattactacctatgatgttctctctctctctctctctctctctctctctctctctatatctatatatatatatatatataaaacaaaagataatatttttttatcttaattataacagatataaagactactttaatttattgttaaatttattttttatttttaatgattactttcttttttccataaaagtgtgtatttaattgagttatatcaacaaaataagacacatttattgattgaaatttttttattttaaaataatcatattttaaattatttaatgttataaataattttgaaataaaattaaaatttatgacaaaacaattaatctaactatttttatttgtcatgatgaattaagtaattattatttttatataaaatcagggttagtataaaatttgctgagtgacgtgattctgaagcaatcggtgctggaggctaaggttttcacgggaagcgaaaacatgcactcaagcctatcgcaggatctgtagatgacttatccaaacaaagggttgaaagaaattaaggatcagtgaagcttaagaattttataaacaacgaaaaattgtacacttacaagacgagtaattacacttaattttcacgtgaattaatatcttattttatgaaccataatcttaatgaagttgaataccttaatcttaatgaagtatgcattgatatcgttacctgtttcttccattttgaaagtgatgttctaagcagagtaacgaaaatttcagagtccattggcttctccaaatctacaatgactcctccatgggcatcatttgtggcagggagaatctcaaaatcaccctcacacaatcggtcccctgaacttggtaagattgacattggctcaactgaatgttaagcttcacaagaagatttaactatagaattatagctagggattcaaaaggctaaagtttcaaagcataggatagggggtagaactaatcaatggaagttgggaagtggtggtacaaggttgcaatttataatgcaaaaaaatgatattgggcaaacatcaaattctaactgatagctaaaaaataaaatgaaattatataaacataggttaaaagagttaactcacttggttgactaaaatgcataaattattataaattttatgtttttaattcgtatggataaaaaaaaaattatataaatatgtataataagtgatatgatgctaaagagaaataaaagagaaaaatgaatattaattaaatctttgaaatcataaagtgttaatatgtcattattcattataactatctgaccacaagcatataggccatggaatgcgcagctctcgtgtgagttctcaacggacatgccataaattgtcatgtgtttctagaaaaagtttactttaagtgatcattaattaattcatccgtactgtacgatcaaatttatatcacctcaattatactattatagtgagtatagtttgtaaaattaatatgtctccctatttaatactttataattgatagtacaattggaatacacggggattcttaggtaggatatgattgcgcatatattgttgaatgctgggtggggatgtagtcaacagtatgaacaagattttgatttttcctttttcgaaaggcagaaagttgattgtcaaattaaatttaaaccttaggtctatagtgcaataatacgtgcctcacaactcgcaagtttcgacttgacttaaggggtgtttcacgttcagagtttgaagtatgaagggttgttaatttcatgtagatcgatcgagtatcatattcgtatatgtaatttgtaagctttaaaactatatatatcactgtatatctttggcaacgctatacccccaagttaatattaaggatagatttttaattattcatatttgaattataaatgcctttcaataagcataaggggttggtgtaactaataacaagtcatacttttagaggaaaaagtgcctatcgaaatgcttttaaagacttaaaaaaaaaaaatactttgcagacttcagtgcactgtgcacaagagagatttaatcatttcaaggttggataaaaagagttttcaagattgtttataaagaaatctatcatctgaaattcagaattataaatatatatggcaactagcgagagatgaataacgtcctcaaattaaaaaagaaaaaaagaaaaaagaataatatttcttagacaatgcggagtactaactcattgggctcaccaggcccaaccataaaaaagtattgagccgaaatatgagctggcctgttttcactccacatacatgactaagactttcttattataatattattatcacaaattgtattagtcatgtacgatcaaattactttctgaatttttatcgttacacataattaaatatagtttttattttcttgtacaaattctttttaaatttgaaattaatacactaacactttgttttatgtttaaaaacatatttcactgagatactcttaaatttttacactaatactccctataaaagagtgatgaaggtgatgatattgataaggagtcccacatcgtgcggggtccctttctgccgcaagaaaattcttttgttggtgttttcccagtgatccctccaatagttcgaaacccaacaatgtgaacaatgatgggtgggttttatggtgatgtgtcaagtggtggtggtggttctagtagcggtgccaatgtttgctatgatcatcatgttgcttactttaatcgtgacaactcctttgggaaccggtgagatctatttggcagaagtacaacaacgatccaagaaatgcatttagtgtggttcaatatataggaggtgtgctacaacgtgctcttttatacattttgtttttagcttttctgttattgttttaaaaaaaacgtgtgttgttttgtcatatttaaagttgtcttaaaatgtatggaacaattaatatattaagtatggggtctctttttcgtgcccctatatcaagttgactgaatgtaaactatagtgtgctcagtaattgattatataatattattaagctagagtttaatttggaggtactttcagtttaatttttttaaattaacatcaaatctgtgttgacacttcattatttaataaattttactaccttaaaaccaacaatgacactagactaaattttactaccttataacatcaccacgggataaaagctagtttaagcctatactaacaaattttctattgagaacaaccaactacttgaataaatttcaataaatcagggcttcaatcaagaatatccctggctcaatttttatttttttagaacaaacatattgcagagatccccatcaaccgttaacaaataaacttaatatactacatctaactcaaagtcttaaaggcattaggtataagtgttcttcgcactttaagtattgctcaatttatcaattcctatatatattgcaagactttttcactcacttgttatccaaaaaagttaaaatgagcaacttcaacagtagtatttgcaattcgattacataaattatgtgatatttatttatcagcaaatttacaacacaaaaatgaaaaatcatctgtttatagaaaattggctcagatagcgatgcgcagtggctcttgcaaagacccatgtctacagaatgtaatgcaaaacagtagtaatcatttatcatttaagttcaaatataattgttgctctctgatataatcaatcacttcatccgcagtaaggtattttatagatagtcctcttgcaatgcaatccctgaaattagtgaaaaagacaagaaaattgaacgtctctcttttttaaaaattatcgtcctgtaactcttgaaagtaaacaatgtcatagcattaccttactctggttgagctgatttgatttggaacaagttcgttcacaactttgatattatcctaaaaaaatagaggagaatttaaatatgcataaaagctgagtagcaaagcaattcattctaattcttattcttgttcattacataacaaaacgctgatacaaagtctggtcccaggaattttgtttcataactgaatatttgaaaatatatatatatatatatatatatatatcttatagtttatatagtactagtgtccttgaagtatccatccatactttgaaggtatcatggttcaagtatccaagtcatacaggaaggtccagtatacttaataagtagtatccgacacatgtcaaacaaaatgtcaagaaggtgggtgttactgcagcacatgtctcacactccgacacctcaagaaagtgtccaaggttaaaagctaatcggtaatcaaggttgagaggaattaatcaattctaaccaatcacagcaacaaaaaacgatgtgcactagcacacacatgtacaaacaaaaagataataaattttaatcattaaatttaaaattcccgtgttgatcgaacatcaacacacctaagtatatgggacatcacagaaggatttcataagttggtctataatttgaccttaattcggtaaaatacaaatacacagttaacagatatttgaaaatgtccataagccacatttcattttaaacgcatatggggaaataggacaagcttgaaatgtgagataccttattctcattcagaatttcatctttagatatagtcttctcaacatcttgtccttccctgcgaatgcagactactccataatctttgcatatagttttaacctagagtacaaaaacaaaattatagttcattgtttccacaacctatgacaaattagtattcattaacatatttggcaattcaatcgttttatccactaaccgtccaatccatcaagtataaatcaaccaatcaatctattcaattataaaaataaaacttaatacattagttgaattggattaccaatttgttattggatagataatgaaccatccaacatattttgcaatccagtgaatcaagtagttccaagttcattacttggacataggtctttatgagacaaatattggattctatggtatttgggtgtaagaatgtgtaaaatattaaactttgttttagaaaaatattgttttgaaaaaaataaaatataatggatggacctttttttaatgaaataagttatggatgaattagatttttgtaatacataattaatggaccataaatggattcaattcaaaaaaattatccaattcattagtttgacactcctaatctatactccacccatgccttgtatctatgtggtaagaaataagaataattgactcaataagcttgttaattctaacaataaaaacacaaaatcaatataattcctctgactttgaattccatgaccatttaaggttggtttaccaaaattattaggtgggacaaggtattttgttccaagaatcattaaataactccgtgtgaaactaatctatgataaataatattagatttttccgttatagtacctggtcaggaatccagaatccaggaatgctaaaagaatgaaggagatcagaaccacagagaagaatgaccttgagggattctacactaatcaatacaaaagaaaattattgcattgttacaacattgtcaaaaacatgcatagaaagaaatgaaaatctagcacaaaaatttttaattaatgaagggaaggaactattaatgctccttttagactaaatcacatttaagtcaatgaacatatatatatatatatatatatatataacttttgaagtgcatccatatagcaccatatggaaccaaattgcccgtccaatcatgcatccatatagcactaagaaattcccacaaaatactagagtcaaatgaccacctaatgccagagacaggaaaacatgtccaaacattaaaatccatatattaatcatttaaatcacaaagtattcctaacacttagcaccacattttttaaaaaagttcagcagcagtacggattagcattaatgtgactagtatttcattcttaaaagagattaagacagctggtgtcagtgtcacttcctttattttgaattttaagatggggcaggggagcaatttgaaatggcaattagagtaatgtgatttcattgaaggcttgtttgttgagcatacctctagataccaaccctgtctcacaaactgaattctggactctggagagaacagttaaagtgcgttgatatgtgctctgacttgcctgcaacagtttatagccggataaaaatgcaaaatattaataaatcaggttagctagagagccaaatatttctcacaacacgcatgacatcaaagcactgtctctcaaattcaaatctatggataatgaaacttattaacatgcacagaaaataggaagacatgcaatctggctgatagaaagagtaattacctcccatggatcaaccattataaaatctgaacttttgcaggctaaatgacataattgtattcgatgttcagcagatattaggccctatataaacatgcaagcaaaatacaattagaccaacatgtggcagtgaaactaatagcatcacttgattaataaaaatcataatttcattaatagaatcataggatttgatctatttgctgaaaaaagtaaaataaaaactcagtcaagtgtttcagtgttttccacatgccaagcatatgttttaccttatttattcatttattttgctaacaagttttacagactcgcatgtatggatataataaatgaagaatctttttctctctttgcttgacaacttcatacctttttcttgtatgcatcattcacaggagacaagtaacctccaattacgcagtagccatctgaattcaacgcatctcttgcaagctctaaggataacacccacaaattttattttaaaaataaaataaaaatcagactagcagaaaataaatgaaattaaaaattaaattgcacgtaattcaagaaattaagttaatgaaattccatcaagaagtatgtgaattagagggaatattcaacatatactcccattcaccttcattaagaaagtagaaactcagagatcatgactcaaggaagctaacaatacaagaagatacactggtatgaattgttcccaggcaaacccaactgttttgaacatctatgtagtaagtacagcatagaattttcaataacaaattcaattatatgtatatggattttataattataatattaattcaagtagacaaagaagactatattattatataatttatagtgagtatattttaacaatggttaacatatggtttgatcacaaaatgcaaaaaaccactgtaaatggtaaagtgattatcatgcatgcagtgttggctactacactattgagcaaccattgacttttatttttttttcacatgatgtatatgagatcttaattttttccccttaattcttctacactgaatagaaaaatagaaaagtgtcaaattgttcaataatcaataccttaaagaatgaacttatattcaagatgtcatttattttgttagaggagtggaaggagttaaaattattcagatttgagttttataagcaccaaagaagtatagatgtctcagggcagtagaataacaagtctctgcactgtaaacttaaggaaacgcaactgaccaaacatgcgtaaatgcatgaaagtaggtggattaaagcttccagttgccaccagaattacatatatcttgctgctgttttaatgagagacagaaaaagaatgtcataattaattcataacaaggtcaaaagaaaagtccctcacaaaataaataaataaataaataatacagacaggaacatacttgctagtgtttgcaggggagggttcattattaatcaaatctaaagccaatttatccagtggcagtggaacatccatgacctgaaaccattaaaaacaagcaatgctgaaatccaaatgcaaaataacttatttttttttccttgatggattaattgaacttggaattccagttacaagctccaaataagttaagcacgaagacatggagtttcaagctcaaattacaaacatgaatcccaaccatgtcttcctttctaataaattccaaattagtacctattatttgccaacaaaaagcataaacaggtttcagacaaatttttaatttctgctgtgattctaaaaagacattgtagtgaattaaattacagagagagaaccttacctgggtgtgttgggtgacggattgagggtgctccacgaagcagaagcagaagccgaggatgggcagtgccaaataagacgatgaatgaaatgaaaagaatactatacatacaaatatatagttatatacacttgatgagaaccagtgcgttgaacacgaagacgtcaaattccaatactccatgccattgcccataccatacttcacgcaacattgacagggtccattcaaaaaggtggcccaacaatactaggaactttaggctcttgctatttacactcattttatccaagtacacccctgtacccctcctctcaattattcattataccctttttcttaaagatgtacatcccttttacttttcagaattacatatatttatttcagaaatatatttttggaactctaatccatagtttgggagatatacttccaaaatatatatatatttttaataaaatatcatttaagaattaaaatggtaaacaagaaatgaaataaaagatgataaacatttatctaatagctgtttgttaatcttattttcatcatatcattaaaatcttattttcatcttatttttatgattctttaaaccctaattttaaaactattttcactatatattcattatataatattgcattttcatcattattatataatatattctttttcttcatgtgacattatattttaaagtatatttatcactaatttcatatattatacaccttaattacaatttacaaagtaaaatttttgacaatagtttctctcatttaagtgttgattattttttaattcaagtctacctcattcattcatattacaatgactactttggttgatgtatgatttgttattatggaaaatgtctttatgaataatgtatatcgttcactgaagagttgataatagcgtataccttaatattataaagtcaattttttttaggataaaaaactaagttgataatgcacatagacatagtgctaaaaaaatgcaaaataaagatacctagcctccacatgcagtacacacaacatccacttctcttctccattcattttcttgttgattcttggagccacgtacttcatggccatggatttcactttcttcttcttcatcttgacgttgttattgttgttctcgtgggaggtggcagtagcagacaacgtgagcttcgactttccttctttcactctcaacaacatcaccctcctcggcgattcctctctcagaaacaacggcgccgtaagactcaccaacgccgcccccacctccagcaccggcgccgtcgtctacagccaacctatctccctcttccacgcctccttctccaccaccttctccttctccatcaacaacctcaaccccacctcctccggcgacggcctcgccttcttcctctcccccaacaccaccctctccggccctctcggcctcccaacccccgccagcttcgtcgccgtcgaattcgacacgcgcctcgacgcgcgctttgacgacccgaacgagaaccacgtgggcttcgacgtggactccttgaagtccctcgtaaccggagaccccatctttgagggcatcgacctcaagagcggcaacaccatcgctgcatggatagactacaacacccaatacacattactgaacgttttcttgagctattcacgttcttcaaaacccctcctacccctcctctctgtcaagttcgatctttctcattacctcagagaccccgtctatgttggcttctccgcttccactcagggaagcaccgagcttcaccatatcaaaaattggacctttcacacagaaacaatcatcaccacgttgcaccaccctcataatgtttccgtggtgggaatttcacgttctggtgccacgaagaagcgtgacaagagggttgttggcattgttgcgggttctgtttctttctttgtggctttcacaatattcttggggttcgtttttgttcggagatggaagaatggtgggagaaaagatagagagaaagacaagtttcagaagagtggtttcgtggcttatcctagggagtttcattacaaagagttgaagtctgctacaagagagtttcatcctagtaggattgttgggcatggatctttcggaacagtgtttaaggctttctttatatcttctggaaccatcgctgctgtgaaaaggtcaagacattctcacgaagggaagactgagtttctggctgaactcaacaccattgctggtttgaggcacaagaatttggttcaacttcaaggttggtgcgttgagaagggggagttgctgcttgtgtatgacttcatgcccaatggaagcttggacaagatgctttacaaggaacctgaaagggggaagcttttgagttggtctcacaggcaaaacattgcactagggttggcttctgtgctggtttaccttcaccaagagtgtgagcagagagtgattcatagggatattaaggctgggaacatattgctggatggaaacttcaaccctagattaggggattttggattggcaaagcttatggatcatgataagagccctgtgtccactttaactgctggaacaatggggtaccttgcacctgagtatcttcagtatggaaaagccactgataagactgacgttttcagctatggggtggttgtgcttgaggtggcttgtgggaggaggccaattgaaagagaagggtctaagatgttgaatctgattgattgggtttgggggcttcactctgaaggaaaagtgattgaggcagctgataaaaggttgaatggggagtttgaggaggaagagatgaggaaattgttgcttttgggtttgagttgtgctaatcctgatagtgctgagagaccttccatgaggagagtgctgcaaattctaaacaatgaggctgcaccacttgttgtgccaaaagtgaagccaacactcaccttctcttctgacctacctctgcctctcactattgaggacattgtttcagaggctgatcaagactctatgtgcgagatcaaaattgactgatcaactcaacttattcttttcattctttaattgtttccggtgatcatttctaatgctatactctgctattctgtagtctcaaaaactaacgagtcatatcctacatagtgatagttcattcacagagctaatacactgaatttcatgtggctaataagctatgtatgttcaaagcgcaacagacgaagcttattttgttgttttgttttggtcatagttctaataagtaaaaccgtgttttaggtgctctcattctcatggtgtttgtacagaatgaggaaagtagaaaattgacatagatgtttgtatattactactactaccaagtaggattaggctgatcgggttttgtacaaaggcttatgacttcagcaataattagcaatcatgctgtaatgtttcatttcagaatttttaatcagagcccctattaataatacgggccttggtctcattctgtgtcaaacttaatggtataatttgccagacaacttaattttcaatacaaataatatggaattgttttcttcactgaaacaaaagtaaatcgcaatagatactcacggagaagtaggggaaagaggcaaagagcatgttaaagccttgcataccattgtaaaagttacactttcaaaaacattacatgtacatcatcccaataaaggattgatgtaaacgttacaaaagaggggagtttgtacaatctcaccaaaacctgaagtagggagtttaactgtaatctactctatttttatttaattactcatttattccatatatttgcacaatctttatattttaatcattgcacgtatactttttaacttatttcctacatatacatttttagtccgttttagtctcggatgacaagtactaaaagaaaaatgttatgttgtgaaggtagctagagcataattaatcttaatcatgctataaggaggagcacacatcgatcttagcaaagaaatgaagccaatctctgcgttgttcgcaatcttgtctcttctcctggtaagcttttctgaagcaactcataaatttgaaacattgagtttgtcatgagatgcatggtttatgacttttcaatgttatctctactaataggttgccaacatcaacttaagccatgcaagaaaagacctgggggattattggaagaaaatgatgaatgaccaacctatgcctgaagcaattaaagaccttgttcaagttcaacaagtatcagatgcaagaacggatcattttataagggacttcaatataaagcctaatgtcattatatcacacccatgttaacgttgtgccaagaagcagaagcaaaaggcttttgaccgcaagtttataccagtctcaaggaacggaaagtcatggtaattgaacaaaccatcaaaaagggttgaaggctaaagatgttagaattagtaataacaagaaaataaaactatgtattttttaaaaggagaaagtaaaataaaaactatgtattaagcaattaagattgtacccagcaaaaaaaaaacaaagcaattaagggtgctactttgaatttctccccatggaatgaatctctttattaactccttgagtttctttaaaaagcttcactattttttttatatacatttctctttctcacctctaaaagaaattgatttagtaggtggcagactgacgttacaataatttttttgtcagtttatacatatgaatataatttgaattgctactgttcttcgctgtcacaattacaagtttcgatgtacctctgtagaaacgctcaattgtatccgttgtccttctcgcattttgcttggctattttgtgcaaacatacttccatagttacaaaattaattcaaatgttgatttttctaatgagttttcaactttaggttatgtttaacaaaattcaaaattagctgaaaattaactgtaatcacaaactgaaaaattaggttactaaattttaaatattcgataaaattaactaatgaattagttgaaaagtgtcaaataataaaaaacaataaaattataatttatttaaaaattataattaagaaattagataaatatgttaaaaataaaaatataaaaaattataagctagatcttttaaaaatattacttaaaatgattttaaaaaaatattagaaactacttataaaatataaaaatttgtttatcaaaaaatcaaacaaatttttcaactaataaaaaaaattacaaactaacttaaatattttgttaaatattcaaatataattttaatctatatctatataaaaattatactattgtcatcatatgtcataagttgacagttttacctttttttttttcattttttaacattttgctttttctcttttcttttcttctttttccccttttctgtcacgtaaaacaccggatccacactcctagtaataagttaaaactctcccaacaagaaccatcgtcaccgctgtggacctggcaatgccatgcagttttggcgtttcagtttgatttttgctctgtaggcttcatttgttctaactttgtgacttgtgaggaaagcaaatttcccttgacacgttgtagacatgccgtaacaatcgatatcttactcatttcggttattgtccaatatgcatgccaatgcgtttatataatttggaacaaccaaatgtaaatgctgtcacatcctattagctcatgtacaacttaatcttctaactcacgttctatttgcacctgtgtatatcttaatctttcatatccaaaatatataatagtgaatattttttttttaacacaaacaatttatttcaaactttaaaattaattaagatttaaaaccttgaatcatttaatcaagagacaaaagccactgtctgctttagttttatatccatgtatgtaactatgtactggttttcctacccattatggtggtgcataagcgtgctcattaaaagcgtgttatatacaaaactagaaatttgacaagaagtaacaccaccaaaacaaaaagaaatgaaaagatcgaaagtaagaggtcattttctgagctgagctagctgaaatatgaaatatcagcatgccattaaattcccgcagaccaactaaatataaaaaggttccaataaaataatattttgacaaatattcgccttaattaattgtagaatccaaattggctcttgtgtcccaaaaagaaaatggctcctttgttggttgatgatttggattctcacattttcatcatgccaccgcgcgtatatattcacaaatcatcacaatcatttctctcagacgattcgcaacaaattatcagtgtattgacaaaggaaaatgagtaagtaaacaattttttattactgaatgtgttcctaatttttccccattacaaaaattgttcttggaaataactaggaaaggaaaggggaagccgctgaggcattatttatttctatcttgaactctgcattttgtattgagaaatgttctttggtcaccattttctcccaaattttaacagcagaaaactacaattcatggaatacgtatatagtagtatagtttaaaatcaattatcagttatgacttttatgtaggacagttctatatgttatgaaaattgagtttaatatatatatatatatatataatattaatgtaattttttttttacattattactatatcaaccaatacaaatatgagattaagggtgatgtatgaatagtgtaaattaattttatatctaataaaaaattattttttatatgaattttaatatatttattataaaagtcaacataattatcatatatgataatttatgattatataattaatgtaaaattattttacagttgtgagtgagaatatgacttgacctgacttacttaataattaataaaaatgttagacttgtacttttaaaaagacctatttacttaaataggctaaagttaggcttgtaaaaaaaaattattaggccttgtctatttatctataatatatatatatatataatactaataataacattattaattaaataaatcaataaaaccaaaggtcatattatttaatatatcaaaataaataataattaggctatgactgacaatataatctgtaagttactaatagtttcacggctttgttgaatcatatggcttttatcgttctacattagtttcccatgtttttagattagctttttttctttatcatatgtcttttaagttagccttttatgttagtactttttctattgtatgttacattcgttttctttttttgtctgttttaaaaactaagttttaatagcaattatatgtttaactcgacatatttaaatataggtttgttagcttatttaaaatttatcttgttagtatacttttaaatagactaataagatagattaaacttttaaaaaggtcagacttaattatttatataaaatctagtataacctattttatttttatccctattagtagattaccattgaactctaagaatattcttgatattatttttactataattatggtaaaattcaacgaatataaaatagagtttcttatccacttttatttcccttttctttaatttgaattctgatttattttattttttgaagaaaaacatcatgcatgtattacagtgatgtcaaggaacattacaatttatccattctcatgtccatcgtatttgacataccatttcaatatttttgaaaacgacattatttataaccaatccaacctgaggcaaagaaaagcttcacataccttaaatggtataaggcagtacgctgcatgtacacgtctagtttggctagaaagcaaaggcatgtgaatgtgatgatgacagaggaagagagagcacactcccaacaaaggcaaagactcctttagcaattcccgggttgtgctctctctcttctgtcaacatgagatatctcacatcactcatcacagtccattcctaaccaccaatagaacccttcaagacatgcatttccactcgtgatcaagatcaccctgtccattatgaacaataacaccatcatgcatgcatttgaatcagaccatacatatataataattatatggcatgtggacctttcgtgtatcaaaacaagcatatttctattcctttccttttccctactctattcttggtctaaatatgtatattatatttataattaattaaattacatcaagtaagttttattacaaatcttaagtatcctctaactgaaaatccaagactaatattttgaagtattaaaatttatttaagatattaacttatatatatgtgtacatatatatatatatatatatatatatattgatattgaattcatgtgtatacgtacatacgaaagagacatgtttttctaccaatcatatgttaattatgtagtttatatctaaacaaaattaattttacttaaatcttcgtcttcttttatatatctctacaacttttagttaagatgtgaaactaattccttttaacacataattagtcaagtttgaaataatactaaaactgagaaaatggccctagccctaatcctgggaaataatagccctaaaactgagaaaataatactaaataacttcaagaatatgtagatcacaatcaagtggcagtgagtttttcagaaaattacttgatctctaaaatttaattcatgttttacttttatatatgctgtcatctatatattaaatccttcaaaatatcaatcgattttagatcttaggtcttatatttgcaaaaggatatattaggaggggggacatgtagctaggcttctcttaatgtaagaaatagatatctatgatgctgattagaaatatattattgaatgagctagtgtacttgtatatatactatattctttagaaatgagatggggtgtggggggtgatgtgcacaaagattattagtacatgatgctgtatatctcatcaacgggagttaacaattaagcatgaataattcacctccatatatactgatccttgtctttcttcttcccaaatcagcctcaccaattaaagcttctctccttctgtacacctatgcatgatccttgatatatataggaattaaagaacaaattaataatatggaagatctaattgagggaccgtaagaatataaagggccaacagaggaaagaaagggatcgatatgagaatgcaaaagcatttgaatcgaagattaatggagttatggagagggaagatgaagacattttttgccacctgaacaagatgaaggctctagaatgaggagagaaaaacgtatcaaataaaaactctatgaaagctgaatatgtcacaccatggaagatagcagttcttatataacatcaagctcattgaatttaaccgatcgtacggtataatataatatatatatatatatatatatatatatatataattacttagttaatgatatgctaagtacacatctctacatttgttagactaatctctgaacaggctagctaaaccacataggcatatatattagctagctgctcagggattagtctaataaatgtagaattgtgtattcaagcatatcattagctaagtaattaattaagaatgatggctagttgatcaggttcaattttctttaaaaaaataataataattgcatgaagataacccttttgtgtatcatgttaatcttaatttttttcagttttattaaataattcttttagatcgaaatcatgcacaatttattttattaatcaggcacaaatttgaataatctattttttcttcctttcatatataaaataaccgacaaccatatttctttaaaagaaaatgtgatttatatatcaaaatagtctaaaaaatcgataaaaataacatgttcaattaaaattatcttaacaagtaggcaaattataaatagttatattttgacactaaataactaaaagatcaaacattttattttatcttatcatcttatatcttattatatattatcatatcttgaacatctataacaaatctcaatcatatcttgattatatctcatcatactttatccctaggattaaggaataagatatgataagacataatttcaagaattttgacctaaaatataacaaaacagttccaaactcaagtaaaaactaaagtatgaagcacaataattaagccaactcattagaatttagaatatgctttaaaagattaactgacttcaattttgataccataagttattaccattttgttgttagtttggtgagtaagatacatcatcatagtgtgatataactgacaaataactttatcatttaaatgtgataattacttaaaatatgcatgtgtataaaaaaaaaatatttgttaagaaaatttaattaatctcttaatatctatgacaaggagttaatctttgtaactcttggctcagagataacatagggccaagattcaccctaaaaattaagttaaagatacacacgtaattagtaagtgcgtggaaattgcactttatataagttacgtacatgctttaagtataaaaaaaaaaaaaaaaaaaaaaaaaaaaaaaaaaagcaagaagttatgtacagctttgtaggatacagttttcatgatcagcatacgtaaatttcagtttctcatatattttcttaagaataaattagtacatatagtaaattttacgctggcatgtgtcatctgaaccccaggaggacccactaaaataattactcagcagataacaagaaattaccatggtaaatcgattgaacacatgaaagccgaaaggtttaatttgagacagtgaagttttgtgccaaaatatcagagacctggagaaggtttgtagtgttcgaccagaaatgtgtcgtgttgcgtttgagccgcgaattattttagttaaattggctagagccaaggaactacttcgttgaataagatcttaggtagcattctgcacgcaaataaaatgagtttaattttcatgcaataaccctctttagatttttatataggtaactaattaaaaataatttcatgtatatacttacaatatataataatatgtaataaataatgttatataaaaatttgcattgtcagaacattctaataaattcataaaatttaataattcaaatgattgatataataatgtaagacttagttgcgtttatatgtatgagaaaaatttatttaataagagaattcatgttcagtttacaccttatcaaaattttttggattaagtcataatcatgtatcacgaataaaattagtttatattctagtagattgagaatcacccatgatctctgaactaaaaaaaatcataaaatataatgaaaccctttatctattaccaaaccaccccttatggacctgccttgctgttttgcgtttgaaattaatgtcagggaccagggtgtttgtctgtgtaggcttgtttgttatcacttgtgacttctgaccagagaggataacagtttacatgacacgttgtagacatgcacaacaattagaatcttgcttatctagttatagcctatgcatgacaatgcatagttcggagaagccaaatgtacatgtatatgcagccacggttaactgttgctttatgcttatcttcatcttctatggaacaactgatgacaagcattgataccatttctctaaggtgttaatatgaccaagaagattcaacccagttagtagatacctatgttccataagcatattgatagacatttgattccctaattgtgtatataaaaaagactttgttgagaaaaagataaaaaaatccattttagtgatatttatgcatagaaaaattaatttcatgactttcaattataaaaataacacttttcagcagaaaaggtgttaatatactattcactatagaaaactttacggtaattttttttttataaaaaaatacattagaagctaatcagatgattaaatgtccaatctagtattcaattgagtagtattacaactgggttcacgggaacaattgatttattgctttcagtaacttagaactaatttctaataatttaaatatcactttcattatataaactacgcaggaaggcccaaagtaaccagaaacaaatcgcttgaagattacattactgtttactatcatatactaaaaaagccaagacaaaaacgaaagtaaggactctgccaaacgaaagtaaacatgttttttaaaccttaacagaatatttttcccacaatagcatatcatttctaacttgcattcataaccagcctttgctatgcaacttcaacaattacggactaagatcagctattaactctaaaattcaaggtcctagatgttccattcctctaatcgttataaacaaactgtaattagcagcataacagtataaacagcattccctgtaaacagctgctgaacattacacttaaaggaatttcttaaagctgcatcagaatatgtattaagttggagaaatcttagaagcttggacattccattcggaactttacagtttaatcttctcgtatctttgcttattttaatgtcatcaattcatcatccttccaaagttcctggtgaaatagaacttgctgacaatctcatataaatcttttctgtggagagtaatcaaaatgtctgttctggaaatgcagtatctcactgaaggtaaatgcttgatttcaaagcatgatgaattggagagacagaatagaatagccgcaactcataagcagcctcttcatttttcattgaatttgaatgtcacgtaattggggatagagccacagagaattacttcctggaatttcattctataaatctagtactaaacgagctgcaaaggagctatctagtcaatgtttaactgggttggagaaaaagaaaccactgcttgtcacaatagctaaattgattttaaaatcaatttagagggaaaatattattttcactgtcataatcacagtactatttaaactacacgtgagtaatttcttttttatttccaaaatttctatatttacgaaaacaaaatttcgtcgtatattatatgcataattctattgtatatatattagtttaaatatattttttattcttaatatttatctgtatttgattcctaataaaaaatttcatattattttttatatttaaaagttttattttagataactgataacattatcacttaagttacaaaagaaaaaaaaatacatatgcgaagataaaatttatcaggaataaaacacaaaattaggatatatattagaaataaaaaacatatttaaacctatattttgacaaaaaaattaattaattacaatttaaataaaaaattacgaaaataatgtagtttccaaagtattataaatgtatagcagtcaatcatgtccacgtccacacaggacatgacacagcaccaatcacgtccattcaggacgtgactcaagaggtggcgacacgtgtcattttgaggcgcgatgcataaaaacttccaaaggtcataacttttgattggaatgtccgatcgaggcgaaactggtagccacgcgctcgaaaacttgctcaaaattttttcccaaaagaggtctctaggtgcctcaaaattgcgattttattttcgatgacccaaaaaatttcttgttttctaatttttttattcaattattgaattgcatgatattttttatttgtttaattacttctcttattttcgagcattttgacacaaaatccgcctccaacgaacattcctatcaccacctactgtttttttggtatatttatttaccaaaattatattgtagatttttaaatgatttcggtttaacaaattaaaaaatgacaatattgtagtcgcaacactaatttcaacagttgaataaaattatacggtaaaattggtgatgcatataaacttcgaataatcataaattttgatagaaatgtccgatggaggcggattttgtgtcaaaatgctcaaaaataagagaagtaattaaaaaaataaaaaatagcatgcaattcaataattgaataaaaaaattagaaaacaagaaattttttgggtcatcgaagataaaatcgcaattttgaggcacctagaggcctcttttgggaaaaaaattttgagcaagttttcgagcacgtggccaccagtttcgcctcgatcggacattccagtcaaaagttatgacctttgaagtttttatgcatcgcgccgcaaaatgacacgtgtcgccacctcctgagtcacatcctgtatggacgtgattggtgctgggtcacgtcctgtgtggacgtgtttgaacacgtctgtctgggacgtgattgactgctaaacatttatatatactttggaaactacactattttcgtaattttttatttaaagtgcaattaattaatttttttgcccctatattttttcacttgcattatacaatatacaattgtgattctttgtatttttttaccacaaataacacaacacaacacaacaaaatcatattttctttgtgtgaaaggtgtaaaaaatacacaatagaaacatgatttcattgttatttcataaaaaatacgtaatggaatcatgtttccgttatatacttttttacatcccattttaattaaagagatgtattgaattaagatttgaaaagactttttttaataaaaaaatcttgtggtatttaatcaagatttttaaattgtataaataagtatagaaatattcaattaagacttttaagatttttcaataaaggctacaaaatcaaatggtattcaattaagattgtttataacttataaaaagtcttttggtattcaaaaatatacaatttttgatgaattatttttaaaaagaatttatcatactttttagtataaaacaatcttacccaaatccttaagattttgttagactctttttttttttctattggttatctgactttcttttctctcattacacatatattattctttctttaatattcttcaagatgtgtgtcatatatgtttatgttatttttttggaataaaaaaagtcaaacatactctttccctccacactttttcatttgctttctaaattaatgtttatcttttgtgataaggttaaccatgattttcttacctaactatgttcatcacatgctcgcaatgctttcctgagtgtcactcttaattttatcattcacataactagtaaccctcctacaagtttttcatcctcaccactcccttttatcccatttaaatatgtcattaaatttatcatcaaatacttgtagtaattatattaaaaaaataagaaaatcaacatatataattttaaatcttaaatctattgttcaaatccaaaagtgaaaatgagaaaattgcaataaagattaatacgagaacataaagttataatcaatttagttattaaaagattaaaaaaattatgttgattttaattttttttatccaatctccatcatttcttattcattgaatttaaaatcttaatccaatatatctttaattttaattgcaagttaccattaaagcaataaaattaattgtaatataattaatttatcatttttaatagtaattgatattttttaatcaaaattgaattaattatataaaaaaataccatttgtaaacgtaaccaaattaattattatataaataaataaccttttgttaacattaatcaaatcaatttatgacattcaagggacgttccaccttccaatagtaagcccatgtggatgcgtcgtcattgatttcttccttcctttcccattccacatcgttacttttttcaacacacattctttagtctctccctacaccaccgcacattgatttccgttcaacacgttacatatatatataaacgccaaaattctttcattttctttgaaacgccctctctctttctaaattttctcctccttttcctcactcattttccccccgccggaaaatcttccaacattgtattcatgtcggtatgtgtcatttttctcttactatctcaaatttctatgaattacttctgatcatttaatttgttccctatgattgctcattcatgttgcttgttcatttcaattttgctccttatatccatgaatcatatttcacaataattttgtttcattctacggtcacgtatataattaaacttgttttccatttcttgattttggtaacatgatcttatttgattgtctgacttttaggataaaaaagtatgtaacatatcaagtttattcacatataaggcttttcagtttaattatattttacacaaacaaatctgaataaccctcaggacacgggtcgaccactaccaaagtttggtgaatgggatgtgaatgatccagcttcagctgaaggttacacggtgattttcaacaaagctagaaatgagaaaaagacgggtggcaaacctgattcacctgcaaaggttaataatcctcgtacaagacctccgttagattcaagcaaaacacaaagtgtaagatattcgcgcatttatatgcttatttttcttttcttggttaataatgtatttatgtttcaaaagaatgaagaaacagtagaatgattgcctgagctacctatatatatatatatatatacacacacacgatgctaacattgtccttgattaaaaaagttaaggggatccaaagacccatatggcaacaatgattcaattacaacctttatgttgtaaccaaatatgatacttttattgatctctttattgaggattagtatagtctgatttttgtattcaatatgtattcaattaatatgtttgcatctagatgactggatgtctgctaaaaggttcattcgatatctagatgattagtatagttcattcaatatgcattcaaaaggtttgaggaacctttatctagatgtctgctagtagtgttgaatgaactatctaatttttgtctctatagttagttgatgtagtatagggataatttgttgaacctataatttgtttgattttttttttttttttgtatttacatttcccctctcatgaataacgttcatttgattttcagaaaaaatggttttgttgcatacaaggtcctcctgcggagtcatagtcatggttgctcttgtgtaaaagattcaacagaaaacatgtttataagtaactagtttcttccaacgaattctcaaggataggagttgagggtagtagatgaattatgtaagtgagtttgcaacatggagatggaagagtaaagaaaacaaactcttatccaaatatataaaagtggtttattgttagggggcaaaaggtgctcccttttgggccttgcattttgctatctggtatagagatttgcttgttacacattgtttatatttttttgtccataaactattttaaattttatttttagtacctcttaaaattttgcagtcctatctaatttcagacgactagttttattttcttttttaaaaaaaattatctatttttagtcatttttttatttttattgcttaaaattgacccatgagattaagtttttgcattttcttctcaagtttagatcctctcaaggaatagttttgaatattaaaaataaacaagaaattaaaatgaacacataattttttagggactgaaattagttatctgaaataaatttgaagagaataaaaatcagagtataaaatagtttgagtgacccaaaatttatttaatcttaaaaaataatatagttaggcattttttattgttattctttcttgaatattttttttttgtttcaaattataatatgaacaaggtgttaaatattaaaattttaatttttcacaaaatattgatcttggaaataaaataataaattataataattcaaaattatctaattttatatttttttacattatcaatcaatataaatatagattaggggacctttgttcaagtatttacttgttcgatttaaccactagcataacttacatgtagattattaacgaaaaaacaaataaaacgaacaatgttgtaacattttaaaattttaatattcttttttattgaaagattaagtttcataaccaaaaaattaaaggttaagttattaatatgatttgtagtaaaaaaatgtaatataagaattttcaattttcattaacgtcattgtttataaaaaaataaaataaaaatatttgaattattagtatttaaaaaaaattaaaactagaattaaccagactctagaaaactgagacggtaatttacaaacttaggggtgttaaatgcttctaaactagcttaagataagtgaaatgagatacgaaaaacttaactttgtttcttccttatattgagaaaatggttgatataatattatattttgacaagaatatagtcttggaatgcctaatttctttccggattaatcaatatcccaattaatcaacacaatttttttttttgcatgctttgacccctgttacatgtaacatggaaaacttttcagaggttactcatataaaaattgctccaaatcaagtatacttaattatgatattcttaaatgataaattattaaaaaatatatattttgttaatatatgtaatattaatcaattcgtttaagtcatgtttaaccacatagtcttatagttgcacaacttttagatttctctaatttcaatatatattcatttcatcaatgtgttctttttgttaatgatcatttttacctttcaagagtcactccttatccatgacttatccattttatattggcaatcactctcaccagcttcaatatcctatgtgttacaaatgttataaaaataagagaaaatgaattatgcactaataatgcaagacaattttatgatgtcatctagtcataaattacaaataatcatacatgataaatttttttaactcttactataataactttaaaagtcataccaaaagtgatttttgatttgttgacaaagtaattttttgtatacattaatagtgcatatccattaaattataaaaataaaatcatcggaaaacaataaaaattcctttcttttccaactaaaaacaccacaagtacattgtttatcatttgaaagctaacattccaccaaaacaatactacattgtgattttaaaaaaatccaatcaaaaggtaaaagcagagactaccttaatatacttaattccatattttgaagaagatgcatgcacttaaagccagtgtagtagatttaatagtatgagagctaggcaatctgcccttgtccttccttaagaaaaggccttggtatattgggaaattgatgagaaccaaaaacccacacaatagaacttgcaatgccattttctcaccagttaaagcaactctgcaaaggactaactcttttaaagtggctagtaagcaaaacaaatggagtaacgcaagtgttgttagtacagtgaaaaatggagaagaggttccaaactccatgacctcgttcttgtaacgttgggaaacatcatcttctataatcttagttgtgacagcaaaggatgaatatgaacgtccaaagaatttcaagacaatgtctattaaagcaaaaaggtaagaacttgttcttatgtacaaccacatcctcaagccattccaccaaccctggattgtgcctccaaaaattaaaccctcaatcaaagtagaagaactctccccgagtattacatatgcgaaaggtatgaaccatgagctagacatctgtttaacccacatattaagcacaaaatgttagttgcattctcaacacaaaagattcatttagagaagaaaaaaattatacatatacacacacatgtatgtgtctaggtatattacgtagtaaaacctaattatcagatggtcattcaaaggtaacatatctatggtttagggaaagttacttagttagttgaaaagtttttttcatttcgatttcatactcatcaattattagaaaacaagtctcacattcgtgaattaaaactaaataaaagaatgtataagtaaaaggactataagcctaaagtatcaaaatatttacaaataaacagactacttaaattaaaaatccattaatctattctgttacatttttcaataaggactaacacacaaatgataataagggagatttaaggttaacctaataattgagaaggaagaatttaaagatgaaaggaaaagagagggggaagagaacgctggttctaatctctgccgacatatttttaactaaattaacatttgacgatagaaaaatgataataagatatgaaagtccatatcaaaggaaaaatttgtactttgaacaaaatagagaaattgacgggaaaaaaatataattaaaaaaaaaggactcaagcaaagaaaaatttcagaaaaaaaaactaaggccttttaaaactcgattaaatgaaacggcctctaatagtccactaattcttatcaatttaagtggcaaaaaaatgttttttttacataagatttggtttaacaatgagtaaaataaaataatagaaaaagaacattaaatttagagtaaataaaataattgagatttggtttaacgttaaattttatttttctattattttttattggaataaaaaaaacaattttgaaatcaaatgattaataaaaaaaattctatgaaattctgaaagatgtaaaaaaataatttatagaaccatatctattgacaactccaaaataatataaatttagagtaatttataatgtatatttatatttgataaggagtttgggagagaataaaatgttgcaaatctcttatatattctcttagaaaaagggaggtcattattacctttggaaacaagggaatgcctttaaggagataaagtgaagggatgagggagtaatatagtattgccaaacaagtggttgccaaatagttaaagtgccaatatcccattagtaggcctaaattgatctttccatcaccatagcatgtaggactgtacttagaaaacaaaatttggaagtcgccttcaccccacctcttctgttgaactagtgtgtgaagcaagttagttggagctattccaaaaaaagccttccttggtgggttgtagtatattgatttccatccttgtgaatgtatccacaaccctgttatcacgtcctccacaagacatccatatattgcaccaatctacaaagaaataagttatacccacttaaaattattcattattgtactttaatgtatatatactcatctattaatattattattggcttttgggggtgtttgtgattttgaaaacagagagagaaagatcaaagtagacaacctcttttccccatagagtattttcctcataggagcagcttgctagtgccttcgattccacttttagttcatgcaagtttgctttaatcacctctttctcattctcatcatcccaatcatttttgtattgacaattgaacttcttcccacatagagcgtctcttctatgaaagcaacaagttccaataaacaaagggccaccataaccatccgcaccatggagctccaccttcatagtggtcgaaataaatgtgaaattattatttttaaatataagacttaaatatgttttttatttttaataaatattttatttttttgtttttttttctaataaatgtttgttttatgttgaatttctaataaaacaccacttgttttttgttctcgtctatgctaaattaaaaaaaattatgtttgttccctaataaattaacaaattttgttttaatctcaactagtaataaataaataaaattattaggtaacaaatataaaatttactaatttatcatagactaaaataagtgtaagggacaaaaggtaaaaaaattattttattaaacactcaatgtaaaacaaaaatttattgagaaataaacacaaaaaatcgatatttattaggaataaaaccatatttaagcatttaaataattattggacattattaatagctattagttatgtctaaattaaagaaatcacaacagatatattcttttcactaaaattatgtacatttcaaatagacaaatatttataatagttatactcaaaatatttataatagttatactcaaaagtctatctataaaacaaatagacaaatatatataatagttatactccaaagtctatctacaaatgaaatcaaatagaaacaggggtaaggcaaatggaagaatttaatctttctggaaaaacattattccattccatcaatattatctaactcacctccacaattgctgatacagcattcccgtacaaatcattcttactgaggttctcaaaattttgtggaaactgcacaaaagcaatttcttggcctttctcttcatccatgaaaaaacaaagagcatctctcactgattgtgaatggtttgagtacatgtcacaatctataattagaatgattttcgcgttgctaatcgttgaagagactcttagctacatttaggtcaatgaaaagaatgttatctttaatccacatggattgacaaatgatccataaaaagttactcacacacataattaggcagcatatatagacacactcatgcacatgggtgattaattagatcgttgacgatgtgtgccaatgtaaataatctataatctataatgcaaaagatcgcaagaatgattcaaccacttacggctcatatatacagtggtattttttttgtaaacctccttttgtaaataataaataataagcaccatgttacttgtttgctatttttaagtcgtatgaaactgtatatgttttaaccacaagagattcattgagtagattaagacagttttacatatacccagtagtaggcttaaacttctattcgatcaattttttaggtgaagtaaatgtaattaagttccttataaatactttttaagttgaaagatttttctaacatgaattgaggtactattcttcatcctaaattctttaaataaaaaatagaggcgggttttaattatatacactaccaatgaatttatagctccagctttgtagttgtgatgatattgaggtctcttctcacgagccatatacaccagagttggcaaaacaaacccatctacatccttcgaattgtgcgagttcctttcatgaagtagtatctggtaagaaaatcaagccacaagagcaaaccatgcatcaaacttatatataggacaacacaaaactcatgagccgaattgagttcaaaattattgacaaaaatgtgaacttcatatggtataaatttgaaaaacaaggtagtgcatagattaattgaaaactatgttcttaatataattttgtgcaattgcttttacgagtagttttgttactcataaagttcaactgaaagtgaagagtgaagaagcaataacttgaggaagaagaaaccagaaattgagagtaagtggtgaatgatcaattgtattatgatttgttagttacagaagagttattacaagcttatatacaatgaggctataagttgaacacttaggacctatttagatacaaatcataagtgtttgtgagagtttttctactaaaaatgtagaatttttttcaatcaaaaaattctaaacactattagtcttgtattcaaacaaactttaaataacctaactaacttctcccaaacttaactaaataaagttaagtatgctaagagttactgtgcagattttttttttcctgtgagtcacgacaacttacattcttgtctaaagaacgacaatatctttttaacaaaagttgtttaacaattttatacacatgtcgatatataattctctcaaatatatacttatagaaaatgttgagaaagtataattcacctgaaggattgtatcgtgatcatgtcgagaagaatacgaatcccattgagaaaacccattatgctttgatcttgcttcgctgggtactccacccaacttgactacatcttctattcgtcttttcatatctacgtatagtttctacaacaaaataaaagcacactgttgtgagaagaaaataggcaaccttcacaaaataattagaatatgcaaaccaatttatttaattttttaaaatttatctcatgatatattcttgttatacaactttttattctaaaaaaaatgcaacttagatacttaaatggaacttaattacaaaaaagttgtgaattaatgagattgtcatttataaccaaaattatatatgtctaattaacaagggtatcattataaataaaaaccaaggtcaaccacctccaaacaatttgaaattttaaataattagttaatttgtataaaaggcttgattaatttagtcaaaccttatgtacataacaatagcaagatttagatcaaatttatggatttccattggcaacaagtgacatgaacaaaaaaaaaaaaaaagtgattactccgcaccttgatggcatctaagtctttggcatggttatggtcgtgtgaatttgttgagacaagggtgttaaaataagcagcaggtgacctcggttccaccttaaatctcttgcagaatggcatccaatgcttggcaaaggtagaagcctctaaaagagcataaaaagttatgtctgagcctgcatcatccgagagatacacactgagcttctctgctggatagtcataagccatcacagataacactgtattaatcaccatcatgggtggctcaatgattgggtctgccgtgaacacaaaaatgtccactctcggcaagctactctcatatctatcacaaattaaaacacacattatataggaaatttacaataattcatcatatataatgctcaaccaactgaatttaagtgattgtttaggttaacaggttaaaatttgatttataaatactccaatcctaagtaattggattgggtagtaatatataattacttgtaatttctaatttttctagatattaaaacatacacaaatatttgtaacaaataaaaaaaaaaacaattttaataatttaaaaaaaaatcaaaaaaatgttttcttaaacacgggaacaaattaaaggtgtagatcgaacttgaacctttcatagagtctattgatgaaggtttttctgaacagcatgttccagcggagggcttgaccaaagagccaatataagccggaccagagctctgcagcaaacaaaccaagccaagcccatttgccatatgcgggtatgtggctcaatctgaaagcccagatgaagcatatggccacaaacaaagagattgcatagatccttcgaatgtgccttcctttgtctttcctagtctcaaacagtgaatagtcttcaccactctccattaccttcaagttttctatccagtgttcttgttgcacttgcagtcggttaattttttttcttatatttaaattttttgcattggagcaatatgttattcattgatatttcttatattgtgtgatgggtgttgcattgacagtacaacactccaagctaagctaaaaggtgatcacaaatgtactgactaacccattgacattgacagcacatatagccatgatatatatatatatatatatatatatatatatatatatatattgccaagaaagaaaaaagaatgctaaaaacaaagctaaccgccaaactctatttataaatttaaaatatatttaaatctttactattttgtacccaccgcttgctatcaaaattaattatttcattgagaaattcttgctcttgctctatatcatttattatgtaacatgtaaggttattattgttttatacattaataagtctttttaatttttctaaaatattaatcatagttaattttaattttttcaaataactacactaaaataagaattttcctgaagatgttgcgggtgttgatataaaattaatatatattctaaaaaatttatttaaaaaaagagaaattgatatattttaaaaaaatcatccaaacaaataaaaaaaattggttgcatttttatttttttagcagtttttgatttttactttacataggtttacatttaaataccccaaaaaaataagaaaaaacaaaagtataataacttaaaagatatttttgtaaccaactcataactatttagtttcaatcatgaatatgatcttactttgtattataatgagagaaaaatttaacttgacaaaaattagtatttaaattttatcaaattcattatttataacttgtttaacgtcatatttaaatggaatattaaaattttccaatataaaacttatgattatgcactagttcccaaataattttgcaaccttttacgttttccaataaatacgtgttcattattagtagcagagttatacttgtaatttttcctctcatcataatacaatgtaatatcatattcatgattgttttgataattaaaaagactcattaatatagaagacaataataactcacattgcttacatgttacataacaaacgatacagaataagaaaaatgtcttgttcatggaacaaacaagaatttctctatttcatcagtgatgtatgtttgactttttgacgagaatgagattttgacaaaagtaaatatggaaagggattgttttgagaagtatttacaatgatgacgaaggctagggtacgaaagcgtaactcgtgcgtaacttacgaattacgtttatagccgttagatcaaaattatcagatcgattttaaaatgggaaaccggtttgtaaccgtgtatgatttttcttttttctatatttacccttgttgctaagcaccccgtgttgtccttggctccctgctgcattttgcctgcgtcagtgaatgtgacagccatgagaagacaacgctcctgtcaatggccattatttgtcatgatatagcttgctaatatattcataataataaacaattgtatatatattaaatatatatatatatacttataaataaatttaattaatttaacaatagaaacaaccatttaatttaattcttttgtttttataatatttaatacttatacttaataattgacttgactcaatttttttaaataattttcttagttaaacaggttaaattacaaatctttaaattaaaaatatctattaacttgcatattttttttatttagtaacaaaatattttaataaaatattattattaatacgatatgttatattataattattttaattaaattataaattatgttagtagtttgactattagaatcattttaatgtttaaaatattttaatttctataaatatagacggggaataaaaattagagttattttttttggagcttaaaagatttaagtagatagtaactcatcttcacgacaaatataaaaaagaattaatattttcagtcaaaataaaagtattgatagatagatatcacacctacagagatactgtgcaatctagtttgagtagacattgacacaataaatactaaaaaagaaaaaaaaatagtcttcaaaacttaataaacacattggtagatttttaaatttttaaaaaagaacccttgaactaacaagttgatagatttttttaaaatagaaaaatagacggtataagtttataaattggtagagtttttaaaacttaaacaaaataaggatttttaattaaacaattggtatgttttttaaagtagaaaaaatcaacagtttaaattaacaaattagtaaagttttaaaattaaaacaaaatgagtagtgacaaattggtaaatttttagatgggatgaattgatgataaatagtgtaatataaaaattccaaacaaatatatcaaacaagatcaattcatcattaattttaatatttatgaaactaagtgaaaaaacaataacaatagaagatataaataaacaatattatcacttttttgtcagcaaaattaaatatatattattattattagtagcaaggtaccaaaaacaaaacaatttgaggaggttatggtgtatttcaatcataagtagagacatgttgcaattttatttaccaaatattaaaaaataatttaatttgaaaataataaaattaaataatacaaataaaaacaaattaattctaattaatatttaaacgcatgtacttgcacataataataatttaattttgacaatcaatattataatacataaatatgtttattataaaattgtaatataatgaaattctgagataaaaatattataagataatttattttaactattgatgatttgtttaaaaatatatttaaaaagatattagcaaaaaatggaaaataatatattaaagaagataagaaattgacaaaatccataaaatgaaggttaaatatagaaaaaagaaaaatcatacacggttacaagccgatttcccattttaaaatcgatctcataattttgatctaacggctatgaacgtatttcgtaagttacgcacgagttacgctttcgtaccctagccttcgtccaatgatgatagggttgttttagacactacttatccgatagtatcatgtcttcatatattagcattttttactttttacataaattatatatataattgatgtaaaagatgtttcattggttatatttgtaatcgatataaaaattactttttacataattataaatataacttcaatataatatatatatatatatatatattctaattacatacaattgatatgcagaaattactttttttgctaagacttggaaaatgaatgaatgtctgaaacatgaaaatacttcttaaaagaatccgtttgcatatttcctttctccaaaattctcattttcgtcaaaaagtccgtatgtttaatataaaacttattactataattagtttagaacatgttttaagtatatttaataatttaaatattaattttacgaacaaaatgaaacaaatacttatgtaacaaaaataattgttattaccaaatatatagtgcctggacgttaaatttaattaggtaaatcttaaaatgtagaaattaaacatattagtataaaaatatataaagaagtgtatgtctaattaacccaaatatatattatctaacaccttttttcgactcattttttttattagttgaaattcctaaaatcatactaaattgaaaacaatatctattgtacgaagaagcagacatacataattcgtgggtctcatgaatttccctaacagaagggagtatgtcaaatatataatattgaaatgtgcattgctagtatttcttgtaaatcaaatattgggaatctcaatgtccggtttccatgaacaaataatagtggctagatgtatgtttagatacatgaaaccaaagtactctaataaagataattagcgcacatacttgaagcttcaagtcaatgaagccaaactaggaactaagaaagattcttatcactagtaagtatgaaccacactttcagtattgtactttgacatttaactagattagcaaatgaaaggtgctaggcaacaggctaatgaagccaagacaatggacttgagcataactgaagatggtatgcaacctttatcactacgaatgaaaagtgcctcatacactggtaaactgatcattaccaccaatgaactcagtgtaatctgcatcatcaattggctagagctgaattccaaatccatcataatcctcttcattccccaaacgagaccaaaaagatttagcaatgccactgtagctaatatggttaacatgattgaagagcctccaaattcaatgacctcttgctcatacctcttttggacatccttagtaaccactttatccgtgatgacaaattttgtctgtgacagtcctaattgctttttcatggtgtcaatgaaaccaaagagatacgaggtggtcctatggatgaatttaattctttgcaagttccaccaaccctttgccgtggacccacaaatcaaatactcacacaagctaaagccatatgtagcaagaaatgcatatgcaaatggaaggacccatatgcttgaaaactgcaaaaacacgaattagagttaaataagtgcaagaaaattaaggaatcaaatcaagctaattaaacacatgagataacctgtgggaacagtggaatgccatgaagtaggcaaataggagaaacaaagacataacagagagtaggcagagacataggagcccataaaaggtaattgcaatatcccatttgtacaccaaagtgtatcttcccatgcccataaatgaaagggcaatacttggagaagaaaacttggaacatgccttctgaccacctcatatgttgaagacatgctacatccaaggttgttggagctatgcccacaaaagccttcctttctgggttgtaataaatcgatttccaacccctgcatgagattacaaggccagtagctatgtcttccacgggaataccatatactaatcccttctgcaagattcatatatattattaaatattgaaatttctgagataaattaaaatctacacatgagcgcaaacctctttcccccattgagttccctcctcataggtgcaagtggcaagagccttcgatgcttcattcaattcatcaattgttctattatcatttcttttaggcttcaggtcccgttttgctttgtaatctatcaagtaagctcctgatagactttctcttcgatgtaaacacccagttccacaaaataaggctgctccatatccacatatgccagctagctcaaactttatatgcacatattaagaaaatcagactcaatatactgttggtccatccttatgtgtgagtttagatatatgtatactgtataaactataaagtaattacattattttattatttaccttactgctcacaagataagaatttgcataatggtcattcttggtgatgttattatagctctgtggaaattgcacataagctatatcgtggccttttgtttcatccaagaagaagcatagtatttcttgaattgtatttgcattattggagtacatatcacaatccaagttgagaatgaaaggggcgttgcttatctcggatgacactcttatctgcagaatgaaacttttgatatgtgacactaacaccaaataataatagagagttttctttcttttttgtttgttgttattggaaaaacatagtcaaatacgtctttgaatgaacaatttgaaaatatcatcatcaatgtacaaaagacaagtttataaagtgagtggaaaacatagtatactaagatataataaaaaaaaacttaaaaagggtttaattttcaaggttcttatctttagcctaactatttcaaaaaaaaaaaaaaaaaaaaccttagcttaactgcaaagcttagggtagtatctaattaaagtattaagatactttaagtgaaaaaaatatattagataaagagttaattaacttttttttaaaatattgttagcttgcatttgtaaattgtaaggtaagatttaattcttttaaactaaaacgaaatacatttttacaagtaaaatataaatttatgagtttaattagcatacactgttaatgtattgctgtgagaattactcaccagtgcattaacagctccagctttgaagtggtgagggtagttgggtcttttttcgcgtgccatgtatacgactcttggcagttgaaatctgtcttcatctacagcatttgtgtctcttccgtcaattattatctaataaaatgaagaataaagattatattgaaaaattagttatatagaaaactaagatagtagattaattccaacgtgaattcttattcttttgtgaaaataaaaaatgtccataccctcacgataggttggtgatcctgttttgttgtttttggattccattctgagaatcctttgtgctgattcctcacattatctggaaccttgccccttgctacagctgattcaatctcatttttcatgtcttcgtataatttctgacatatatgaaatggaaaatggggaaatttttcatcaaagaatgcaatctcactttttatgtcttaattcgtataaatgagtaagatttacagaatcaggcaaaacaaattaaagaaaaaacaataagatatgtatttaactttttattttaaaaactgattatatagaaaacaaacaaataacaagtaacgtatttgtattgaatttgaatttgaattttttcactaacaaaaattaataattaatatttattaataaaaattacttttttttgttaatattgtatatatatttttcacatatgagacaatcttatttgagttaaaaatattcagtaacctaattttgaaattttgaattcatatataaaactcaaatttaacattttatttaagagaattagatatatatttttttatagatcccatataaaatacaaatttaagacatctgattaaactaaaataacttatttcaattgatctatgcgctcagctcattgtatctatatatctattacctgcactaattagttaactaattgttacctttcaaatgttaaatatacattcattaatttatttaatacttgtttttttttctaatgcattcctttccgtataacaaacctttgaattaaaaacatcaattgttcaactccaagaattttcatgtgatcacaagcacaccgtgcccgaacaatattagtaacaattgaagacagcactatatggacatatatatataatcattgataattcaacgtaaaaataaaaaataaaaaaagtcagttaccttgataaataaccatgcttggacatagtcagtggtattattgctacaagttggggcagcgaagaaaacctctggtgacctaggttcaacattgaatcttctacagaaaggtaaccaatgtttggagaaaatggaagcctttaagagagcataaaatgttagctctgagcctccatcgtcagagagatacacactcaatttattcgcaggataattgtatgccattgctgataataccgtgttaatcgtcatacatggaggctcaagtatggggtcagccgtgcacacaaaaatgtccactgctggtaaattctcctcgtcatatctgtaaagacatgccaaaaaatattcatcatatttttactattttacgtataacaattacttgaaaaaataaaatttaataagacacacactcaaatatccaacatacattgagctctaattcaagtctggaacaactctacttaactttgccttattatatataactgacatgcatcatgtaataattaaaaaaaaatatcaagtttgaaactcattaattataacaaagaaatccatatatatatatatatatatatatatatatatatatatatctatctccaagactttatttccaaagtttgtgaaggttgtttaatcagagttcgaagtattggaactctattagttactatagtctatagggcgttagagagaatgcaatagagattttgacatttccaccttcaccactaatttcaataatggtatggatgatgtgacatattttctatattccttattataacacatcatttaggagaattgatgattttttataagatatttgtaatttctaagcaatactttttttctaatactagttacttttatttaaatattctaagtattaatatttttttattaatagtaatatgtattattctaaaattttaatattattcataataagttaatgattatatatgattatgttcaaaatgtcttataaaaaagaataaaaaattatatgatgatttagttagttgaatgtgaaaataactgaagaatagattatatatttaaaatgactaaaattagtcaaataagaatagattaaattaataagttgtatgcgccgtacgtcatcacattaattgccatgtgatttcgtatcatacaatctgttaatagatagatatgaacatcacatgactactagatcacgcaaggtgtctatatagtgatatataactattaaacatactgacacgaaacacacttctcatttatcaacaaaaactgaaaatgtttataaaattaaatagagaagagactagcaaaaaataaattaaaattttataaaaaccaaagttataatttaaaattttataaagaaaaaccaaaaacatgtttaatcctacaactaagagtactggaagtgacctatgttaaattgaattttatcaatttttcaattcaatccaatcaaactcaattggatttgattaaattggatttatcttctttttttcaacccaattcaactttaatttaattggattaggttaattatcggattagatcataaaaaaattgtcatatttaaaaaaattctcaaaacccaaaaatagtaagaatgtttttttaataaaatagtaaagatatctttagaaattattattaaaaatattatactattgatacaataaacaagaaaaaaatgtatgatcaaactactatttataaaataatgtattatcttaaaataaataataaaatatgttcaatttaaaatttttatattagtaatttaattacatatgagttagattgatctatgattgaatctaaaattcaaaacttactatcaaatttaattttaattagatttactgaaataaaataaatgcaatccaataatttaatttaaaataataataaaaaatagattaaattgaattttacggatttgccacccaatccgcttacaccctgaccagaactaattacaaagttacttagtacattcggcgatgcacacatcctatatacagccaaaaatgatgcaaaagctgaaacctaactaggacaagtcatcatccgtcaatttattttcggtcacactatactcgaataatataattttcttatgtataaataaatagaagccgcagatatggattccggaaagaatcacattattccaacgtacaaaattaatattatacttaattatatttatgttctcaaaatatttgtgaaatggaatataggaccactggagggaatgaaacagtataaaaagttgactggcaatgcaatgtttagtctttaggtctttaatttatttggtaattggtttacgatactactccgttagacttttcgcttgtttcttactggctattgatgagatttatttgaaaagtcgaaagagtgtaaagtagtagtattgagcgtgattccattagccttttttgcagtggctcttaatgtgatttagctaatgagtatatttaattcagcggtccatgttcctttcactttttttgttaaatgaatatcaaattaagaaaatagacttatatagttgaaaatgaaatacttctagttctagttaagaatgaaagacatttaggttcgttcatttgtacgtagagaaatatataaagtgagaaaaaaaaaatatgagacctatatttttgtattattttaatttaaattttttttatcaatttctttttatttcatttcttttcactacattgaatgaactcttagaaacaatattattgagagggagggagaaaaacaatcattgaagtcaccacagtgtggtgaatgcatcttgcaaggattcagtttgatcgtcattctcaaaggataatatatatatatatatatatatatatatatatatattctaacttattttatatacttcttattatagtagttatcacgattttcatttttttctatgcttcattttccctacactattccaccttctatacttgcacatgtcaggacagatatacttggtatactttgggggtaattgtccccacaaatctttaattttttttcttttaatgtactccatacacatgtgtaaatatacaaatgcttctcatgatgtgaaatgtaatatataattcaatgtataatataaatattttcaccatagatatatatatatatatatatataaatgataaatttattaactttataaaaattatcttaataattatattaacaaaaatttatcataattaacagtgtaaatttttttacaccaacagtccaagttattttaactttataaatattgctcacagaatataatttttttttattcgtccaattttaaggtgtacgagtggaaatgaagaaagtgagagaaatcaataaatgagataaataatgtaagcaaaaaagcactatacgtatgtgtatgtttaatattttcccctggacatgaaaaagtaaaaggagaggatgaagaaaaagtaacctttgtgagagcctgtgtttgaaaggcgtttggtgaaggattctccaacgaacagattgagtgatgatccagtagaatccaaaacacaactctgacaccataacactaatccaagcccacttcccacttttaactgtggggatgtttgccactctgtacacccaaataaaacatatagctgcaaatattgttgatgcaaataccttgtaaactcctcggaatcttgcttcttttgtctcgaacaaactaacatcaacatcggactcttgttgtctcgcaccttcttcctctctcattctctctcccagcttctttctcacgagattctgtgtttgtgatgtgtggaaagggagatggacaattacatatggtatggactattaatgttatttattcacatcgcggaccgaataataaaaatatcatcgtaaatagtctttttcttaatatcaataaatttattcttttgaaagatgaaaatttaaattttattttgaaagtaaaaaaaaaaagtatgacaaattcattaatatgttaattttcgttaattaatgttaatgaaaaagcttacctgacacataaagacaaaaaatgtcacaaaatgattgttaacatgattgctaaataaattgaaccaaaatgttataagttttcattagactaattcatcgaacccaaattttatttcatttaagggtaaaaatataatttaatatttatctttcccattttttatcgttgaaatcataatattacaataaatatttaaaaatagaaaaacaaacataaattagacgtttgttgctctaaaatttctaatgtgataatatatttatccaaaatatgaaattcaaacaaaattatacaatcattaagttaattcttataaaaaatgagacataacttaattttttcactacctaatactatcataatagaaatttcaaatcaaaagacaaattctgcttattaatcaatatatattttatgcttataattatatttgttgtaatttatatttgttttcttattttttaaaatatttattataatgttgtgcttgcaatgataaaaaaaatatgaagaaagatgaagattaaattatattttatctttaaatgaaatgaaatttgagatctaacaaattaatccaataaaaacttcctcacattttgatccaatctatttagtaaccatgttggtaatcatttttgtctctatgtatcacatagattctttcattaataatgattgacggatagataaatttatcacattttttactttcaagactaaaatttaaatttttatctatcaaaaataaatttattaacactttatacatataaaaataaaaataatcatttactcaaaatatcggtgctcacgtattcttatcatcttatacttgtcactgggcagatattatgtttagcaaaaaataaaatcaaacatgattccgcaaaatgacaaaacatggtcaaaataattatgggagtttgtaattttagattattatgtcaacttacgagtttgtaattaataacttgttatatgttatttgacatttagcgagataaagaaatagtagaggttttattagaatatatatgaccattcggtgattaaagttttcctctgcacatttaataacccaaatgtaaattagaactcgaactcaaaattgttctatggaactcaatagcaaggtttccaaatataattgttcataagaaattaatattcttcacgtattcttatcatcttatacaggccagatattatttttaataaaatttcaataaaatatgtttccacaaaatggacaaaacgtggtggagaattcgaaagtattactacgggagtgtacttattaagatttaatatataaactttcataaataattctttaaattcaacttatcgttaatagtgtctttaattgattggttgtaatactactagaattattttttactaagaatagtgttttttatttatcacacattggtacatgcgttaagatatgcctattaccactatgtcagcatgaatgtaattttaaatatgattaagtcttatcaaaacttatttttataattggtttaaagaactaaaatttataaaaatatcttaggtattattggagagtttaagtctctaattacagtgattaccaaattaaataaaaaagacaacactcatgtgtgatacatatattcaaataatactacacatatgtactcacattaagtagtactctattttctaagaaaatatttttgataactaaccgatatatattttaaaccagtttataaaatttcaagtaaatctaaataaaatgtagttaatattattttatcacactattttattttcacgtgttatctgttataaaatataagtaaatatctacttactagataaaacactaaaaaatatctaatatatgtgaaatgtaacatagatgatcaaaatgataatatccaatgattcaattattatattagttaattttgtattctacaaaaaattattataagcataatataagtatatatacaagtttaattgctaatattaatttataatgtctctttctctctatatatagagggatcaaattgacatatgggtcgattttaaactacgtaccaatttgtattttgaatatataaagtcaataacagtcgcagattatgatttggtcattcattcatagtgctttgaatcttccgtaaatcaagaaaatgaagagaaaaaacatacagaaaatgtcattttatctattgtatatgtttgtgaatgtaacctttttctatgaaaaacggactcacttcacatgtatcgttttaaattggaaattggtcaagtcaatagtatgaacaattcaaaaacttactgaaataaaaaagataaaaaaaactatgttgacgatgtaagtttacattgtcttttaatataagttatatatgataaatttattaattctcataataattatattaaacgtcatgcaatcataattttttattagataacaatataaatttgttatatacattcatcgtgtatgacaattaaattcaataagaaccagatatagaaaatttggttagatttgatatctaaaacttatacttgggaattaattatagactattattactatttaattatttattattaaatttttcatctggtgcaagacacaatataatcttttatattttttatttgtatataaacttttatattaatacaaatatacaataatagcgtgtagcagaatgaatttaccacttactcccctcctctcacttatactttgtttagtttaggagtaaattgtgttgtttgaatagataaataagaaagaaaatagtaaagaaatttctctccgcttgtttggatgggaatgaaaaaaagttatatgaaaaatatttttttgctaatgattaatgaataaatgatattttcaacaaatttatttgttatttttataaataaaaaatttttaaaaatgcgtgaggctttgtgtacaagcgatgtaacccttcagttgtctggcatttttgttttgttttagcaagtgcatgtaagagggaggggatcttgttttttcttcttgtctcattccttgcattgcatttgcatgcttcaatttcaaccaagctctcatttctcctttatcctcattaatcttgcaccccccagttttgtatttctatgcaatatattggcactgtgttaaaaaaaatattgccttgaaattttggattgattatggttatgttaggtaaaattattttgaaaagttaattgaaaattgaaaaattagttgttaattaaaaaattaatttattaaattataagtatttgataaattaattgctaaagtagttgaaaagtataaaatgatgaaaaataataaaatcatgatttattttaaaaaggataattaaaaaattagataaatctaatgaggataaaaatgaaagaaaatataaaaactagaaagtaatattttaaaaaatgttactttaaataatatttcaaaaaacattagaaactattaagaaaatttgtttattgaacatgttttttaattaataaaaaaattaaaaactaatttaaatatcttgtcaaaaaaataacttaacttcctagctgatagaatgtttcagttggaatgcaaggaagggatcgaacgtgccagtatgctctaacctcttggtacggggaaggaagttgtagtctttcattatcgatgctctatacatttagggacaaaaataactatttatccatattcaaattctagtcctcaaaaatgaaaaaagtgcgacaaattcatctacatgttaactttcatttgttattgttaatgaaagacataattgacacattcaataacgaatttatcaacattctacatattcagggacaaaaatgactatttatccaaaatacaatttaatcttcatatttctccctttattaatcgttgcaaacataatattacaataaacacttaaaaaataggaaaacaaacataataataagcataacattgattaataaacataatttttctgttactttaaaatttttattgtgacaacattaggcagtgacaaaatcaagttgagtctcattttttgtaaggattaacttaatggctatacatttttatttgagtctcatattttgggtactgtactgtcatattagaaatttcagagcaatagacaaattcgtctctaaatgcgtcacgtaggctctttcattaacggtaacgaacagaagttaacggatggatagatttgtcgcacttttttcattttcggggattaaaatttgaattttcatctttcggggacaaatttgtcaagactttacacgtttcgggacgaaaatgactatttatccaaaaatattatttctcattcaattgaactcaacgtttaaacaaatacagcttagtgtatggactcaatttcttttttttcttctttctctttacatgtccatttccctcttacacacatgcattgaggaggatcatttccaaatgagttttagttgaaatactaataactaaggtagttgcgattgattcctataattcatcaaaattccaagattactcttctccaaaaagtattatggtatcgtgtttttgctgcacaaaagggggtgtgaattttatgcacaacaaaattatgattctattgcgcatagaatttacgcttccttttgtgcaacaaaaatatgatgtcgtaatatttttcagggaggaaaaaaatacacaacaaaatcatgattcgttgtgcaaggaaggttaaaacatgacagtattacgaaagtgtgattccattgtacaacgaagtcacactttcgtttagtattctttcggagagaaaaaatgtacaatgaaagtgtgaaatttcatatagcaaaatcatgattcctttgtgcaacggattgttgttgcacaatggaatcatggcttcgtcgtgcatcaacaacaacggaaataaggaatttgtgatttcgttgtgcgaaattttgcaatggaagtataatttcattttaccacaaaaaaaaaaatacttggcagcgtgagtgcaaggaggggttgggaagtgtggggtggggtgaggtggggaagggtagtttgttaattgtctttggttgataggggccaagagaaattttgttgggtccaatagcaattttggttgggccaataataacaccctataactaaagacttgacactaaggtagtattcttttaaagccccaaagggaataatgatttcgtcgtgcaccaacaacaccgaaaataacaaaattgtgatttcgttgtgcaaaatttcacaacgaaagtataattacgtttgaccacgaaaaaaaaaaaaaaaagaagcatggcagcatgagtgcaaggtggggttgggaagggtggggtggggtggggtgaggtggagaaggatagtttgataattgtctttgactgatagggactaggagtaattttattgggaccaacagtaacaccatagtactaaagacttaacactaagataatattcttttaaagcccaaaggttgaatgtaccaaaaacaaaacaaaaaatcccaaaggttgagccttaagaagacattcaactagaataaaataattaattacatcaaaataataagtcataataatactaagacattatgagtgagaaaaataaatctttatgataagctatatcctttttaatgtacgtaagttataggtgaaaataataataaaattataactttagtaatatgataatactaatgatgataaagtctgattcattggagccttatcataaaatagaaaattaaaaaaaaaaatgaaatatgtcacctgaattcgattaagaaaaactacgaattttcgtcatgaaaatttaggcttcttttttctgttgtgcattttgaatgtccagcaacttccatcccatttgtagctatgttggatgttttaatttgattggatgctttattaagaactgagttgtcttatgtttttgtggcatgtacaatgtgttgaatattcctctcaatgcttttggacccaaatcccaaggcagtgtcctggcccatttccatttagggtaaaatcctaaatgaagtgtctccctatatataccctcattatgaggtgagacagtgacgaaaagttgcagactgagaggcagacgcaaggtgcggctgcagagaggctgagcgaaaacggagagtgagtgtttcttcggttaagcgaaccgttgaggtgtctccgagagctgtgagctgcttgttgagaggttttttacttctgttgtagcgaggctgagagaagctccggcaggtggccgtttgagcatttgtaaccattatttctgaatagtggattgttctggacttggtcccgtgggttttccggtcgccggttttctcccacgtaaaactatatttgtgtgtgttgtttctcccttctcttctctcgtttaatgtttgattgtttccgctgcattttgtttgtgttttactctgtgttggctgctgtgggttgagtcgtgtgattccccagtgttacggttggtgaaggaagttcccagtcgagaagatccgagttcagccgagaacgcggactcagggccgagttgtgccgagtacgtgaggagttgaccggagtgtagccaacgggttgtggtgccgagccgatctcgcggtgacggatagcaaattccacaacacaatgacaatcgcaattgtttttcctagctagtcattctccatttttttcttcttttttcttttgccatctgctctgtatatatcagactaagttattttgggtttcattcagtaaagaagataattgtataaaacatgagagatgtatcaaatttgattcgaaagcccaattagtaatccaagaaatgtaaagtgttggaatccacaagttgactcgaaagtttcactaactatttaacatgcattcttataaaacgcaccacaaaactgatatttgtttatgacatccttctgtcagatttggttccctgtgtggttaattactagctctttttaagtggaaacataattccctgctgggtactagtttcagtagtatatatgaatatatactgcaacactacctatgcctattatttgatcttacaacaatttcagttacctgtactactggatatgcttttcatttactcccaatatgacatttcagatctctctctatataaagtccacaataatatggagtctgcatgatacaaatatctagttaactagcagctatgatgaattcttgagggtatatatgggatttaagatcaatctcaaaacccgttaatcagacttcaattaacttagagctagtgtgggaaatttaattaattacaagagagatgattctcttgcttatggagcagattggtagaaaggagaagtaaatcacagaggtggagatagtattatcttgtagtttcatatatgcttaatgttaacccagttggaaattaatgtaatacttagctatttttttatttttttatttattgaagaatcgtcttggttgcattaacgacactgatcatttacaatgaatcatcattaattactcactcgtttactggtaacataccctaatcaattaatagagaaatattgataatgatgggcatgcagctattaatcatgatctatgcagcgagcgcgcgacagcgtagcttacttgattgagttgacaattataatgatcatgcagcagatactatcacggtatttcgacagtatatctgcctcacctcaacttcaaccctttaattatatcactgccttactctcatgcaaacaatgattccattttccctccttggttttcacttctctttaaaggaaaaaaaatgaatatttctcttttgtatccttttatccttttttctctcatttaaattaatgaagaaaattctatttatccctttctccaaactctttttttttttttttctcgacatcaaattaaacagaggtacgtacataaagacaaatatttgaatattagtctatggatgtgtatgcaaaaatacctataattatctttttgtaaaatttgtattttgctaaagagtaaaaatagaaataacttaaaattgtttttagttttcagttttttagaataaattggaaattatttaaaaaatatattttttaaaaaagctactcaaatatttattttttaaaataattagcttttttcatggtccaaaatgttcaaaagtttttaaaatgtattttgttaagaaaaaagattataccctgtaaaaaaatttacacaatcatctcatcataatttataatatatgataaatttgttggcttttaatataattatcttaaaataatttaaataatgatttctttcttttaaatagaccgtaaaaagataataaagccaactaaaactatcgtgatttatacacgtttctatatagactagtacaaattttgggcatatcctcctcacttgatagtgaaatgtaggtgtggaagtagaaaataaccataacaaaaggatttgaaagcaaaagcattaagtataatgggcctttaaatacttagtagctgcccaatgcccactccaatccatttgtaggtcaagcagacttatccaagtcccaccatcagacaatagaaggcgacttatatatacctgccatgttattttctgaggtttcggccccaatacattaacaaatcattctcctatgaacaataatgaaccagagaattagaaacttcatataagtgtaactttttttcatgtctcaaattttgtaagtggaatccgatgccaaacaatctcaatccataattaattaaattaatctacaaagatctcactgatatttgaacttaggatatcatgaaaattattctaaactttctatcactagatcaacccgggtggtttataattaattaaatcagataacaaacttaaaaaataaaaatagtaaccctgtgcaaatccgtgcctcggttctatacaatcaaatcacgatgcgataaattatttattaccccttttttagaggaaaattatttattacccgtataggtataatacatatttatgcattagatttgaattactactactcgatatcaccgttgaagaggatgtatatgggcaaccgaagcatgaagcatgaagcatgaagcatgagtgtcccaaataattgctagcaaatgttcatgttcgagacacattgttgaaaaaggacaagagagcttgtcctttgccttcttgctgatttacatcaccgtcactctcattttttttaaataaattaaataaaaaatttcctttgttcattgtgaagtgagggtggtggtgacgtggcgaaccatctttactacaacttttattctgacagaattttcacaagtcacaattgcatagtgctacggataacatatatgatcttaaaaccattataactgaattagaggaatcttgaataggaacaagttgcacatgattattcccttttaaactcttgagtctgaaactgacatgctgatgcaaaatttgtctttaaacacaccacaccttttcgcaattttcacttcaaccaaactcatctctctctctctctctctctctctctctctctctctctctctttctttctttccctcctcacaattatgtgaacattcttcgtcgcgatttcactctgcaattcaatgtcacactttcccttctcatgaaaattttcaagaagcacctctttgaaagtttttttttcctactctttttgatatttgtaggtgatttttcttgtggattcagctaaagatggaaactttgatgtggttttgttgatggggttttgttaaaatgtctgaataggctacttggtggttgctttttgtgtggatttgaaaagaatctctgatatgtgtgattgtattgagtttgatgtttacaatgtgttgtgttgatcatattcatactgtaacatttttttttttttgcaggttggcttcaaaggccgttaatattatttaaataaaagacaatatggtagccaaaatcaggcaaagtgctgctaactctccaaatcccacaaaaccagtggttggagagattgacaccagtccaccttttcaatctgttaaagatgctgtttctctatttggcgaaggtgctttctctggtgaaacacctcccaatgctcccattaagaaggcaaaatcgtattttgctgaggtaactgtttttataccgtaattttaaaactatatctgaattctgaagttgcatatcaaaaagacaaaattataatggaccaatagttttagtgtaaaactcattcctagaattggtgtagaggttactatgaatctaaatttgtgtttgcaccacgtgctctgatggaaaaagttttgagtggggtgaaatgtgaaaaaaattggaaacttttattcttattagttcaaaatcttctatattgttataatttggacttcaaaatttgacaatttgttcaacacaatccagtatcatgctttaattcagttgccaatgacatgtccttgttaacatgtatcatattcatgaatgacatgctctcatttaccacataagtgaaaattgtttctatggtttgttatttcattagagtgtttgggcaaaggtgagacaacttcacttagcccagaaagacctgaaaaaattaaaggaacaactaaagaatgcagaaactaccaaggctcaagtcctggtggagcttgaaaaggctaaaagagtggttgaggatctctcacaaaagcttaaagttctcggtgaatccagagaatcagcaattcaggcaacagaagcttcaaaaaataaagcaaaacagcttgaagaaaaatgtggtgatcctggtggaaccaatggtgcttggaaagaagagttagaaactgcccttaataattatgcttctgtcattacagaacttgatgttgaaaagcaagaactgagtaaaatttgtcaggggtatgatttatccttgaaagcaagagtttctgctctcaagcaagcagcagaagctgaagatgcaatgaaggcaaacaccgaaagagcatgtgagctatctaaagaaattttggctgtacaggaatcagttgagaaaatgaatgctgaatctgtccaagcacatcaacttcaagaagagacattagccaagcaaaaagttccaagacaatcatatgaagccacccttgaagaatcaaaaaagaagttgcttgatttaaagaaggaattcaatccagagcttaccaaaaatcttgaagtgcagctgaccgagacaatgactgaaattgtggttctgcaaaagcaaattgaacataaaaagacatcagacttggactctttgaaaagtgtcactctggagcttggtgatgctaaggaatcactgcagaaagtagtaggacaggaagactcccttagaagcatggtggaagctcttaggatggagctggagaatgcaaaaagagaacactctgaattgaaggagaaagaatccaaaactgaatctgttgccgagaatctgagggtagagctccggaaaagcgagtctaaactcgaagcctacttggcagaagaatctaaagctagaggtgcatcagaggaaatgatcttgacattaaaacagttgttgtctgaaactgaaaatgcaaaaagggaaacagaaggtatgaagaatgaggcagcagaattgaagatggaaggtgcagtcactaaacttgtgttagaagatgcagaaacaaagcttaaagtagtgttggaagaagtggaagcagctaaagcagcagaggcaagtgctcttgatcagattaaggttttatctatgaggactagtccttctcattcatcaacttctgaacctggtgcaagaattacaatctcaagagaggagtttgaatgcttagttaaaaaggttgaggagtctgataaattagcagacataaaagtggctgctgccacagcacaggttgaagttgcaaaggctagtgaaaatgaatttctaaaaaggttagaggaaacccaaaaggaaattgaggatatgaagactgaaacacaggcagcgttgaaaagggctgaaatggctgaagcagcaaagagggcggtggagggtgagctcagaaagtggcgcgaacaagagcagaagaaagcagcagaagctgcatctcgaatattggctgaaacactgatgtccccagaactttctccacagcactataggattcaaatgcagaattcacctccaaacaaggtggagatgaagttagaaaaagggaaggtgtcagtttcaaagaaagttctcttgcctagtatcagtggcatctttcacaggaaaaggaaccatgttgagggaggttcttcttcttagcttcccaggaagaatcctgtatgaaatgtctcttgcctagttacagttttgtgcggctcatgaatgtgagagatacacactggtttttgtgaaagttgagaccaatgcgatcagatttttgtcaatagtttggtcacaagtattttattaatgaaatttagtatattattgtatattgctacttcatgaggtagtatgatgaactattttacggcattcactgtaatgatgataataactattaaaaaaaccatacctttatctgtccattcttctcaattatttgatgctatttatgaaatgctaataaaacaattgttattactctttttacattgcttatttgatgctttatgaaatgctaataaaaaggcatggttaggatttctctttttggcaaactgtattactgaggcaaaaatgagatgttgcttcaagctgtttttcctagaaaacaggtaacaaatttacattaaagcaccatagaatatatatttttcattagattagataataagataatttgacaaaagaagaggaccaacgaaaccctcataatatcaagtgaaaaataatttatttgtaataatagggcaaagactaaggaaaattaaaataagattattgaaaatgatttagattataaattctttgcatgtttggaagactgaacacattggtgtcatgtaccgatcaaatgtccagtaattcgggtccatctgataaattacaaaaaggtccaattctgactgttttttgccttcaggttggacgggttacggttgagtccaaacgggttggaccaatattgggtcaagacactttggacttaatttattttctttcaaatttttacttaatttattcatttgtattgggccatattgtcaagtcatattttatcattttttttttgttatttaatgtgaattttgtattgggctctttaattgaaattaaatagctaaaaggttaaaaaattgaaattaaacttttaatattgagtcaagtcggatatcgatatattaaaaattgtgaacccaaattggattgtcaaaaatcatttgggatcgaatttaaaacccgcttatctatgaaccgtctaaatccacccaaattcatttttttaagtttgattatgtcgggttcgggttcaggtggaacccatttatttactcacccgaagtcacgccaaacaataaataataatatcatctattagatgggcacatttgtatttaggtaataagatgaacatgtaagaacattaggcctccagtaaaagcactgaatcgcaagaaagataatctaataataattctttaaaccaaaaaaaaaatagcagttagggataaaacaatttttttaaaaaaatattatactgagaataaaaaaattatataacatttgttttcaaataattataaatacaacaatacttcctaagaaaaaatcaaattttttatgctatctatcaaatacataagctaataaaccaaaaattaaaaaaaatccattataataaacatttttgtaaatcctgttattataaattctttctcttataacaatttttgtatttctttcttttctttgcatgaaggttgcagttaataatttgtagacaactctacagaatccccgaaatcagtagatccaggaatgccgaaggtttgggcattggattggatcgtcgtgagttggcaccatcaagaaaacaaagaagccatgaatgacacgtgttacataattgatgcacgacccgattccaccgaaaaatcctagtctcaacctcacaggaacgcaacctcctccaacatcatcaaacccctcgaaataggaactattgaattagaagcacagcacagacagactcactcacacaaagttgttactttgttagagagagagagagagagagagagagattggttgtgttctgctactatggcgagtaacagagagagagaagaatcgctgacattcacaatcccttcttcctcttcccattcttctcccatcaccgtctccgaccaactcgacagttacctcgccgaccccagaagcgcctccggaagcttccagaacgacggccttctctctgccggagacgtcgccgccgacgatcccgacttcggtttctcccgacccgatttccggcagagccccctcgccggcaccgtcgagttctaccgacgccacgtcttcctttgctacaagaaccctcgcgtctggccaccgcgcatagaagccgccgagttcgatcgcttgccgaggttgctccatgccgccgttgtcgcaaggaagagtcacatggaaaaggaggtactatactatactctaccgccccttccttttggattttgtttgtgtgtacgctgtttaaggtaattgatattagcaagcgttgtgtccacttagttacactgttttggctatatcactgttcgaggtatgtgttaaaagagtttaattgaatatctggtgaaaatgttgcttcatcttacattgtgttggacttatgagttctctctttactagattcggttaacgatatgtgagggtcatgatgggactgagacatctaatggggatgtgttgatctttcctgacatggttagatacaggtgagagtattgatcttaaaggttctctgttattgtttcccttttttcccgcttcttagatcattgtggacaacaggttttagtggaattgcaggagattaacgcattttgatgttgaaacgtttgttgaggaggttcttgtgaaggatggggaatggcttcccggaacgcctgaggcgttgagaggttcgtatgttttcgtgtgttcgcatggatcccgtgatcgcagatgtggggtttgtggacctgtcttggtcagtagattcagggaggagatagagttgcatggtcttcaaggaaaagtctttgtaagcccatgttcacacattggagcaagtcagtatgctggaaatgtcattgtatttggacctagcatgaatggagaagtcactggccactggtaaggcgaacacctgaatggttactaaaactgctactttcagttacagaaatttttatttattgttttaaatcatgcaatgccattgtaccattggttattatgtttgattatgtaactgattgatattctcctcaattaaaatatgcaggtatggctatgttaccccggatgatgtaccttcattgcttcaacaccatatcataaaaggggagattttagatccattatggaggtaattatttcctgtaatgctttatttatcttctttaatgttttggcttaaaggttacatctttaagtttcatcctataaaagactatatagctaggcttctgtatattttcaaattgaaattgtggtcaggcaagaagtggcatcttcataccctttatctgaagatatgacagctttgcttcatatgcctttaaatggcatctgtgacctaccagtttggttgttgactgtttaagctttttattcataaattaaaattataaattccaaaccaaggacttagccacacacaattaactcctattgtaatgttattccttactctttcttcaaattttcagaaacctagcttcaaccattacttttcaagtacatttctttctgcccccttttttgcgatggaaaaaaatttgatgcattgggtgacagattccctcttcggaaattgacatggtgaaatcctttacatggttatgtatcaggctgatggttatgaaaactttggagcatagtaggtccatggaacatatgctgacttgtatatgttacttttttttatattgccgtcaggggtcagatgggtttatcagtagatgaacagaagaaaaagcaagaacagcggcttctgctgaatgacttgagaaacttagaagacagcactcaagggtgtagagctcaagacaattctgtaagctgctgccaatcaaatggagttggctgctgccaatctaatggagactcctttttccatcagaatcacgtgttattggaaagaagaatggaccctgatgtcattgaatcagaggcaaagctctcagctgataataagagcagtgagactgtgatttcttggatcaataggatcaataatggcaaaggagcttcgtgcaagtttccgtccatgacaacttggctcaatggctgggagcaagaagatacttatgcagctcttgctgttttctgtgctgctgtatcagttgccattgcctataactcctacaaacaattgagataagagagatcaactttggcagcattattaagtggtttagataacttaagcctttactataaaaataaaaaaataactacgtactccattacctggaggttccacgttatgcgcaggtaaggacgagagatattgtacgcatatacaaaaagattattttcggattcgaactcatgaccaacaagtcaccaagataaaacaagccttaagcctttactatatctggatattagcttcatgtctgatattagtgcagttcttctttagatcagtccttactgaacatgctgggaaacgagtgaggatgtgtgtgctttagtgcttatagagtattattggctgaggcacttataatatgccagttagcttatttttgtatatataagaaactttagccagagtaatcaaatttaatattttaacactgtttaggtaggatttgatttgtaaccttttacaatttaatgtaaagctttttgtgttcctcgaacttgctagttaatcctagaattgtgtggcgcataggtgacaaatgacgatagtcttgcctgaactttcatataaaagaatgcagcaccttcagagattctcttacccatattgggaacagaaaatgaaatcatctagcacctgattgatgaataattttccaaaatgaatagaaagtacctccgtatgcaaagatattcaggttaatgctagccctaagttttgtcaagaaaaggaggaatcatgaatataattgagaaaataagttgtagtgtagtttataacggcatggcctttttttttatcctaggcttgatatatttgatataaaaaggaaaatttttgttgcaggataatagtgctcataagtcacaacacgaggaaaatatattttctccaactgttctattcttagttccatgcataatactgtctggcaggcacggttctgaacactgtagttctacatttttgtataaataccataccattaattgacgggggaaaaaaaaaactgtaacttgatgtcattcttccaagactgaacgaatttacttgctcatcgtccaggggttataaaaattagattaaaagttattcacccagaagtttgtggcaacttgatgtaatacccgtatattacattacatccaataactgaagataacaactgcaaagaacaagtaactcgatcggaccagaattgcctgcagtttgaaagtaactgcagggcactgcagacataatccaatcctccaagtttttttgagtcatatttcattttgttatttaatctataataataattttgtggaactcagtttctatagtcttggcaattttggcatcatctgggtctggctctggcaagtctacatggaaagaatcctgtccgattggtaataaggactctatgaatatagcttgctgcgtgatgtaattatagagttgtttatggaagacatgatcaaaggaaaaacaattttcactatttccagctacatgatgtcggggcaccctcgaatccttctttctgcaaaaatgagggagggatgcatagtccattacctgttcaaattgttaagtatgtcaaaccctcgcggatgcaacaaattctagtaagaatgaagtaaattcaattcggtagtactatttttcaagtctccatccatatcacaggttaattattaacaagaacaatggacaatatgactttaatttagtcaagagaactaaaaggaaaactcatgaaagatatactgtacgaggggtatgctaatgtttaccttcagtaattcctccatgccacaacctttcagtacgtgaactttcctccttgttctttcttgcaaaagaggctttacaacctgccattgtcattgaagagtttagctgtaattgtcaagattttgatagatccgtatgaactccttcaacataaaaactggcacaaaccttccaacacgctgagaatacatatggaacattaacgatgtaatatgcgtctgtcttttctggatagttcaagtcgtctattgtagatatagctgtcaaaagctgaaggtggccaaacagaaagtgtcaactaggagatcatctagtggatagataaagtgagaagagaaaaacttcaataaatggccaatcaaggaacgttcatatgattaaaaacatgaagagaaagagaaataagaagtttttaagttactggcataccttcaattggctcagtgccgagagttttaaaccagtcatatccaagactttcacacaagtgccaatgtatcgtccatgattctttgtagcttttggctgcaataaaaattccaataaacaatcagggtgtagagaatttatgagggacaacaaaagacactctagatactcaccaacatcactcgatcccgatattcgttcatttggatgtgcgactgtacataatatttgtcctgaacaaaaataactggcaatttaacatcatgaaaaataataaagtagttcacatgctacaaaggaaaatggacagataagcagcactgaacactgcagcaccaatgtattcatatgattgtaaggataatatggcttagagatggtatgtagtccttacaaacacttcatcaaatgtgctgagcccaacaccaacagcaaggacaggtaggccctggcataactcagccaaaaataaaataaattagcaatcatgcattttactttatgtaagagatgacatcttgttgatcatctgctatgtttatacagtcgtacacaaagatgtcatctcttacacatcattcattcatacaggttagaggcagagaagaaccatgagggtagctgggtaggaggaaaataaaataaatttatgcctgagatgaaaacttatacctcctttgagaaaccagacattcctacaagttgagaatctcgcaaacgtctgtacaaatcagggggtataggcttctgttaacacaaaaaagaaggaaaatttaaacaatgatagacttttatgatcatgaattcacaatgattgagaaatatgatagacatctagtttatgctagaagtgtgatatgatcaaataactacagagaccatgtaaatttcattctccagtgatagtgataactaggtttattttatactttttgcaataacatgcatctttatctcggtatctctaaagtttggtccttgacactctgacatgatactgtgaattcacccccctccccccaaaaaataaaaagaaagaaaacatgcatccgtatctccatctgtcacataatgcttaactgctttaagatatgttgttccaaaatcaataatatgcacagtaaaggaactcaccgataaaacattatcaatctcattttccactctccattgtaaacaatcaattaactgttatagttaaaaccgtcagcaaagtgttcatatccaatgataactctataagcaatcaacttgggaaaatttccaacaaaaaacttttactgcacacaatctaaccattttatgtgctttgacaacattcccatcccttgctttgagaaaccgtactaatgtttctgttggatagccccggtgcataatctgaaatgtaaagagcaagctttcatgacagaataaaggaaacacccatgatgatcaacatctattatcataatgttcgcagctgtgcttcagtaaagaattcttgccaacggcgaggtactggtcatcaagatcaatttagaagcaaaattttaattttttggttcaaaactcccaccccaactgaaatttttaaaatataaatataaattgtggcgacttattttatccaagatgaacagatacattcatcaagttataacttccactgattctttttgtcattatctttctcaaaacttaagatcaagtaaaaccaagagactgaagagccaaacctggaatgtgttcttctgttgctcatccactacatcgagagaaaaacatattaaaaaaaacatggaaagaatagaagatatttgtcactaacaaaacactattagcagaaaagtgtatgctaaatgcttacagttttccataagggactgcaactgcttgatagcttcctgattagtaatacacatgttgctgtttatctctgtggtgacactagattgaaactctgaaactaactggatgagaagttttgaggacaacctgtgactagggtttgaaataatgatctttcaaactcctttatgaagctactgtccacaaaaatttaaaatgaacaatagcatgtgaaatacaaaaaggtataaaatctggctttgttttgtccacttcacgaagcatgcaagtttcttggacttagatgcaacttccctatgaattctgaactgaactgagtgatcgtcattataaaataataataattaagaaactgttaaataaatacaaacacggaaaggaaaggaaaataaatgattgtttggactttggggacgtttctatttgtataggtaatagcttaatatatgtgcaacggaataatataaaaacttaatttaagcttatatatggtacatatacggagattaggaagtttcatttaaaatttgaaagtttggtagttgttttccgaatctttaaaagatggaaaagaatgtggatttattttatgaaaacgcacgtagtgcttaattttcattagatatatatatacgataacctttttccttttgcttgaagttttcggtggttaagaatagagatgctcactaataatgcaaaacgaaagtaagagagaaaagaaaaactctgcagaagtaattaagacagtgatagatgatgccaaattgacaagttttttccatgttaaggatcgatgccttgatagttcagcattatcaagttcacttgtttaaaaagagagattcacttcactttaatatataccgaataacgaaatgatatggtgtggctgccgaaagaagaatatcagaatatgtactgcctcagtgttattcacacagtcacacgcatgcataagtctcaccttgaataaaaatggataagttaaaaaatccgcaaacgtaatgtcttatatgaaatttacataagaaagaaaaaagttcatgtaacaattatatggaattcacaataaagttcagggaaaaaattgtacctccaattgtttgtgcttattacctcatacgatttcaacctattatttatttatttattcatatgtaacattgtcacgtcaaatgttttctacatttgttgagatgtcactttcaattatattattttattttctcatgtttaaaaatcttcatgccccgtctcattcttttatcacacttctaattatcataagcaaaatttactctagtataagtaaatggtttcaaactaccaataaagattcgtccaatcgataacaaacgaatttatattttaaaagaatataaatttaatttttgttgttgatgtgagggttctattgataaataatatataaatatttttgtaaatatttttttatgtttgaaacctgtatgactctatgaatcctggtattcaattcacctaaattattagccagaaaaaaatgatttcaaactcctttttaactaaagattcatttggtaggaaaaaagttttaagttttctaagaatcttagattgcaaatcttaggtggtattttggttaaggatttattttttgttttcatttcttcataaaaaaattaaaaatgttgataagttattgtcagttgtgggcttattttttaaaatattttttgttttaaacaaatgcatttactcttattttttgttttctttaaaaatgaaaacaaaaaaacactcaaattaagcactaccttagtttcttgtgcttggtatttgttttaagaaaataagatttcaggaaattatttttcacaaaaactttctcatggaggtgagaatcttattttcccgagcttagattttcttttattataataaaaatattatattattcttattaaatggtaaataattaaaataactataaaaatatcacgtaatccttcaagttttaagaaatttatgtaaatgtttttataatcaatcaatcaaatagattttactcgtttctagaaaatatgattcgaagattcatgaatagtaacaatgtcttgaaataccaatatcatttaaaggattaattcattgtttttcaatacacaagaaattatgttaaaaacctctaaccacatggcaaagttattacttatttgccaatggtttcaaactcttaattatcataaacaaaaggttcgtgtcagttacaaaaattgcttggtgctaactatatgtcactcttgaccaatcaaattcaaccacaagtccttgggtgtttgcatttgagaggacatttgaataagcattacttttctttctctcattcataggaactagaaccgtatatatggcaactctccaagagctttttcgtgccttctgtttccatgcacgtattgctgccatgaagttcattttgggcctttctaatggaaactcttttctccaagagcaaccattatcatatttcgcttcgtgtttacgttattaatttgagatttgggtttcttaggtataatatcactaagaatccaatatcaaaagaaaatatatcaccaagaatcattaaaaggcttttaatctttatatatggtgaaaaagattgtggagtaggtatagtgattagctttgagctaattaacatgtgaggaatcctattatacgctgaaaatataagtcgtacatatagtatatgatattcgccatgcaccttatatgtgctttacagtatctgatgctgatcgtgaatcaaatattgatgacccttctttcttactgtttctcaatgtcaaaactatgatgccagaatttactgtgtttgagctaaaagttttttaatagggagtgcataacatttctagaattaacgaaccaaataatttttattatgagttgccagatgtacctttcttttttatgataagcgaggtgaattaatgaaaatttaacttttatacattttcaacgaatttaaacgcaagtaagcaatgttaaaaatatgatggcactatgtgtccaaatattggttaaaaaaatggcactagctacgtaaaaagtagatcataagcgagccatataacatttcttttatagaaatcatgtcgaatggcacttgacctattttaggtccagacttcagatttcaccagcttctctcaactctcaagcatgcaaaaaaacttccaattcaagaattttcctacttgttcaggaagttaatcgtggcgtttggcaactctactccttcaaagagtttgaaaccgaaccagatgcaattagataagtgctactgtcatatgaatcatacctagtatatatatatatatatatatatatatatatatatatatatatatatatatatataagcagagaactgattactgatacacagacaataatgggggagaaagtagaaaccatcataatcatttacggattttatacttgattagagagattcagaaaatacggaggcttcattggattacacagcaaattaggtacatggatgtaatacatagaatatccaacaattccaaataaatttgcatttcagacagtaaagtactccttgatagcttccagtacccggtttgctacttctggaccaaacaatctgggaaagcttgaaccaagatcaatctcaatggtcttgtttctaatgagaccatccctttttttcagataagctctttctgcctctcccacctctcgcttggcacaagcacaatgatccaaccagatccccaacacttgcttggaaatggggtccaaatggtccctgatgatatcctccatgcgttccactccgccattttccgtcagaacgcgaaccattatggctgtaggagaggaaacagtgcggatgtaaagggaagaagagaagtatggttgaacctctggaactctctccagagtctgcctatgtttgtctagttgagtgtcctcatagaaagttttgaggtcatctggccaaagcacaaggtctttccggggaggcaaatcaagaatgagaactagcattgttggactactgcggatcatttcaaacacaaaatttggcgcatcagttgagctgttaagataggctgaaagacttgttatatctaaggaccctcctgttggtagctttgaatgcacccagcttcccaacacaaaatctatctgagacaaacaccaaaaaaagaccaaattcagaacaaaacaaatgtcatcatttttcttctaaacaaaataaatccattaaaagggtggagaaaaatgtcagcagtagctacctggcaagagaacggaaccaagcattcacatccctaatcacgtatatcactttctcttccttttcttttttctgttcgtgttggaccttttctccttacacatatccaccccaaaattcgagtgtatgtttattcttttccttctttttttttttttatgtacaatgatagtaatgagatttgatcttaggaactcttgcaaactactcaaacccctcattgctaggctgaccactcggtcatgtttacactttgccattgctattcaaattaaagcaagagtaaaccatcaatttagtctctcaactctcaagtattaccctctctcctaaatagttcttagagtattggatattcatcaatttaaaggatttcaatatttgaaggactactaaatatgatttctaatcattgagggatcatttatataaaaactataaatttagggataaatttgatggcttactcattgaagcacagaaaaagacaaaagttatacattgcccatttgcttcagtatctaatccggacatagtagcttgagtacctaattctcaacccaatactctgataatgccaatacttgatttagaaacccataagccactaaaaaataagtcaaaacgaatttgggaagataaataattggcaagggaacatgaacaatgtaggggctgaaaaaaaaaagagagaaaaaaatgaaaacttagtattgaaattaaatgtgtgtttggtttcacaagaattgattcttggtacataattgattttggatcaatttttacatatttgatttcacatctgaagatttcaaaattgattctgatccagaattggcaactttgcttttgcgttggagcaaaaactttatattaagttttattcataatttgattccataatgaaaacatccaaacataaatcacatcactacaaaatcaatttcatttaaaaataattttgttaaggctaatccaaacaagcactaaggattttgggagtagaaagaagagggggaattaccggggagtcattatgagctgctctaatatgaagagaagcttgggcagtggcagtttggctttgataatactgaacatcagaggggagtgtgcaaggaagaagctgagtgtgaaagcgattctcaagcgttgagacgagatcaaccataagattcttctgggcagatgaaacgaacggaaagtccatgaatttgctgcggccttggttgttgtgggtctcctgattctccatgagagagcaagacacagaaaaggaagaagaaggtttaaggctcgaagaagaagaagaaggtatagagcgatggtaacgaggtgaagaaatagataagatggagagtgctgaataccgcaaatgctcacatatcatcacttccatcatcactacaacaatgtcatgtccttctccccaaccttttaacttttaatccttcacgtctttctttttctttttgcttcccaagcatttctttctatttttttttactcctaaccaaaatttgaataagagatatttaatatatataaaaattaaatacgtgaaataattttattatttatttttgtgtaaaattaattatatcgcaatcatgaggatggaattttattaaatattttttttgtacgaaaggagttttttttttaaaaaaaaaaatacaaatggagttaatcttccacacgatatgcatagtgattaactaaagtcaacagatcatcagcatctggtaaataatgaaaaactgaggcttcgttggtaaatataaaataaagaaaacttgtaaatcggttctaatttaattcttctggtttatatagataatagagtttccattaaataaaacacaaatatatagaaaatttggtgaagtggttcatatttaaattttttattttatattacttaacatttaaataaataaaaaatttattaaaaatatgatgttatcttagaacatctccaaaagtacaacttaagtaatttgttttgagttctatatttccgttaattgacttccaaaataaatatatgaaatttgccggttagaattaccaataaataaaaaaagtggttgtcaaaacttaaatctaggtataggggtaggcatggcaatgaggcggagcgggggtgaatattgcatttctcgtccccgcctccgactcaaaaatcgctcctcgaacccgtctccgatctccgtcgggttttaaaacccatactcatccccgccccactagggttaggttttccccgccctcctcgttctttgaaaatcggacaaaaatgttaattaagtaacaaaaaacaataacaaacccatattcaaaatatgcaatcataatttaaaagttacataacaaaattaatcaattcaataaaaaaatacaaaataatatatatttttttaatattatttattacagggcaggtgcgggtgtgaggcaagtataagtaatctcatatccgttcctatccctatttttggttatcgggaaaaatccgaacctaaatctaataaacttgattttttctgttaaaattgggatggattcagacggatacccacatattgagatcccgcttttatgtctaataacgggtacgagaatgtgtgttagggatgattggaggttgttacttggctacaggaacaacagatacttcgattagatttgtggctaaactatgttatttgctttgttacttatttgggagataagcaaattttgtggctcacagtcttttcagggcctctagtctaaaaaaaaaacttattcatcgtatatgacattttttattgttgttttatttccgacataaaaagattttatattttagtatctacataatatgtttataaattatgagtatctacagtttattaaaattataacggtgccacaaaaatgttaatataggaaattaaaacaaaggacgatatgtcaagtgtagacaccaaaatctagatttttttcttaattaaatatatttttcatctattttttcgttttgttcctatagtttctttcattttaatatttataaaatatatttattttaaacagtaaaaaatattttaaacaataaaaaatatgttatttaaagtattttaaagacgaaaaatcaaaaaacatattttgcaataattaaaataaaaaattgtaatgacgaaaaatatatttatttttttctatataaagatcaaaacaaaaaatataaaatttccattaaagaccaaagctaaagatgatgtaagtatcaaaaacaaaaaatgatagttatatttggtaaaaacaattgaaaattttaaaattagtttattaaattacaagtgtatgataaaactaactattagtaattgaaaaatataaaataataaaaaataataaaattataatttatttaaaatatgaaattgaataaatatattaaaaattagaaactaaaaagtaaaatactattttaaaaaattaaaaattattacaaaaatatttatctaacaatcaaacaaactttttaattaataaaaaaattaaaaatcaactaaaatatcttaccatacatcaccatgtctaatgacaaagtcaaatgtcacaataacctgcacaaataataaagatcaatttataaacggttttcatactataaggactaaaatgtactgtaatattttttcatataaagacctgcgcatccaaaggtgtagttatgtttaaaacaaatatattactttcagaagattgaacttgaaagctggatcctgatagtaattaacaaactttaaaactgaataactaaaacctccgcaatattcttgatattaattaactccaatcttcctagcaaatcctcccaagcactttccactgtcattcctgatcccattcaccgaggtatttagagtaaccctcctaccaagagatggagcaatccatctgatatttgtataactcttgggctgaacaggaggcaactgatataaactattgcatggtactccttccaagccgttgtaataatctcccaaaggtttataaggtcaaacaaatgaagggtcatggtcatggacatgtttatttctccaagtccacaacctgtgacaagcaaccgcccataaagtagaccaacatttatctttcttgcttcccataaaattatcaagattaagattaatccaattgtaaagaaaactgatatgatcaatgatgttgtgccccaaatgcaaaaatgaggaagtccagcataggcccaagaggagtattaagccaaactgtgtgagactgaatatatctattactgatatagacagagtagaacattctggaggagggttatgtgagtttgttagtgaatggggtcattctgttagagggacaactctattagaataaggaaattggcctagctatagaaatgctgaatattgtctgattcctctctcttgttattcttctttggaggtttctctgtcctctattacagagaatttatcacacatcaaaaacatttatgaattcaggttccagaagatgaatccaaacagtaaaggctgaaggacaatcacaaagaacatgcaaaatatattcttctaaggaatgacaatgaaaacaaaaaggagaacccgatccccttcttagtaggcaatctagcatgagctgtttgccaaataaacactcggaccctctcactagtttgaagctaccatatatatatgttggtatttaagcttccatgttttcctccaaaagcctccactatttgaatattgaaaattattatcctttcatatgcacttgaaacagaaaaactgctcattctatcacctatctggatttcagagtgtcttttattcaagagtgttcaaatccaaactattccaaagtaaaaaatcaaaaaccactaaaaataaaaaaccgaaaaacctaaagaaattgatactttttaaatttatttggatgttttttctttcgcaaactaaacagtttggttcaatttgaactttgtgcttttgaaacggattcgaatcgaaccaaatcataaaatttatattactttaatgttatctattttatgtatatgttatttgagtttcacaatgttatgtagtgttatggatacgaatttatataatgtatatcaatttttttaaacgtctttttttaaaatatgtttggtttaaaattgatgaaaatttgataaatttttattatagaaggtttaacatattaataagtttcgtagattgttattagcaatttttaatgtaatttaatttaaaagttgaaaagaaaatatataaatcttaatgaaaatcaaaccaaccgaatcatgtgttttttaagtttggtttggatgactttttattaaaaattgaaccaaaccgagccatgaacacccttacttttatctgcaccagaatcaatgtaagctatacatttacatatataaaataacgagtcatactttatatcacaattaacacaagttaaaaatattaatatgaaagatttgcacaagaagacacattttaataaaggttgatgagtcataatttttttaatatatagttatattaaacaggtcatagtacatgagacgactaacataatgcacactcacaaacacaggctcattagtgtgtgattattacatgaacatatggcttcttctaaaattatgagcctacttacatttccattagcaattgaagtcaattagaattggtctagataatgtcattttcaaatacccaatgacatatttcgatttgacctggaccaaacccaacttacatgagaatccaatttccctagcctacgttaagcccccaaccaaacactccagagatgaacaagtcatcccacagggtcctgccgttttcataggctacgatcataagaccccgaccaaatccaacttaccggagagccccatttcctgagcctaccttaagggcttgaccaaacacatctgagaaaaatgagttttcccacagggcccccgtcgttttcataggctacgaccataagatcctggagagccccattttcgtctccaagcatatgttttttcacaagagcatgcttaaggaaggaagccttatgtcgatgctagatataagggataaattgccaaaaaggtcatttttgccttgttatatgttatccaaattgtctttctcatcttcttagggtaagttgggtttggttgggatcttacaaccataacctatgaaaatggtggaaccatgtgggatgactcattcatctcaagagtgtttggtcgagggttgaacatatgttagggaaatgaggctctccgagaagaaataataaagggcagaaaaactaacccaattaatcttcccatacatcataaaactccctaacaatacaactcacttcctagtgttttcttgtgtgcgtgtttgcaatttgcctgtgtgcaatattgtgtgcgtccgtgcaattttttgcatgcatatgtgcaatttaattcagatcttcagtcacaaatctatacaataatgtgtacattgttaagatctaggaaatcaatacaaaaatacacaaaataattgtagatacaaaagtcttgttcagggatgatgcgaaagcatgtggagatctgaaacctattatctttgtaatcagaaaaccatcatcaatggtgagacgacgattacctcgtcatcgtccagggaaagaatagttccttccatcgcaaatgacgccatcgacggtcttttccatcatatgctccctttttctcaacatcttatcccttccacaatgcctctgaaaacttaaaacgtagagatagggggtcacgagcaagtcgtcaagatccttcttcgtccttcttccatagttacaatgttggttgtggcactaatttgtgtggagagatggagatcatatgaaagggggcactctagatttgaagaagatgggaaaagaagaagagggataaatttggaaaagtagaagaaatgggaatttgaaaaggctttggcactgtgcacaaggagtttgggtgtggcaccctagactctatcctattacagtattacacagtaacttagcattgttacccactagagaaatcaaagtgcaaatgtagagtaaaataaggctacgcaacaacaaagatattctcgtcgacaacacaaattggcggtttcatagcggcttcgacatctcatttttgcaaataaaagggtgaaagattgaagagaaacggtcttgcaacaacatgggtaggattttcaaaatcgatttagataacacaactcaaatacatacaagatcgcaagtcatattcagataacattttacgattccaaaaaaaaaaaaaaaaaactacacttaatcctttctaggtcgtaatacctgatcgggttaccaattttttacaaaatcgacagttcaaggcgtgtgaaatcaggttacatgcatgaacaatcctactattgactcaaatcgagctacatgcatgaacgatcccataaattaatttggtccgattttcataacactagcttgagcataaataatcaaaaacctgaataaaagaaaaggtctcaattaagacataaaaattaccagctgtgacagaccaaaaagaaatatacaatgcattttgagatctgattatatttaatgcagtatagaagaaataacatactgctctcaaccaacagccacaccacacacgacctgccacatattcgcctaaatgccaccctcacaaaagatcttcacacccctgccatccaaaaaaagaagtttcacactgtaaaaataagtcttttctcttatcattattttttaccagctccccccgaaccacctatcaccatacaaaaatcatattccagccacttccacagtcaacatcttcatgaatattttcaagctgaaaataagaatacaaatggtaaaataaacatgtcttaatgtgatcttaattctttaagagtataagcttctcatcaatttgttgtacagaaacaataagtaaaaaacctcgcaaacctctaccaaaaaagatgctgaaaagagaccttggagatttcggaagaccatcatggttcgaagatcagtagagcaacttgagtgttttaaaaccttaccaacaaatagcatgttctaaagatagttatgaccattgttgtcaagacatataatgttcttggactcaagtcaaaaagcactaaagttataacctgaaacttgagtgttttaaaaccttaccaacaaatagcatgttctaaagattaaagtaaaaaaaattaatttaacctaaaaattatcgtcgagacagttgagttaatttaatgggcaaatgattatatttatattttagtgtaatgacctaactaatccatgtgggtgtaacgtacattgaacgatttctcattagtagactgtagacgttacatttgataatgtatcaataatcacgtgtattaatattcacgtgctatgtcagttttctgaacttgttgagtgtaaaagaaagtctatgtgaacttccttcaactatacatttttcgcaggtttaatttataccacattttggcacgtgaagtttttgttcattaaataaaagtataattcctaaaatgaaatttattttgaccagcttattgtgataaacaaaaacgtctcataatttatatttaccaaaaacaaaaaaagtctcatcatatatgattcttttttgtcagcatcatttatgaatgttattaagaatcattattagatgtacgttaaatattaaacaacgttcttaaattgtcaaatttacatttaagattaaattaagaatttgatccttacacacctatacattgttttttcgttttattatataggtgtctaaaaacctcaagttattgatttttttttttcaaaataagtttttaatctctaataaatatttaaattttatatttatttttaatacttttttaacattaagtctatgataaaacaataattttatttatgtttcttacatttttttaattaatgataaatagtaaatttgtatttatttcttgatatttttatttttattattagttttttttccaaagagaaaccgataataaaaaagattataaaaaaataaacacaaaatttaataatatattatgaactaaaaaatgtaaaaaattaaaaataaatgtttattttatcaaagaataaaaataaaataaacattattaaaaaataaatttaaaattcacatatttattaacaaatcacgtacatattttaacttcttttttttttgtaattttgtccatgacggttgagaaccacttagaggcctatgcacttcaaccagttagagacctatgcacatcgcgagcgaaagaaggtacatagcttctcccctcactaaaatggaaattccttagacagtcttatctctgaaccctgcatcatcttaaagttcactgccattaatattggcatggaccccaatggtgttgaatggaaatctgataatgcagccaagtgggtacttcttttctaactttcattaccagattgtaattccattcattatacattgttgaataagtccactttctttcttgtccaacagctttggaatcgcttaacaaacatcaaagagaatcacaaattccagaaagctagatggcaaggaaggtcagcgggtagaggactcagctttgggacttcgtcatattaccaatgaaatcaaactgtagcatcatgtaatgtatgtcatttttcattttattgtttacataagatattcagctcacacatactcattttattgctaatataaaaacttaatttaagattatgtattttatatatgtaccccctcggcctactgatagttcacttaaaaaattacattcggacaggtacactgtacatttacggagattagtaagtttcattcaaaatttgaaagttaatattaaaaaactacaagtttggcagccgttttacaaatctttaaaagaattcggattaattttatgaaaatgcacgtagtgcttaattttcattagatgtactttaaacagacattaaaaattaaacaaactgttgagatatcaaattctgaatcctgcatggtagtactaagattaagattgctttttgtatggagaaaaaataagaaatcaaaaagtattggtatgtaaaaaaaaactattaaattatgaaacccttctttatattttccatacatctagttaaatattctcattttctagtatgatatcaatcatcaatcaatctctctctctctctctctctctctctctctctctctatatatatatatatatatagtataaaacatgattgataattgtgcccgttaacacacacgacaaacaataattaatttagattctgggttattaaatacatttttctcttaaaacaaacaaaattaacaaaattaacaaaatcattaagaataaaaaaaacaaccgcatttaaaatatttaaaattacaataaaaaggaaaggagaatattttcaatacatatttattatattgatatattaattaggtttaaattgatttttcattgaaaagaacagtcttttgtaaattaacaataataatctgaacaatacacacggtcattaattacgtactagttaatcttattgaagactaatttatcaaatatcaattgtgcatatgagtccctaataaaataaatatgcatgtgtattttttcaaagaaaataattatttcaaactgctactatgccaactcattcataagagaagggctaaaaaaaataagacagatcagagaacagagtcaaattctatttactccttagagcatatagaatcaattttggtggtcaactcttagagtcataaacaagatttgctaaaataaaaggatagaacattaaaatccgccttatttatctcgtgtgatatttagtaatatacattgttgatttgatcatgcttacgtcaaatatgaataaactaacaccactaaatggtccaggcacacatgtacgttttctgtaacggcatgctcggtagtgcacacgtccctataaaatgataccaacaacgtgaggtcttcgcgtgcctgaacgaggaaagagagagagagggttcaagaaccagatcccggtgcaatggctggggtcgtcgacaatcagcacgactcaaaacttggcatacctggtactattacaacaccaaataacccaacacaacaccccttcatttttgctaacatatttccttccttgccttgtctgtcttatatactcatgagttaacattcattatagtttattttgattatcatgctgtaacatgttatttggttttactatcgggcgtatgagaatgaattaattggtatgaaattattgaaccttgaataaaaaactgcattacatgttcccaaaaaacattatcgtccatgataattctttgccgcttgcgtgaaattgtctggtaccaacaaataattctgtctcgtcggtttttttgtgttattgttgttgttgaagagggatcaccaaccaagtgaaagggagtggtttaatgtagagtttttttttttttttttaagtttattcatgaaatctgcaataaagaatttttcaagttcatccagaaaacttgtaattttatcgaagttggtgaatatttattaacatattctctctcttgatcatagacaagagtgtagagccacgttgaatttgtatttgtggtgttgtttgtgtatgccggtaccctttttatcctttttagtgtgtacgcgtgtgtttttcttcttcaacatagctatacggtgaaggttgtattgtattgtattgtatgtgttgttgtcgtaatttttttaacaaaaaaagatcgaatttggaatctttttcctttcttttttctttcttagttatttaatcaatcttatatgttggtattgttgttgcagatgaaagtgatgaggtagatgagtctcctattgaacaagtgaggctcaccgttccaacaaccgacgacccaacacaaccagcactgacattcagaacatggactctggggttggcctcatgcattatcctctcctttgtgaaccaattcttcggctacagaaccaaccctctctacatctcctccgtctcagcacagattctctctctcccagttgggaaactcatggcagcaacacttcccaccaaaccaattcgtgttccgttgaccaagtggtctttctccttgaaccctggccccttcaatctgaaggaacatgcactcatcaccatctttgccagcgctggatctagtggtgtttatgccatcaacattgtcactattgttaaggctttctaccacaggaacatccatccacttgccgcttttctcttagcactttccacccaggtcattaccatttcattattatatagtaaacatcaatgatgtgaaaaagagagagtgagaaactcataaatgatgtgacgggagatggtgagagaaatagaagaaagaaaaaaaagtgaaaatgaaacaacaatgctatttagtatgaaaaacaccttaaaaattagattacgaaaagtagggattcataatcatacaaggcggggttgttgtgaaaagattttttaaattatatttatttgaagtctcttcttaactttttcacgaaatatttttcgcactaaagagcattttccaaaatgaaatatacgaatataaaaactggtttttgtttttacttttaaggctattaatcaaaataacaagcatttttcaaaatatggttagtctgctaaaccttgtcgttgaatttttagatgcttggttatggatgggctgggattttcaggaaatgtcttgtagattccccgtacatgtggtggccttcaaaccttgtacaagtgtctctatttaggtatttaaatttaactattctttcttgtttggtgatttttggcgtctttatttttttggatatgtgaatgaaaaggattaattatatgaaacttttaattttggaatattctgtctgtgataatgacagggcatttcatgaaaaggagaaaaggcctaaaggaggaaacacaaggctgcaattctttttcctggtctttgtagcaagctttgcatattacgttattccaggctactttttccaagcaataacaacaatctcctttgtttgcttggtttggaaaaactccatcactgcacaacaaattggttcgggcatgaaaggccttggcattggttcatttggcttggactggaacacggtggctggcttcttggggagtcctttggctgttcctggctttgccatcatcaacattctggttggatttgtgctgtttatgtatgttctggttcccatttcttattggaacaacctatatgatgccaagaagttccccatcatcagttctcacacatttgattcctctggcgcaacatataatgtcactcgggttttgaatgctaaaacttttgacattgatatggacaattataacaattacagcaagctctatctcagtatcacatttgcattcgactatggattgagctttgcaactctgactgctactattgcccatgttgccctcttccatggaaagtaagctttgtttagttagtgatataattttaatatagtaccatggataaaacttagatgatattccatagttgtgttgtttttctaactggatttagagtttcacctcgataatccatgcaataaaagatttcattaaatgttaacatgaattgtagaggtgaaattataattctgattgaaaaataatatctaaaacacctataaaattgtattatctattggtactcatgatactattctccaattcaaaggttggcagtgattcttaagataaaatacaacttggtcaactttgattgcagaacaatatcattcaccagtgtatctaaatttacattcccattttttttatttataataaaccatctaactttatgcttgtggctatctatttgaaagaacgatttatcagatgtggaagaagacaacatctgcactaaaaggacaacaacttggagatgtgcacacgagaattatgaagagaaactatgaacaagtacctgaatggtggtttgttagcattttgcttctaatgattgttgtatctttgataacttgtgaaggctttggcaagcaactccaattgccatggtggggagtcctaatgtctcttgtaattgcgttagttttcactttgccaattggggtcattcaagcaacaacaaacacggtaacgtccaatattgtccaagtagacaaaagtgttttgcatgcaaaatgcaacaatgccttgtttgttttgtatggctttcaaaaggttgtatttttcttgttttgcagcaagtcggactcaacgtgattacagagttaataattgggtacatttacccaggaaggccacttgctaatgtagccttcaagacttatgggtacatcagcatgtcacaagcgctcgggttccttcaagacttcaaattaggccactatatgaaaattcctccaaaatctatgttcgttgtgcaggtaggtataggatatgataggatgtaaatgcatgcacatatggttgatctaaacaactttttttttaatcagtaaatgttagttttattagaatgttacttttattagccgaagacattgaacgcacaatctttgtcatctttcctttctccttaacaaaagtgatcagacaaacaaataaatagttaattttgtgttcagttggtaggtaccatagttgcttcaggtgtgtactttggaacagcatggtggcttctgacaagtattccacacatatgtgatgaaacaaacttgccagctggtagtccatggacatgccctggtgacgaagtgttttacaatgcttcaataatttggggagtagtaggaccacagagaatgtttaccaaggatgggatttaccctgggatgaattggtttttcctcattggcctacttgctcctgttccagtgtggctgcttgctcgcaaattcccaaaccacaagtggattgagctcatcaatatgcccttaatcattgctggtggtggtggcatcccaccagccagatccgtcaactacataacttggggatttgttggaatcttcttcaatttctacgtttacagtaagttcaaggcatggtgggctagatatacttacatcctctcagctgctttggatgctggtgttgctttcatgggtgtcattctgtattttgcccttcaaaattatggtgtttttggtccaatatggtggggtcaagatgctgatgaccactgtcctttggccaaatgccccacagctccaggcgtaattgctcatggatgtcctcttctctgacctctattctctaacctccatcatccattcattcatctaatgtaattataatttaatcttttttttaaaaggtttaattataactctagttatgtatcaatttaatttgctctcatttcattttgttaactgcaaacattttaaacaaatgcagtcattttttttaaaataccactaaattaaatcagttttataaaaataaatggccaaattaaatatattttaaaaaataaaggaaccaaattgaatctaaaaaataaatttcttgattttttttgaaaatttattcacaacaatattagttaatatctattttatgttaaattgtttcatattttttaattgatatataatgaaatagttttgttttccaagaatgaacgacataactaattattatttaaaattattatttttttaattttaaaattccaaattagcttgttactctattcttgtttataaaataagccattaatatttgaaaactgactattttattttatttttaaaattccaaaatactgttatttaaaaattgccaatttttttaattttgaaatttcaactcattactcttttgtattgactttttaaaataaaattctcagtcttcattacactcttttcggggtttttttaaactgccgagttttctttgttttgaattttaatttaaatcaaataattatagaaagtgctcgggttgttgtaaaaaagaaaaagaaaaagaaaactgctcaggttttatttttttcaaaaataactgaattaaaaacaaaagatagcattttttattttaaaaaaaattactgaattataaacaaagcgataacaattttttatttttaaaaaataactaatttagatgagaaaataaaatttgaagtaatagaatgtataataggaacacggtgtattttggtgcaagttaagatatattagttactatgatgttttaacttgagatagtcaaataaggccatcttaaatatatagaaataagagaaagaaggaaaacaaataagagagaaataatgaacattgcatacgaacaaaaaagaaaaatagaaaacttaaattagtaaacataaaatttgttgtactctttatcatagtttttttcaagtcctcacctctatcatgacatatcaccaacatagcttccaagcatataatagaggatgatacatgaccatataatagtcctattatggtgcgttgttttgatcaaagatgtctgctatcatatggtattttgttgtaaacattttttgtactatcagcaagaaattaaggaaagggagttttacagaaagaaaggaggaagagggtgtgagtgagagaagagaacagttccactcaaagaataaaacgtattgtcgtgcgtagtagcagttacaggagagtcttcagaaactgatgggttttttatttgagaattgaaaacttgaaagtcgttggcagaagaatttgtactgaatgttaagccatgatcagcgcaaaacagttgaggacttgaggttgtgtacatgagcaatagaagagaagaatattagctgataatttattgttcaatttaggaacaaaattgactaagaaaagtatcttcttataaattatctattgacatatctatcaacatatatttataaaatttaaactaaatagttaataatatattaaaattcaaataatataaaataattattctttaaattataaaatataaattaaatactcgtacaagacaaaaaaaaataagcgagttgtattgtataaacagaaagttgaacaagcttgtactgattgttttatgttagcagggcaagcaaattgtttgcattatgtatttgtttgacttcgatcattgttgtattctatttctatccaattaaatatgttcaaacccaacaaactcacgatggccacagacatctgaaatagtggaaaccgatttgataaaaacatcctcaccatcattggcattgttgcctagtgctactacttgcatatcacacgcttaccaatcctgctcaaacttgtacgcttcatattgatcagaaaaaggaacattttttttcagaagattaatcataaattcataatcacctcagacaatgatttgggcccgcgtaatcatttataactgtcccccactccctttgtcatgtacagcccaattttattttatcttatgaataaaaacattacaaaacataaatctgaaaagagaatgcgttgcaaccataaaaacataagaaaaccattggattaactaagataatgacagtgatggttttgttgtttctaccaagtaacgaagttcgtcacaactcacaaacaaagcaaacaaaaaaagagtaaaaaaaaaaatccacttaaatatacctacatccaaggggggaataaaagaaagagaggctctgcaatcaaaatcctttacggacgggtggtaaatatcctgcttatacaactgaaaaagtttcatgaagcaactttcctagggtcaaaatatagtccctaaatgtccatcattgagaatccagcatatgcaccataataagcctcaatatcctccacttgcaaagtaaatagcgcaaaaatggagtcaaaagggccgggatcagttaaaaagccctgggtttagccaatccctgaaaacaatagaatatgtattatgtaaagtcttagtcagttatagctgcacagataaataaaatactatggaaagaaagaaatactgcaagcaaaaagcacttacttgcttatgtcatcgagatggtcatcaaaatctacaatgtcattccacttctcggatgcaatatagtccaacaagactagatttgctgatggctctttgagagagaatcgattgttcccatctgactgaaccaacttccagttcttagatgtatccctaacataaagctaaaccataagaaaaaggcaatcttggttaatgtaactaacaaaaaaatgactttatatatgggggaaccgtatattatatatagcataaactctaggaagttggaaccatacttatataacaagcagataatgaatttcttcttttataacaaaaaaaaaagtgtttttgaaagaaccataagatttgtaacactaagaaacaaaagacaaggaatctttgtaattagtacgaattttagatgaagccttatagctttgaggttgtagcctgtataatcatgcaaagtgtgcacgttagacaacattattatttcattctcccactcttggaataggatagatcttagtacatatttggtttagcttattttagagaagtttttttttgtttgtttgtttgctaactttcctgacagaacttttggaaaaaagacaaaaaaaaattatctcccccaaaagagtggctcccaaatatgctgcagtatgtggcaaatcaaacaggaatatgataagcacccaagcacttgggaaccctgccttgaaagctagctgttaaaaggttggcggggggagagaaccaagccacttaagtacttcaccgaatatctcatactacttgaggtgggatttaggtacctcataatatctgagtccctatcagaatattcctctcttatgacttatgagctatgatcaaaacaagagaaattgaagcatgacattaagcctgaaatttgaattctagccatccaagatgatccaagttacaaccaatgaaaccccacatatctaaatcctagccccctatttctagttaagtttttagatacagcagttttgtctaaatttacagaatgatgcaccaaaataagccacaaaaacaagacagtcagaccaaccaacataagcaaactcctaactgtccaatgcaaaagcagcaaactgcagaaaatatacacattctaacgagttcacaggttttcatgatcccattaaaaataagtggttattttagtccactgacaaaagcccttgaggatttctatattcatatagatcagaatggtttctattctatacatttgatggtttgatcaaatgtatcatctaaagaagcccaaatacaattcatggagtggataaacacaatgattattgatcttgatgaaagcggtatccagtactgaaattgctaacctgcattatggcactacggtccttgctctttttcaaagcatcaagcttcttgttatctaactgcgaataattgaataaaaacagaaagacgataaacaaaaggagataattaaaaacaaaattagtaaaaaataaaaataaaaattcaacaacaaaccaatagaacggcggcttggggaaagtagcggcatatgtggtcaccaatattcttcgccacaccaccaagctcactgtcatcagatctctcattcgcgtgaaaatagcccactatgttcaaccctttagcagaaaaatattcctctatctatctcacacaaaattgatttaaaaaaaaaaatcagaaaactacaggcaacacaaagcaaacaaaaaatcaatagatgcccagaagaaaaaaaagataaacccagttgattaggttgcatgttgattaagaaagtatacgtctttgtgcataattttgtaaattacaatatggggtaagaattgaatgtaaaaaaaaatgataaatccctagagaagagagagagggagaaccatgatgagagatatctccaactggggaagaagagggatgtgagagtggaagagaggtacggcatcggcgatctcgacgacgtcgttggaagcggagatgcgaccgatcaagacgccgttgacggcgcaagttggatttttgagtgagtgaaggatgagtttgatgtaagagttttgtgcgatttcgtacctcaaaccgttgctacccatggctaagattctcgacacaaaggtttgaggttcctgttctattctgttctgtcgaacacaaacagatgcagatgcaatcagttgctttttgacaaaaaggagtaaaaaaaaaaaaaaattagcatttgggtatcttttaaatatattatcgaatgggtaagtcttaaatttctgattcagaattcgtttacatcaaactccaccgtaaatatatttaagacttataataataataaaaaattagaaataataaatatatttacgacttaagttgtaaatatatttatatttataataaaaaatttaaagaaatttaaagtctgttataaaaaaatttaatgtcgcaacatcttatacaatttacttccattagataatattttaaaaaaaaatactttcaaatgataattaattttttcaccccttctttatcaaaaagccacaatcagctaccatcaactgttgtgtacttcgcactttgtcaattcccacaattctaacttgtcactcagtaactacagtttgacagtcagtagtttttgggctttagcaattgagtccaattacttcatagctcaacaattattttcgccaattttgtttattatttttaaattatttaataggttaaattttaaattttacgttaaagttaataaccctgcttaatttatgataatattatattatacgtcatatgtgtcctttttctttgtctcacaataataacaaaaacataattatttttttatcaatattactatacaaaactcttttaatcgaatacaagagaaattattattaaaagtattgaaaattattcccctcattttcttaaataaggattgaataaattcattaaaattttggtcattcaggattaatattattctaaaagagaaatctcaatattatgggaacttgagttatactcaataataacgtgtgaatccaacttatacaaataggttagatcactttaaacgcataaaagtcaacagtttctacaaagaagccatcgacttaagggtaactgatatggaagtgtgaccttcataccctacgaattgtgatatttgcataactcgaaccatgatgatcgagtgttcgttctcacctatatcgatctctctcgaggacatcataacccctcctaaagaaacaagtttatcaactaagctaagaagacattcatattgaacgtgagacactcctctttggggcacacatcctatgtgtaatgacaattggataattgatttttcgaccataaacattatataatttagcaaacattggtatgataactaagacaacattccatcttaagtccatattaacttaaacataagagtctatacaagtatccaatgtctagtatgatctcattctcgtcaccatgcttcacaccaaaattaccatcatgatccagtttggatcttttcctaaatataatttctatcatctaaactgaacaaatatattttttcataagaaattggtcataaaaaataatttttatgatttaagaacttttctctttcacaccttaataatgtaaaaatttatgattctcatatatttttctctaattctgatatttgacaagttgattttttagttctagtattgttgcatggcgtttcaagaagccatgttggttagcctgacctcaaaagccatcctgatgattgagatattgttgttactaggtcaacggaactatcccaaaagaaaaatacaaatacattgttaaggagaatgataatactctttatcgtataattaagtgaattatatgtaaattatgtttaataattcaagttcatacgagactcaaaatttttttttttttataaattttattcaaattgaacaataataaaaagataatcaaataatttatattttatatattttaaacatataaataaatattgatgtacataaatgagttatacaataatttagtattaataattttttttctaaatatgattaatgtgaaataaatttttagtcaattttgcgaaaaaattgtacaattttaaattattaaatggtataacaattaatgtatttttataagtataacttaatctcttcatatacatatgaatctaattttgatattctgttaatacaattttttagccaattgattaaaaattatattaaatatgacacctaaattaaataggaagactttaatctttatttattattaatatattttttatataagaaataaaaaataacattttttttaattataagaaacatactattatttcattaattaatgtcaatctaaaaagtgtattgattgttatttttttaatccttaatcttttgtgagattcagtgatatatactcaattctcgtgaaagtgaatatatttattatactattaagaaaataaggtatattaattagtttgaatatttatcatttaaaaaataacaatcacttataagtttatgttatgagtaattttggaataaaattaaaatttataatattattaattaaaatcaacaaatttaatcacttttattgattgatatgatgaattatgctatttgtcttattaaatttttagtaatagatcttaaattgagatcttagaccactttttgatagatcttatagtatcatataagattaaagatctctctaattttttcctgtaatgatagatctcaatttgaaatcttagggagagagaaagagagagaaaatttattattttttgaacaatgtgcagctaagggatattgtacaagaacccattctatatgttcgagatctctcaacttcctttattgggagatctaatcaagatcagatcttaagcttaaatctttgctcaagatctgacactaaatatatttataattattgttcttggttgttttaatcaagaaaaattaataaaaaatattaattttataaaatcaatgttatcatcattaatttatttttcatttttctgactcatatcattaatatcatataaatgaataaataatgaatcttatattgaaaagataaaataattataatatgacggagaaagtattttataggacctactgttctttaagcctaaacaaatataaaatagatgagattttgaagcagttattatttaaatttaaaataaaaaataggcatagtaatggaaatggcgtatattaatgattcaaagtgactgtgttgtgttttggttgtattagtaaaaatatataagtttggggaacagagacagtgtgttctttgtttcttcgttggtgtgttacagaaagatgagcggcggtggtgggtcttcgaattctagggttccgatcccaaacaatgtacgcaaaatcatccaggacatccgtgagattaccggcaagcagcacaccgacgacgaaatctacgccgtcctccgtgaatgttccatggatcccaatgagaccgctcagaagcttctctatttaggtctcttatcttctttgcgatccgtttcttctccctccctctctccctctctcccctacttcccccactttttaagcttcactttcactgtctctgtttgttagggttgttgttcaaacttcacttcatcttttcatgttttattttttaaaatatttattgtaagaagctgaggtgaggggagctgcgtctgtgtgtgtggctctttggacattgaaactttgttcaatgtttgggaacaacaaggagattgtgtatcagtgcgcttcagggagataaaagctagtacctttgtagggttttgtttatgtgactaggaattagctataatagttgaatataataataatctaatgatattgttggtgtttgatggtatcttatctctcaggctctctcgctcacacgtgtttcttaactaatggcttcaacactatataatcatttaggatttcttgaaaagaaatgtgttatggcatatttgagattctctctctctcttttttttttaatgtcgagtgttttttttttgttcacagatacttttcatgaggtgagaaggagacgtgaccgaaagaagggggtaagattctcccgtccctccttacttgctcttgaaagttgagttgctgaatcggattaatttggtgcttcttctgccattgaggggatcaattgtagtggatgaatcttttacctgtttatccactatattgaagtgtatttattattttgattgttgtgagctgctaggcaagctttcattgtgtcatgagttgccattgtgtcatcttatgagcactgtgattggcagactccatgttgagattctataagaatcctttctttttatgaatgtttgaacagttgtggttgttataggtttctacttcctgcctatgatgaagtgtgggatcatgtgatattatttgctgagagtaaaagacttgggtcttgttttataattgcctgtatatgttttttactttttttctgtgttctgtaattgtatatgtccagttataagtaaatgtgcttgcattgtcccatcttttgctccttaatatttttctattagcctgagtattttgtgttatttttattgttgcagggattgagcagcagagcttctgatgagcctaggttaaagcaaggcggacaagggagggggggaaggggtggttctggaggatattcttctaactttcctggtacaatttccccaccttttagaggtttgactttgggctttgttattaacttacttgtctcttccatttatggagtttcgtttccacaaatggttacctggaaaccatcatttccctgtctcttgaaagaagaatacttttggaatgccatatttttttttaaagatattatcactttgtgatcctttcctcccatcaccttcttactgagttattttatctgaatattaagaattatgctttcattttgctgcttaatgagccctattacattccttttgaatccagcatgtcatgataaagtacctttccgttgccactattaatcctttgatgttgttttagttttttctttttttttcattgattatttttataagatgaactgctttagtgcagagacctgtcctaagcatcatcaaattttctactagtttattgacttgtaagttgttaccctgtcttgatgtctgttgttagatggtggtggtgggaggaaccaagctaatcgaagggaaaatggagtcaatcacattgcagagagaagtcatgctccctctactcagccattttcgcagaaaactaagactaatacaatatctcaagctacaaggtagcaatttcgttttatatttgctttaatttgtttatttcaccaaattaattttgattatgagaaaatgtatggcggaaagaaatggcttatttattccttatgtatttaataaaaaagaaatgcaagactccaaaagaagtgaaagaaaggtgaaagatgacatcactcttattttcctgttttgtgcctaaaattctaaccaaatctcacattgaagccatgcttaaaattttatgttgattaaacatcaaattgtactctttttttatttcataacttcaatatctaataataattacaatgaatagaataagtaagaggatactttatttttgattatttattgatgatcaacttgcttgaagtttggcttgcatgatcaacttgataacatcttatatcttatgattgtacacttggattgctaaatacatttatataaagttgtttgttggtgtgatgagaaatacaccagtgtcactattggcttgattacttattcttttttatagttagatatatgtatcctcttcaaaatcatttttcttaaattgcagagtttcagctgttgcaccccatggtgctgcaaatcaatccaatgggaagtcaggtcatgattctgctggccaatctcccatagttagtgttcctaaaagtacttcagctgctaaggacactggccatcaagaaaatgtccaacctcatgcagctgttgttgcagcatcctcctcctctactcaaacctttggctcagttaccagcattgaccaaggaaagtctgtgtcaagttctgatcaacttcaaactgctgtatccgatgtacattcttctttggatcctgtagtagcatcatctgtctcccggagtcttggtgtcagtggtgctattagtagggaagttgggagcaaccgaatatctgccggaccaaatcatgttaaaggaagtaaagttgttcatgaagttaatgattcattggcatccaagaatgaaaaatatgggtccatgaattcaacaagcaaaacaaatgccccacagaagttaaatgaagttgaaaataatcatttatctgaaccctcacaactttcatctccatctccaaatgattcattgaggccatcttccagttctggtagccaatcacctctaggtaaagttttgtttatatctgtttaatcttatgagtaacagggttgctttatgtcctgtttccctcaatgtactgggatgaagtattccttgaattttccaatcaaacaattctaccatatggatactatcattgctctccctactagaaaggaggacaatgtaaattttcagaagagatagtgaagaaaagcccacaggaataggaggacataggtcaggagaagaatcttagaaactatttctgaaggtattttaagtgagaagcagcatgactaagcctataatttaaataagcatgtcacttgtatgggttttgcttttgtgtgctaaccctcaaatttacttgcttagatactcttccatgctcgaaggaatcatcctgacaatctagagttgcctatttatttatttacttacaatttttctctcaattcttttcaagatatctctaattatatcccttataatgccttttggcgtgttcgtacatgtttatgaaacagctaataccacagaggtttcaacttcagaagcttgtgtgcaatcttcagcagagttgaggcaacatgttacttttccaaaccatttccaagtacccaaggctttaaaaagtggtctgacatttggaagctttgatacttttggcccaagtgaaaagtccaacagtggaactggtggtgacaataatgcttctcctgcccttgaattgagtgacgaagctgcaacttcaaggtttgtaattcatctgctccatatgtgcttttgccttgcatatcaaataacagacccctctgtgtgtgtgtgtgtgtgtgtgtgtgtgtgtgtgtgtgtgaacgtgtgttccctcatgccctttttaatggttgtaatatcctagctttgttctcttatatcaaacttcttaacaaaacaactataatctgccagaaagatagtactaggaaagtgggaaggttctctttggagataatactatgccattttccgtgctctttgtcaatcataattcataaggctgagttattatttcttttatgaattattctggctgaattaattgatttttctttgttaccaaagttattacttgtgtcatggtgtgctcatgtaatttttgttttgatggtatttcttgtctgaatatagcaatcaaagtgcatcgttgactgcacaaggagatcatcttgattatccacattcttcatcttatttgattgaaaagacaccagctacaaatggcaatcctataactagtactgacacaaaggttgatcagccaaaggaggttttgttggctcctgaaggccaacaaattccgactgttcaaactgctcaaaactatggtttgaatttcatttcctccatgttaggcactcagcaagttcaatttgagggaactgaacctcagtcacaagatacatctcgccttcctaactttgttgtaagtttctccatcttttacttcttaagatcttcctctgcttaatatttattaaaaccgaatctccctgtgtttgaatgctctcttttccggtttggtgttttgatattggccctttgttttttaaatttctttccattcatgaacttgtaaaaagtaaaaggttaacatttgttttccaaagttaatttactcattcaagtaaaaaggtttccattcataaacttttaaaaaggtttaacatctgtaaaaagtaaattattcttagtatgacttttaaggtagttattataaatgtcaataaatttaccatacatagcagtttgtaattggatgacaatgtaaaattctttgcaagtgcatatattatttattatgactgtatattttttccttttatatgattctattttttttttttttactttgtattgcagaatgcaagttcgcaggctgtgtcccctagcccaactccacccctgcagaattctatacctgtgactccacagtcggtttctattttcaggccaccataccctgctaatttcttcccatatggccactattaccctccaatttatgtgtctccaatacaccaatttttaaaccacaatggtttccctcaacaaccatccgctggcagcatgtatctaccagcagctgctgggatcaaattccctctccctcaattcaaggctggagcaaacacaggaaacacagctcatattggaattccttctggatcatttatcactccacctgtaggatatgcgccaggtcaaacagttaatactggaagctccactggaaatgaagatctggtagtgtctcagttaaaggaaaaccagatctatacgacaggacagctggttggtttacttccttttaatgtcctttatttcacccatgcatatttcttgataaaataggaaattttgttccatattttggtccctggttttcaatagtatcaatcttattttgtcaagagtttatgtttgcttcatcagcatgaaatgaaattcttggactttctggagttcctaagcatattattttttatttttttttgctacagagtgaaggctctgcagtgtggatacctgctccaggccaagacatgtccagtttgcaagttaattctctgtataaccttagccctcagggacaacatctcaccttccccccaacacaggctgctcatggggcatttgctggtatctatcaagcagggcagacaatagcttcaccttcaacccttttgcaacagtctcaggctgtggctgggcccgttgagactgtaggtcccccttcaggatcttatcagcagcctcagcctacacaaatcaattggaactctaatttttaggctggaaaacattttcttggtgcgataatgttcatatgcacacatggtgtgctcagatgcaggaagtatgaacactggcctgatctgaagtgtaaataaaaatgtggccaaagaatgagaaaggaaaattagtaactgtttttggtggggatatttggtgctaacgattttgaagggtgctaattgcaggttttctttttctattttttttattaaatttttgagcctaaagtttatttatccctccctcttttacccgagagaacatttagttgttgctatataagaaacttggtaattcctagtgataatatactaagccaagaattggtaggtgagatataccaatttttccgttctaaattctcacctgtatattacattttgatatcagagaacattgaattatacaattttatttggagcatgaaaattgtgatatctgcttttcttagcacatttctagtctcatctataagcccttcacaagccttacctgattttgcatggaggaaccaacatgcttatggatttattttgtctgattcttttgttttgaaatttttaaattcattttctatccagcatgattctagtttttctttcaacacatccaattattgagaaattactgtttgctacaggtctcgtgtgacagctttcttgaaaccttaatagttcatatgcattaaaaattatcgggaatcatagaattatatgcttctgttctcttcaatgttatttatttatactcttaataatttgggcttaattgtattttcggttcttgtatagttttttaggtgattttggtttttcatattttatttgtaaattttgtttcatttgttaacattcatagatgtggagttggaattctggcataagtttgatgtgggtcttaatttttaattattcgattttagtcttatttttaaattgtgcaatttggtgcctgtattaacttgttatccattatccctcatttagaaaaggcaaaaaaaaaatatgttaatttgcatacttgatcccatgattacgtgagcgtggacaatgataaattatagtctaatgtgtttggtataagttaaaattattaggtttattgaacttttggtttctttattttctcaattttatgaattgcatttttttttttgcaaatttgatttaatattttaattatgtaattttgatctattaattaacttgagtatttaatgataatattgatgtgatattacgatatatgtggatttgttaatgtgacattgttacattagtattttttgttaaatatttagatgttaatagatgaactcttaccaaatcatatatgtttagtaactccaaaaaaatccatatatttaatctagaaaacttcatcttccaattttttttcacgagtgttagatgttaaatatgatatatctaaataatgcgacattatattttcggttggttattagatgttaaattaaaacagtgaagaatcatattcatgtagaaaatttggaaatgaaatttgcgaaatcgagaaactagagacatgaaatgtttaattaggtcgttaaagagagtttgagtaccatggagggtggtgtgtaaggatgcaagttaattatgttgctcacttattaggcagttgtgtaattttacgctagctctcagaatttttattacatacttatttggtgtaattttatgctaaatctcagatgttttattacataacttatttggtgtaattttatgctaaatctcagacttttaatttaatacttgtatttacgacactgttatttcataaatgtaacggctttgtgtttcaaaagaaaaaagagtttgaatacaattaccaacctgacttgtgttatgtagataacaattttctattaatggcaatttttaatgttattttgaaatatgtttatgcttaatattatagataattttgttaattattatttaaatgaattaaaaaaacaaaataaaattatgttaattgaataattaatcaaggaaaaaataatattgatttgaactgttaatattaatttgaattataataatactaagttaccaacattattacttatattatgtatatactttattttaataatttagtcattcaaattttatttttattacaaaattctatagtaatttatcatttgatatatgtatgtcattattaaacaaaatattaatattttaaaattaatatacaaaattttaaaaagtattaaaaaatctccacataatagttttatgatattaatattaatatcaaaataaaattacagctatacacttgagcttttgtgtatttatacaaacatttcttacatttttaatcattacatttacctttcttataaagtgttagtataagatttgaggttacaatgtaacattttcaaacaaagttgttctaccatcaaaaacattatagacggtgtaatgattctactgcttgttcactttgtgaaaatgagttaaaccttcgaaattaacgatttgttacattccctaaataatgaatacaatagcggctaaatttatcgtggaaactcctctgttttttgtggctttccatttgcaagaccatgctcgtttcttttttctaacttaaccagacatgtcatctgttgagtaataagtcattatctcagagtgtgtcagtggtggtcgacgaacttatataagatgtgtgctaaagctaaagcccttgaacatcattcagttgaatagttgataatgcttttttcatttaagaaattgaagagactgatggaactttgtgaaaagcaagctacccttaaaaaatctcaacgaatttccagtactgtctatacataaagtttcgctaattgctaaaaccaaggacgtggtgtatgaaaaatggggtgttcttgttttcatgattcatcatctactatatgacagagacaagggtgctagaggtagtggtagtaatatttacatttgaatctgtagatgtggtgtcttcacttgttgatttcggcttcgatgaaggctcctgaggctcttgcaaattcaatgatgtgtaaactgacatcccagagagagcaacaacagcaccaccaatgctcacaaccccaggatctgagtcaaataatagataccctcccaacagaatcacacatgttttaaactgtcctaagacaacatgggttgtagcagaagtggccctgcaatcatagattcatagtgtgatgttatctaacattaaaagaaaacaacattatatgtcaaaaaatggtgttggaagaggaatgtaatctcagtaccccaatgccaatgcccctgaccactgcaagagaaaaccaaggagagcagataccaaaactgcagttgagttgttcacatcccacttgaaggataggactcctggtggatctatccacggcatcaatgccccgaggaagaaaactgtgatcggggttgtcttccacatcaatctacaatcacaaaagttttaagtaaatagtttaattaagcacttcttgaataaatgttgtatcatgcttatgtataaaatcgaagagaaaccaaggctaaacagtttttatataagttgaaagttattttcataaactatgtcaactgctaatacaaatatttatgttgcaagataagtccaaataagttgcaaataaactcttccaaatgtactctaattaatattacttacgccagagctgtccagttgccttgctgttgtaaagtagaccataaaatcttatttatggcacttgggattatccatgcaattgcaattagagcaccaaataagttgaaccctaaatctgttacagttgcaacagctacacctgctgatacgacagccaaagccaaaacctgcatcattgcaatgacatacatgattagtgcactaaaaacaacgaaagggggttggaatagtcctttttaagatatgtgaaatgctttataaaagagtagaaaagaaaaagaagggaagaggagtaattcctcacctttttaaaatcaatggtttttccaaaaagaatgaactccgcaagaacaatcgttggggtaacagcaatcttagccatttggtagaaaccaacactgcaagagctggattgtcagcaaaaagtaaagttccaaatctttttatcataattcataaagatgctaaagcaagtgaataaacctgttatacttgaggctggtgtttgcaaggccagaggcaaaggccataacaacaccaagtgcaaataaagaagagaatggagttgttttagatggaggggacacaggaagcactgagagtgtcttgaaaatggcaaggagaagccatgcagtgatgtagtgtacaaatgtgaggaaaattggaaagttgaagccaactttacccatcacctgttaacaacataaacatgtaagggtgcttgatcaatcaataggcttgtaatgactagttgggacattcagttcatcacattatataatacatgatagaaaagaagcaaattgtactgaccaatttgtttgccatgataatcccaacagcaaccataaaattgaaggacagtgccaccactggtccacaatatctttgctgttggcgcttggctccttctgaggttcggatctcattgtagagagaagctctgagttcttccagtgctctacctgatatagtttcaatcattagctggagcgtacaccaagtctagtttatattggtattgggaacaaggatattggaatcaatggtaatgactaatgagtaatatcttataatcatttcattgcaaaagggaaaattgtaaacattgaatatgtccccaatattactccagggcacaaaattagcttgtgtataaagttaaaatcaacttttgaaaaaactaatactttttacatataagttaatggagaaacttgttttatttcttttattttattttttctcctacaaatacttatgagaattttgcctaaagaagactcaaataaattgagttctaatcagctgtggaaataaaagaagtgcattatagttcaacacttaacagaaaaagaagaatggagcataagggcagatgccaaagaaggaagaatgaaaacaagatgaatattagatcaaattcatatacattcatttcaagtgtcatttcttttaattggccactgagaacatcaatgaaagttgcagaaaaataaacagagaagtatcagttcaattcaaaatcaaaatgggtctcagaaagtttctaggatccgtaaaaccataacataaacaacagagattatgaatgtaaaaagagagagagagtaacgtaacaaacttataatttacaaccgccaaggccggagtatccaatgattcttaaacgataaatagtatttcacacagaatgagcagggaaaaataattattaatgtaagattaagatagttgggatctattcatcaagagttgaacatgaaaagttcacaagccaatcccagaaaaagaaaaaaaaaacaatatatgaacataggtaaaaacaaaagttgaatgtacattatgcaaattagatataaaaccactcagttgcatgaaataaaactgagtcacaatgaaatcagctaagaaattcagaaagacctgcatcgccagcatcactgtctttccttttaataaactttcgtcctcttccccacagtgaatccaaccaccccataacaatctggcctattcatggacttggatcacatatttattcaagatgctagacactctttctaaaacactattctataccaattagattaaagaagccaaaacagaaaggcaaagagaaaaaagggttatataaatatgaattaataggccatgttgcttaaaatacaatcaatgtatgttaggtgcttatggggaaacagaaaattgacattcttcaaggaggggtttttcaattgcatgaaaataaaaaaaataaaaaaataaaaaaagacaaaagagaaaagtgaagggaatttactgtgttccaagagaatttagcatttgatgagagtgccaacaatttggcaacacgtgtttctcaattcaagcctactagaagtgtagctgaagaaggtactactagcatgcaacacctgtctatgatatctggtatactaggaattgatgtaactgttgatttacgggaagttaatgtaacatcatgaattattgttatatcattaggaaatagtcaagacacttgtagcaacgaccgctatgcactcttttagtttaggtaagattgcctaatctcatggatacaacgtcatttctgataaggtatatatcatcactaaacttgatgcaaaagttccatcttactctaactgatccaaatgcagatttgaagatatcctaccaactggttggtaccattaaccgttaaagtgatgcaaactttttttttttttctcttttgtagattaaactagtattttagtccatatattatatgggataaatgttttttttatttaattaaatctttaaaaaatgattagttttgaaaatataaattatattataattagaatttatagtaaataaatattgtttactatataaattatagtttgtatttatgataaacatttatattgtaatataagattattttgaattatttataatttaatttcttttgaaagttataaattttaatttaaaataaagatagaaaataaattaaaagagataaatgattaataaaacatggataaatataaaaagagagtgttttgagatggttggcttaatatcttgtgaaaacaaattcttttttgaccatcttaaatcaatttcattttatctttatacatataattgacttttcttaatcatttttctctttcaatttatattattatctttatttctaaattgaattacaatttttaaaagaaattatcagaagttaaaagtaatcttgtatcatcatataattgtttatcatataaatctaaaatataacttatttattaaatatatttatttagtatgatttgaattacaatataatttatatattttaaaatgtttattttttgtaaattttacacacacaaatttatgatataagaatatactaacaagtttagtgtaatttagattttatttgctacatttggattgatggtatagatagccatcagggttaggttgaattcctgaaatagggaccaaaatctctcatggacatggacagttatatcttattgtgattcagtggcaaggtcattttactcctaacaagaaatgattcactattcatgagtataaattactttcccattactaacatttgtaatttcatactgtcccatgaaaaaaatatttacgaattggactcaaactacttcgtaacacctttaatttaaattacaatttttttctttccattcaaaagttacactctctttggttgaattgaaaagagaggagacaaagaaacaataaattttttgttgagaccaccaaaaatttgttttgcccaaattagagaaagaaaaggcgaaagtaatctttatattataaaaggactaaaatgatattttatttatttatttgtcatggttctctctctttttaggttattcatgtcactttagatacaacttttttttcttaacacatataaaactttcttttcattttctttcttattaaacaactaaaatatcatctaactttaaaacaaaaaaatcattctcatttttttattttattttctaaactaaactaagtattgatgtctttacgttatacattcattttccgagggtggggacaggacagggtgcaaattatacaatttaggtatccaatttatactttcaattaataagtccatggattcgtgttgtgtgtgagagtcagctggtagttttcattccgttgttcatttgaaaggttaaggatggtgtgttgagtctttgctgaatttttttattgacaaagggagtccacatgccccaagtttccttcaagtatatattgctccccaaaaatgtaaaaggatcaattagtattgctaaccttttctcaaatacacttgaagtttatagtaggtacattagtgatggtatgatcatatttttaatatagtcaaatattttctctagtttcatataagtaaaaatgttacttggtatcttagactcaactataagcaaatctgattataagtaaaaatgttattttttatatcaagttctaatgaagaatattttaaaaataactttattttttatttgagattaataaaattaaatgattttaattatttttttaatcaatatgaaagtagttgtttttacttatatacgaaattagaggaaatataaattaaggataatagttacagtcttacagaagtaataataatttttttattagagatgagatgtgttaaaaaaattacgataaaatgggttactagtaaatttttccttttaaatttcttcaacgtcaaagtgaatattgtggcatgactgcatgaagggtgacccatgaaatgaaaaaaccaaatcaagacagaaaacacagattttgggcccaacacaaccgctctgctatactatgactgctaacaaattagtttgattaatgctacttgcttcactgtactatcagttagatacatattctttttcagtttttctattcctatcatatcttacatattttcatttatatatatatatatatatatatatatatatatatatttctttttgaatcttctgagaattgattgataatatattaatatgaaatgcctttaataaacatccatggctgttaattctctcaacagtgcattaaagttaatattatctaaaattaagaatagttttatcatctattgattgttaaaaaagtcaataaatcatagactttctacaaaatgacgacaccaaaaatgtatttgtaacatttaatgttacattcttaatatttttttaatttctaattaaatgttaaatgttaaatttttaatttctaattaaattatgccttgaagtaatggttaacgaaatcaaacttagaatgtttagaaatataatattaaattgtttgcatcaataacaagacaatgaccatgattaattcagacaatattatcacatattactcaaccaaacattaatgagcataattaaaaaacagtagattgaacttaaaacaaggtgtctacaaattatacccgtgactccggttgaccatcccacaacactaaaagagtcgtcaaatagatttactgatttacacatcagtgttttgtgagtaaaaagtatacatgacaaatattagatggtcttcaaagcaccaaacacttgaaaaagagaagtgaatctacaaaatggcattgccgttacggacatgactgttatcaatcacataatttagcctattattcattgtaaatgaactatttttattttttttaatgagacgaattgcatcaatttgatagacacgagattaaagacatgcagcgtgtattccattaatggtcaattacttaccaagccaatttattcatgttcttgacatgttcttatgacaaatgataatggttaaattgaaaggatatgtgggaataacatccatgcctttcatggaccaagaacttgtcatgaaaagtacgtggcccaccaactaaaattctgcctcaatatataggcaaggtcttggtctgatgcagttgactcacgatatatctaattaaactacattattagactacctggcttcaacaaagttctcatagaatccaagatcatggagaaggaaagagaagatgagattgaggacatgtcaatgtcacctccatctattggctccatgcagattgcagggagcaatggctttggtcacagcatggagttcatgtctcaggcataccttccaaatatgtacacagagattgacataaaagttgaggatttcagtttcgaccaagatccccccctccccatttatctcaaggtagagaaaaatggctaaattctacaactttattagaattttctttccacgtgcattaggagaaattatagtatggttcaggaccaccacatatagatggtttcggccaattttcatgtggcatgtaatcgagtttttcaatttacaagagttaagaaaattcggttacgtgtggtacatagaaatcggccagaaccatggacttgtgatggtcatggaccatatgttattttcttcgattgcattagagcaaagtttttctttttatgagaatcatagttcttcatgcaatgctattgaggatcttgatgattaccacttgatattgaaaattgatttcaataagaatattctcatcaacagtgttttaattgtgtatttatgattactgtcatttgctctcaaaattctcattaatgtgcagtttgaagatgtagagttcaaggtgagggatagccaagcggcttccaagaaccctgtgaagacaatgatgtcaaaagtaggcacacaacaccacgtggaggaagatagatacaagaaaattttgaagagtatcacaggaagcattggccctggtgaaattcttgctttgatgggtccttctggtagtgggaaaacaaccttgttgagagttataggtggaagattaattgacaatgtgcaggggaagataacttataatgatgttcgatttaatccagctgtcaagaggaggttagaaagcttcatagacatcagcatccatgtcatgacatgtgcttttatattttaacagaacataagcactcttctgtttgttttgttttattttcttctttttctgacttataggattggatttgtgacacaagaggatgtgcttttcccacaacttacagtagaggaaacattaatcttctctgcattcttaagactgccaagcaatatgagcaagcaacaaaaatatgctagagtggagaacactgtcaaggatcttggccttgaaaggtgtgttacattaattgattctttgaatcctccacaattgactaaaaattagttattatgatttcgagtaagccgcaagcaaagaaagaaataaaactgcttccctaaataatctcttatataaacatagatgccgccacacaaaaataggtggaggatatctgaaaggcatatctggaggagaaaggaagcgaaccaacataggctatgaaatccttgttgatccttcactgctgctacttgatgaaccaacttcgggccttgattccacctcagcaaacagactccttctaactcttcaggggcttgccaaggtatcagtaactatatttaactgtcattttgataacatgcttcatttctataaccccacaatttacttttgatttgcctaaagggtggaaggaccataatcacaacaattcaccagccatccagcagaatctttcacatgtttgacaaacttcttctgatatcagaaggctatcccatttactacgggaaggctaaggactcaatgcagtacttttcatccttgaggttcatcccggaaataccaatgaatcctgcagagttcttgcttgacttggcaactggacaagtgaataacataagcgttccacaagatattttgaaagatcaagaatctgctgactcttcaaaagctgttattaacgttagatttatgtattatataagtcttatatgcttgttctatctcaattctatttaataattgatcctttattttatgttagtatctacaactcaagtacaaagacacactggagccaaaagaaaaagaagagaatcatggagcagcaaacacaccagaacatcttcagctagccattcaggttaaaagggactggacagtgagttggtgcgaccaattctttattctttataagagaacattcaaagcaagaagcaaggactattttgataaattaagactagttcaagcacttggcattgcacttttgttgggattactttggtggaaatcttctaccaatacagaggctcaagttagagatcaggtagtttccatgatattgatttcaattttttcaaggctgagctgctctacctgtctcttcaacattaacattagaatgaactactatttttggtgcaggttggtttaatgttctatatatgtatattctggacatcttcatgtatttttggagcagtctatgtctttccatttgaaaaggcctacttggtgaaagaaagaaaagcagacatgtatagactgagtgtgtactatgcaagcagcactctgtgtgacatggtggcacatgttttctaccctacttttttcatgttaatcttgtacttcatggccggatttaagagcactgttgcttgcttcttcctgactttgttcgcggtgcttttaatagctataacaagtcaagtaagctatgttgagactcataataagtaaacgacgtgttatcatttttgtttgaagctttaatgaatacaatgttgttaatagggggcaggagaactatttggagctgcagttatgagcattcaaagagcagggatggttgcttctttgatactaatgttattccttctcacaggtggctactatgtccaggtatgtatgctatgcacaaggagtagcaacattgtaatttgtatgcttaactgcaactttgtctccctactttctcaatttcacgaattttgcctctcaaatcttttttttttctcgtgaatttaatccctactattttagttgtacaattttggttcatatgttaatgcattgtcacgtcagcacatccatgccttaacacacataaaccaataattagtttgttttggaagtgacatattcatgcatgatcatttggtaagagttgtactcattttttattcaaaagctagccttccttcacagaacgcttgattgtgttgcatgcagcacgtaccgaagatgatgcattggttgaagtatttgtcgttcgtgtactatgggttcagactacttctaaaagtgcagtattcaggagagcaaccatatgagtgtgaaagcgaaggagggtgcaggacactgcagagttcaccatcatttgacactgtagacttggaaggaggcttaactgaagcatgggttctggtagccatggctctatgcttccgcgtgttagcttacttctgtctccgcagaagaattgacatttgcaattagcctctcatgaaatgaacaacatgtcttctatgctgttgttaactaaacagcaacatttgagaaaaaaagtgtctctgctggtgtctactgtctagttgccttttcaggataaacagttgctgaaaaaacacaatgcaagaaaaaataaatactgtattcaagctctaccaagtaccaaccattttaaagaaatgtgcttcataacagagttatgtttttttacggcttgatgtttcaatctacaaatgaaattaatgttttttttttgtttttttttcatttcttcttttgtaacatagattagttgacccatataccataaagaaaagtaaaaataaaattttgatctcttattaacatattttatttcagtttggtctcttaaatttagaaagctatcactttaatttcttaaaatgtctatgttaaactgaattgaccattttattagtttctcatactaatttattaacttagtaatacgtggcaaacggtgaaaaatgtcatattatataaatgtatgtcatatcaaccaaaattgacatattagtgacaaaaactaaggagcaatttgttctaacaaacattttaaaggaaataaaataaaattttaaactttcgcaaccaaattaaacaaaatgtagataagaaactaaaaatttattttaaaaagaaaaaaagtagctgccccatactttaacaaccttttagttaaaatacattttatttgatcattatgctacattaaatattttaattcttcttccccttccgttaaattagataatttttcacattttactatagaagatattagaaaaatgatcaaatccataggttgattccaccccaaaaattatattttgattgcgcataaactatatcaattataattaaaaaaattagataatcctagtcattcatgacattattgctacaatctttgttatagaattggacataaagttttcacctaatattacgactcttttaaagccttaaaaaaaatctaatgattggatcaattatttatcccttgatatatttgtaagatagataagattcaattttataaattagttatggattagacccattgaattttgtctcttctaatatttttttaaaataaatacatcttaatatttatttaaataaataaataataaaagtacctattgatctcatccttaaaaaaaataaattttaaatttattgagttataattcaattcttccataaaactctcttttaaaattatcaataatttccttatcattttcgattaaaagaaaagaattacatgttaattttttacttaaacaaaagaaaaaaatatacactttacagtattgttcgtgagtagagtaatttaaagatataagataaaactgttagtgattacttaattaattaatggcttacgaaatctcatactaatttagttatgatgaagattgggatgacttgcgggcacgtgaagaatgcaatgccgcaatggaacataagacaagacacgaacgaagccaagtaccagttcttcctctctttttttttttccaatcttttcacttcatattcatagttcgtactattacttcctgtcagtttaaaaagctgcagtgttcacttttttaccacaaaacttggaaatcaaatgatactactattactgtatctctttcttttattagccattcaatccttactgacagacacaacatccttagccagcacacacataacataacacattcattcactaacattatttgcacttcactactatttctgttctgttcttagatggaccttgtcccttactctgaccctaactctgccaccaccaccccaccgtggcacgacatgttccgatccgcatccctccgaaaacccacctccgatcctcctcctcctccgccgccgccgtcaaatgccgaccaaaaagtcaacccctccggcgactctcagtctcaagcgcgcctggccctctacatagccatggcccacgccgggctcgccatggccattctgatcctcttctctctctacaaactcctccaacagtacctcaaaccctttcaatgggctgttctctgttccatccctctcagactcattcaccaaaccaccgtttgcttttggtctcaccctctcaatctaggcctccttcacaccctcctcgcccttcccctcaccgtcttcacgctcttcattacaacccttgttgagattcgtgaagcttctctcagaacccttctcaggaagccaaagcctgagaatgagaatgacaacacaaagaagcgtagcggcttttccaccgtgcttcgtttgctcttgtcctttggggtgtttgttgctgcttatgagaggcttggtgctgttgggtctctgtcacttctaggattaggctttgttttcagttccaagaacgtggatttcagtttctcacttttctttccctctggtgcatttttcacaagaggggtattgaagaggttgaaaaccgttgtggctgttgggttgattgttggcatgattgttgggttcttgagtggggttatattcttctcttacaagattggcggcgaagggaaagaggcagtgatttcgctgaaggttcgagtggaagagaacaattacgctgagagaatcggtgtgaagaagtggatggaggagaatgatgttgctgggatggtggataagtacactagtcagttctatgagacggtttctgatcagattgatgggttggcaatgcagtacaatctgactgaatttgtgacggttattaagcagtttgtgataactgctcctgctagtgctagtgctaactcttcttcaacggattcgttaatggtgccttcaccatacacagaaaagctcttgagtttgaagggtagggttaggaataaggagtggggggagatttatgcagaacttgatacccttttccaagaccttataattactaggggggatttggttgagaaggcaaaagggtatgcggttaaagggatggatgttggtcagcgtgttttggctagtggtacaagtgtgcttggaagtggtgcaaagtttgtgatctccattttgaattccatagtctctggtgctgcggaggttttcaattttgtgtctcaggcaatggtgtttttctgggttttgtattatctcatcacatcagagtcaggtggggcaacagaacaagtgatgaacatggttccgatgtcaaactcggccagggtcaggtgtgttgaagtgttggataaggctatttcaggagtccttttggccactgctgagattgcattcttccaaggatgcctgacttggcttttgtttaggctatacagaatacatttcttatatgtgtcaactgtcattgccttccttagccctttgctaccaatatttccatcttggcttgcaacaattccagcaacactacagctggtactagaaggcagatacatagtggccattttcttgtctgttgctcaccttttcctcatggattatggggcaactgagattctggaagatgtgcctggacacagtgcatatcttactggactgagcatcattgggggaatggctttgtttccatcagctctagaggtaaattgttacccctccatgttttgatattctgatatttttctttagtgtttaatttttatgcactctcatagaggtatgactttattgtaaaaaaaattaataaacttatttatcatatatgacaatgtaaaaaccctttatactaccagtgtacatagactatttactcttttcttactcaatttgaactagtaatagtcttacattgtcattttttagattaacatgaaatttccaacctatatttgttctagaatttagactggtttgcctgcacaacttcgtttgaaatggttatctgcttgtgtaacttttgtgtgtgagcatgtgggatccaatgtataggtgtagtagctcaagtgtgggtcggcttattagtgaacttgtatggatgcattttcctcgtatttcataacatttgctgaaggattctgttgttccacagggagctattttggggccattgataactacagtcatgattgctctgaaggatttatatgctgaatttgttttgggcaaacctgatgacaaggtaaaggagaaggcaaattaggtttctatttgtgtctatgactgtatatttttgcggttgaagatgtctggtagagtgctagtacattgttctttgccattctagcagtggagcctgtctaggccgtcatttgtttgtacttattcttttcatctatatcatttgattattgtgattgataacataggagtttgttttcctagaactgaaattaagaaaaatcaaagtatactttggacaaaaactatttttgtctaattattaagagctactattactgtcagacataaagtctaactgttcatactttttcaataactgttcatactttttcaatggacctaagaaaatatgcacataagtacacaaagtttacgttggatcagatattcacaattcacatgtttaaaatgtccagaataattatttttaagttttttttgcatgcaggaaaaaatgtttgtttttacataaatatagtttaattttgatacattttagtaaaaaaaattacaaatttaaatgattaggtttgttgtaactaaattagttactacatttgactttgttgtaattccaataaatgatgatataaatgtagcaatcagtgaggacataattacaaataaggattaaattgattttgtttttgcataatggctaaattgaatttaaaattgatatttatccatgtgttgtgcgggttaaaaatatacgctacaattctaaaaaattagggattacgtaaataggatatttaaacatgttttcatttaaaacaatataatataaaattttaatatataagtaggatatatgttataatttatacatgctataaatatgatatattttgtaagtgccacgtgaggtgtaaataattaagcattatcctgaatcgaaagagcagagcacaagaaacacatgggatgggagtgaggagtctaaataacactcacggaatttttaaatggaattttgtaacaagcaacatgtgtgtcaagaacttaatatcacgcatgtatatgtatgtacatcccatggcctgcgtagacccaccaagttccttttagaacaaaaccttaagtcctattacagtattatttgatgtattatgcagaaactttcggttgaagttatttctgatttcttttgttatctccaagagcttaattggttcttaaagatcacttcatgatcctacctaagggacacaatatgatagaactttcaaaaatcttattaaaaatatatggaaaaggggagaataaattatatttctattatataaaaattgaaaatagataaatcaatataattattgtagtcaattttgttgcagaccagttgttgtaattcgttgatcattaacttgaatatcagtttgaaaaagaagttcaaatgtaatctattgtgcacaatattatgatagacgaagtcggtaattaagacccccgctagcaacaacttttttttatccttactgtttaacgatgatacacttaattgacaagagaaaacaaattcgtgctgtataattatatgccttgaaatcggaagctgcatgtatgtgactgacttttactcaattatattgaatatttgtatgcgcgtacaaatctaacctatccaactcaagcaattgtttagttactatacagaatgtgacatgcaccttttattggagaaccatccaaatgtactactgttcgaagttggtcaaagtcaaatagtttttaatcaagatgttggagttttgtaatttttacaataattattgtaaaagtaaattctaatataatttgtgattgatgcacagcatatggtaaatttggtttagaagttttgtgaatttatagttggtacgaggacaaccggggcaagcacatgaaattttgaggatgattttgcatacttttctaattaacgtaatcaacctttttgcttcaactttgaagccttttgatttctccgtgtatatatgaagataagtttcgtgttcaaattcaagagttcccatttcttatccattttccgaaagtgattgctttcctttgcaagatacgtcaacactaacacgttgcatgtctcaccgcccaaattggggtcaaatttgatcctaatacgtcaaaacaaacttaatcgacgtcttttatttgttaattatatgttttctttggaatatagccacttcagcaacacttgccaaattcttaatggttaacgcatggtttaattttattcattcaagtaaccttaattaacacgctgattaaacatctcgctcattccttatagattccctctctgatttccttttatgtagtagctcttcagcatttagtcgtgagggttaaggccacttattttatgttgattttaaacttgacgcgaccttttttcttttttaaaaattaaaaattaatattgatcccaaaatgatttttctctgatctatttagaactaaggatcatataaaatgtatatttgaaatttttacactttgctccattcgtaaattaacaacgcatgaatttgacctttagccgtcaaatttttggcctctaatttaggctttcccacgtttgatttggatttatggtaaccaaatagaaaattaggtataatcgatagtttgggtcgacaattctacgttttcatttcttttttccttttaattttccacccatatactttaattttccttttaagggccaaggtgtgcgttgcaatgttaatattttagtggtctgatcaatgatcaattctacgttgcagtgttttttttttgtaacaaaaaaaaacatgtaaccaaaaaaatctctgtttttttttaaagtaattttaatctctttaattagtttatgctttttgaatgactaaaacaaatggagactaacactagctctacatcaagtgcatgtatgcaccaaaatgaccacatacgaagaaatagaaaaatcaatagaaaaaattaatttaagatgttcaatgcataggtctatatctagtttccaataattgcttagcaatatgatcaaattttgtttttacttctgctagccctactttctcctacattaatcagcggatggtgacccattcggcttgcgtgatcccacaagttaattttgattctagaatattagttatggcctaatacgactataatttatgagtcaaactaacgactatagaaatcatcgcaactgatgttctgttagccaaacacatttttgacagacctataatattagtaaaaataaacttattcactgtagcaaaataatattgtattcatacaactctacattcaatcatctttagaaaccatctagcggttccttattttcatctgaaaaaaaatatcggtggcgctgtttaaacttaggttaggccacctatgaggtcagtggcggaatcaggaaaaaagtgatagagaggcaaaaatttaacacataaattgacaatgattcatagaaaaaaaaattctcaaaattaaattattttatctatcaaattaagagtaatttaaaatgtaataaaaaaaattaatttaaaacctactaaataaatgataaagcatattcgaaaataattaacatagttgaacctgtaccaaaaaatcaatgtaattaaaagcaattaatctataatagctaaaattatttatagcatatgaaataattaattagttaatatttgaaatcaaattttattattttaatttatacgcgtgttgactagataatactggaatctttggaaaataagatacagatattaccaagaacttctggtagaaatataaaactataaactgatcatcaacgtaaaaaagaagaaatagtaaaattcatcgagagggaggggggtcaatattagaattcatggggatgggtgacagtaaattttatttactcggagggtgactgtccctatagcgaagaacctagtttcgctcctgtatgagtctatacaattacaaaagatttaatcttactcttaattaaccgaacttcaaagatttttcttcaattagaacaatttacaacatgtaataaaaagaagaaacttagttgtgtggttaatacgtaaaacatagcaattattcctagacacaaggagggccacactactccaatgtgacacaaattaactgttggttggattaggtggccaaccgtttaccacataatcccaaaatatcaactgtacccgccagaattcaaatcatgttttatgattcatttatcatataaagaattaaaagattgaaattttgttggccataatgtaaacaaatgcccagcgtatagtatcagataataacttttaagtcttagcccactttatttcagagagagatagacttcactttattttcaccaaaaaaataaaataaaaatctgcgtttgtgataatcttttaatatataaagagacaaacaaacaatgttaaaataacttttgggtccctcgttttatttttttagattcaagttaaaatttcagtcaattaacaaaatattggcaagaagacgaaaaaatggacattaaacttatgggaacaaaacaaaaacaaaaaataagattacggatcaaaatattttagccgacaaagaaagggagagaaaagaagggaaattgaagtccaattgctttctgagcttggcttcatataaaaataaagcctagaggaagttggccaacggttaagttccctccaaaccttgtgattcccttcgaatcaaagcaaaacttagcagttcgattctttgtcaccctctgagacacaacctcaccttcctgacatatccttcacaccaatcttcccttcctcctcttctatatacacttcatcagctccatcccctcttcatatttttcctattcttaacctttctctacagtttgtggttgctgaaaggatcatgttattgaagctttttgtgatatttgtctgattatgttgctaggagttaaaggtggtgcagacccagaaaagatcttccaatcaaggtactagttccatccatcaacaaagttgccaattgggatgcttcaatttcaaggttcttttgatgaaaacctgtgcttttaagaaattaatactgctgctggattcaattacttgatctctgatacacgtcttggacaaattctcaacacacacaggcaaaagaaaacatttccaatgaattctaggtgcttccttgttcatccacaacaagagtatagcatggttccattttcttcaaattctgcctcagaagatagagtggctagtgctcgaaacaggcctccacgtgtcacccctccttcctttatggttcggatggccatgagaatatctagagccagatggtttgcctttttgagaagagtttttcattaccaaaatggatcaaggtccaaccttggctccaaccctttcaattctagcacttggatgatgctggagtttattgccttgattctccaaataacgattacaacgttcactttggctatttccaagagggagagacctatttggcctatgaggatttggatttctggttatgatattggctgtgttcttaatctgcttctactttatggacgctaccgtcaaatttatctaactcaaggagattctctcagcctttctgatatggaacagcagagaaacaatgaagaaaccaggtatcctgtgcacttcaaccttcaacaattttatttcagacaattttattattaggaatgggtaattaattgtacttattggctatattatagtgtactaatgcatgagtatgctctaaaatttgctagaaaagcttgataccatcgttttgttggttaaatataactgttatataaaaataaattgttctccttgaattgattataaataatatttggacaaaacaagttggattgttagaagataggaaaataccaagtgtcaagtaatcataaagttatcataattttaatttatccccttaaaaagagcttggaggaatcaaataccctcacatacctttttcactgcgatcagttcgtggcatttacttttgaaagagtagaatcttttgtttattgcattttttttttatctcgttgaggatataaatcatgtgaaaattgaaaagactaatatagaagttttaccaacttctttttctattaaaatgtattgtaatttcaagttgacgaaaaccatatccaagaattaacagtaccaattaggaattaaaaaataaattgtaaactctatttgtattatattgtctgaaataactttcatataagacctgtttggatacaagtcagaagtgcttttgagagtttccctactgaaaataaatgttggagaagtcattgactcaatcagagaaacaattttttgttattatttttagagccatgcaacttttttttggttgaaatttgaagttgtaattttaatttgcactgtattgtacaggatgtcacacttgatgaataaatgccggacttcacttgagcttttcttcgccatatggtttgtgatgggaaatgtttgggtttttgactcacgttttggatcttttcatcatgctccaaagctccatgtgctctgcatcattctccttgcttggaatgcaatgtgctactctttccctttcctactgtttgtgttgttatgctgctgtgtgccactaattagcaccctcctcggctacaacatgaacatggcctcttccaataaaggagcttctgatgatcaaatttcacaacttccaagttggagacataaagaagccggtgtagagttagagcttggcaatggctctgaaggcagtaaacaattgatcaatgaagacccagtaagtggtaccattagtagatatagactaggccttatttggatagttttttctacaagcacttttactagaagaaaatagaaagataaaataaattaaacgtctcctataaattaaaatgaacttatgcacttcatgtgtttcatggagaaatgtatcaaaatagagctcaagtaatgcaaccctaaaagctaaatgagacaaaaatgacaagtgtgttgtttactagcccttgacttgatgtacagctagctagccacttaacagctagtaatgtagttgggcatttttaccctcgatttggatgtatgcttttaagttccattcattttaagatttgtcatatttcaatttctattgaattgatagatttgttatgttctgatgtgcttacaggaatgctgtatctgcttagccaagtacaaagacaaagaggaagttagacaattgccctgttcccatatgttccacctaaaatgtgtggatcaatggctaaaaattacatcatgttgccctctttgcaaacaaggattagagaggtagaaatagcagaaacaacagtcaaaaggattgatcttatttggtcacatgtatactcttgatattaccctcagttttttcttcttcttttccttaaattttggtttaatatactttacacgtgtcacttgagtgagtttgtatatgtacagagtagctcaccagtgaccaaaactataatgtgtacttggttgtaaggaatggatcccataaccattcaaattagtgatttttcttgtattgtcatctaaatactgtgagataagcatctgcatctctgtagggaaaaaattaaagcaagtaatatattcgttccttaattcttaaacaataaaatgtccattatttagggtttttccccctaaacaaattgccaaaaaaaaaaaaaaatgtccactctttagtatagtctttgtacacatgctacttttcggccttctaccagaatattttgattgccattgatgtaggctgtgttgatatcgaatgaacagatatgatttattttgcatatctaatattaaaattcacaactaaataaaaccaactactaaataaatttatccaagtattgttattcttgtcctaaaatagcctaaaagttgtcaaaccaacccaaaaaaagcacaataatatgaagcaacaagcaacaagaaggcattatcgctgtaaaattagcttaagattgtcaacgtgacaataaagaatcaaaatggtgaaaaataaagaatatccaaaagaagtacagcgtcacggaagctgttaaattattgccaatttgtcaatcatatcaaggaaaagacctatcatagtcatagtatctcatgtccaactaggttgagaagaaaaaacgccagcagagctttttgagaacttgtcgccataaattgttgattgaataaataccacatatttgaaacaacgaaactgagatggttaacgcccaagatttgtgctatctaagagctgaggttttctgaatcttcagaggaagcataatatcatactaggggccctccctctctacattgttgcagagaatccaaagcctcaagtgaaccaagcaattcatctgcggaaggacatcatattttgtacacgccttctcaactatctaggtataaattaatcacttatattgtatatggcttcaccctacaatcaacatttacaaagtatacatacatgattcatagagggaaaccaatcaagcatcttgtcatgaaacatgatttaatgttgttgttatgtcattagcattatgcatgtaccatgtctttaattcgtgatatcttgcttcataagcaaatcatatagtagtattatatagcacacatccaaagaaaatcataacacaacaaggaaattaagataagcgcatcacaaggtaactaactctcttctttgatctccatcatatgcatatatgtccttagacacaaggcataggacattattagcagttaacacattttttaagaatctaacacatgcagctgttatgtaaagtccaaccgtgcaattatctgttttaccaatgtctttagatgatgattggcatgtttatgattctgttttacctgctgttatggcagatgtaagctcgactgtgttcccttgtggtttttaagctagtttcttggagctgattgccccagtcattcacccaaaaaaaaaaaaaaatgtaaagtccaaccacatgcagttatcttgttaaattgtttagttgttgatttgctcaaatgttagatggttaattcttaattgaatatgcgtggtcaggaaagggatggagggaaatatggagaaaaagtccccttgcatgaatctaatgaagctgaatggtaaagaaataaaaatacctggtttgaatatggattagatcaataagcagtcaaatatggttgtgtctgtgtcaccaacacctcaagctgcatctgcattgaagaagtcttcgagtgaaaggaggaattgtctatgctcacccaccacacatgttggatccttcaggtgccggcaccaccgttgaggaatgagccatgccagctctgttggctccaatctctctgcaatgaactctaaccactcactcaaatctcaatactagccttgcctggcttctgtgcttgaatatgttgtgaatattgcaaagtttcaatggaaagaactctcatgttaactaacttacgtgtagtaaaataagttttttaataacaaaaatattattttaattaatttttttgtgggataagtttttacttgatttatctcttttactctgccaaactttattattatttttttgtctttaacgttcaattagtctaaaagagattttgactaatctgaaattcaataaaaaataagtattttaatcaaggattaaactctgatactatacaaataatttgacattatttttaatatattaaccacttttatttattttttcctattggaaagttggatacggagatcatggcatggccttgtctaaaattattggggcctaagaaaaacttcttaaaaagagttcaataatcaattattaattatattaatttattttatataatatgttaactgttaaattttatggatttttataaataataataataaaaatattatgtcatctttttttttaatcattccgcataataaaataggcaaccaaactagcagaatataaacatacagtaaagcatctgccaagagaagcatttgaacatcagaaagactgctccaaaactggaacatgttgagacgaagacgctccacgtttagctaactagtaaagtattcgtgtggacatactcttaagtcataaaatctaatgtataatataattatatatacttaattgtatccgttaaatatataatataattgtatatatattcatttgtaactttttagaacttaataaataaaaacaaaaactaataaatgttgtctattttaaaaaaaataagaaaatgaagcctaaaagatatttaatattaactaaaagtattttaatttatgatatttttaataaaataatttaaattaattaattttgaccgttatagaacaaagaatcaaattattattttataatatatattaactaaatgttattattttagtgaacataaattatttaatattaaatatgttaaagaataaaataaaatatagaatagaaaaaatacaaaaaggaataatataacatacattattatcaatatttttttaccattttttgattatgcatagagctgaagtcatatttctcaaggaagatatttgaacacatataactcttaaaaatgtagctaaaacaatataccatctagacgggaaacatatttaaaaaatacaagatctagcatagtttattaatgacaaaatggatgtgtagcaaaaataagaggaaaaaaaaagaaatgaagttaaataatgatttttttcttgtgataatatacctctcttgaaatcagaccttaagccattgatccacttaagacttcatctcttgtcacacctttgtaaatctatcaataattagactcaactaattgaggtaagaaccaacaacattgagaaagaatgatagtaagtaacaataggtgtttaattagttcatagagcttctaacttctgaaataaaataataaaaaaaacctttaataatatatatatatataacaaaagatgaaagactcaaaggaggagattgtggaaatcataacataaaatgaaagacaacaactgcacttacccacgaggccatgactacttactaatgttaaaattaaaaacaccaagaaactttgacattagaatcacaaaagtgaaaatgaaaagaaaaaaaagatggatgagaatcaacacatatccacgactttttgttgttgaacaaaacccttttgatttctcaaatgaaaaacatcaagaaatccattaagcaaaaatgagggaaattaaaaacaaatatgaaatatatgtaacataaaaaaggtgtgagagagatgaaagatgcatcaaatgcctgtaaatttgacattagaatcacaaaagtgaaaatgataaaaaaaaagatggatgagaatcaacacatacccacgacttcttgttggacaaaatccttttgatttctcaaatgaaaaatatcaagaaatccattaaacaaaaatgaggaaaattaaaaacaaatatgaaatacatgtaacaataagaaaggtgaaaatgacaaaaaggatgagaaaacatacttaccaacggtaccgatgcagtagtgaaggaatgcaagatgcaccaacaaataattactatatcatcggtgattttgagtctctctaaaaggaatgatgaaaataatattggaatcttgtaaatttgcaactggctagtacgatacctgcaatatgcaccaacaaacaattattatattaccagtggtttagagtctctccagaaggaaagatgaaaataatattgaaattttgtagttttgcaactagttagtacgataccctgtgtacataggtaatatcactgcctacactttaaagagagaatgtgtgagagagatgaaagaaaagatataataggcatttaagatttaaaaggaaatattggagtatacttatcaaaaaggaggtgcaattagcaagtatcaaaatttaatagagggacttatcaaaaaggaggtgcaattagcaagtttcaatttttttgctaagagacttattagttagggttgcgagacttatcatttagcaagtttcaattttttcctgagaaacttatcaaaaaagaggtgtaattagcaattttcaaactgatggggtgtcaggccccttccttcttttattatattttattatatagatagaatatatacatagaagacatcagcgcattcttttaccttccgtgtgggtatgctagaagttaagcagccaagcttcattcttgaaagtccctatatataagattataggtgcatacggattactacctgttttttgccaaattaacggattattacttttcaaagcaaaataaatatttataaaataaaattattcctaaaaaacgcaaaaatgttctgagaatgaattataacaaggagtaatgctatttttcaaaaatgtaaatattcagacattgtttaaattttaatataaaaaagaaagtggcaatggatataaaggtccttacatatttaacataaaggtgcacttatctgtctataatttcttttatcttttaaatgagtttgagagaacaaatagtaagtttagaaaataattaaaaggtaaagtaattaaaaatgcaaaaattttcaacaacatcgttttcaatttaggtttaaatattttttttctgtaatttaacacttttaatttttatttctataattttttttcattagtctttataaaatatatttatttattttaaaatactttagataactctataaataataaaaaatattttaaacagaaaaaaaatgttatctaatatgtttaaggaaaaaaattgtaaataaggattaaaaaaaattacaaaaacaaaaacaaatatttaaacgttcaaaaaaatcataaacagttaattaggaatgacatttttaaactcataattgtgtcatttgaccaatcctcttatccccacgtcaaagcgattaatttcactcagaagtaaaaacattttcattcccgaactgaaacttccgcaatcagcatacacgtttatccgaagaaagcacaaattcattggccagagagcggacacaaatttaccataaagaaactacatacactactaatccagaaaacggcaccaaactagccaacattccaaaatttcgaaaattcaaaaaacataaaacatattaaaagactgtttctccaatcattgtttctttctaaaaacaaaacaggcaattaagtcagatttaatcaacttcttccatcttgctaccctcagcatcggcatcagcgtcctccagaggaggcatcatgtcagcatctgcttcaccagcatcttcatcaatactcagtccaagcttcagcatcctgtgaatcctgttaccgaaagtgttgggatcatcaaggctgaacccagaagttagaagagcagtctcaaagagcaagagcacgagatccttcacagatttgtcattcttatcagcatctgctcgcttcctcagctcctccatgatggggttctcagggttaatctccatcgtcttcttgctcgacatgtatccagccatgctgctgtccctcaatgcctgtgctttcataatcctttccatgttggctgtccacccatattcacctgtcaccagacagcaaggagaatccacaacacgatcagacaccacaactttctccaccttgtcacccaacacatccttgatcacatggcaaagaccctcaaatttatcctttagttcttccttctttttcttctcgtcttcactctcgtcaagtttcagtccttccttggtagcagagaccaacttctttccctcaaattccttaagctgaccaacagcatactcatcaatagcatcaaccatgtagagaacctcgtaccccttcttcttaagcttttcaaggaagggggaattctcaacagctttcttgctttcaccagtaatgtagtagatgtcattctgtccttccttcatcctggtaacatagtccttgaggctggtcatctcatcaccactcttagtggagtgatacctgagcaattcagctagctttgtcttgttctgagaatcctcatgaataccaagttttaggttcttagagaaggcttcataaaacttgttatagtcctccttgttctcagcaatttcaaagaacatctcaacgcacttcttgaccaagttcttcctgatgactttcaggatcttgttttgctgcagcatttctctagaaatgttgagaggaagatcctcagaatccacaatacccttaacaaagctaagatattcaggcatcaactcctcacagttgtccatgatgaagacacggcggacatacaatttgatgttgttaggcttcttcttagtgtcaaagagatcaaaaggtgctctcttgggaataaagaggacagccttaaactccagctgaccctcaacagaaaagtgcttaacagccaaatgctcttcccaatcattggtaagactcttgtagaaagcagcatattcttcttttgtaatctcttcaggtttcctcatccaaataggcttctgcttgttcaccaatgaccactcgtgagatacctccttaatggtcttctttttcttctcctccttctccttatcttcatccacatcttcaactttaccctcctcatccttcttctcttcctcatcctcatcatcagaaatctccttttcagtagtcttctcaatccagagagaaataggatagctaatgaattcggaatgcttctttatcaaatccttcagacggcgttcctcaagatactcaagttgatcttccttaagaaacaaagtcatctttgttcccctaccaaggttctcaccagatgtatctcttgtcacagtaaatgagccaccggcatgtgactcccagacatactgttcatcatcattgtgctttgtggtaacaataaccttatcagctacaagataagccgagtagaaaccaacaccgaactgcccaatcatgctcacatcagcaccagcagccagggcttccatgaattccttggtcccggaccttgcaatagtaccaaggttgttcaccaaatctggaacataaaacgcacatgcattagagaaaacagactaactaacatgcacagtccgcgataatctcacaaagactaacaaaatatttaatcttaccagccttagtcatgccaataccactgtcaatgatagacaatgtgttgttggtcttgtcaggaataatgtgaatgaacaactctggctgagcatcaagcttgctcttgtcagtaagactctcaaatcgaatcttgtccaaggcctacattgttgtaaaggtaataacatgtcagcaatcagatataaggcccaaagtgtagaataagagaaaacctaaataaagcataattcacaccaaatccaaacgatccactcactccccaaatagaagaacgtattaacagcatcagttttgcctcaatcaagatgcaatggttgcagtaaaaaaaacggcatagtactacgtaaatctcacataacagagacaacaggaacagggacaaaaattatgtacccgaaactcaataaatttcaattatgctatttaagataataaagagaataatcagcaccgtttaacaatggaaagagcacaatatcataacatgaaccctaacaaattaaaaaaaaaaaaaaaaaaaaaaaaaaaaaaaaaaaaccacatcaattgttgaactatgaagacaacaacaggtaaacgcacgcaagagaaatcacaaaaaaataaaaggggggaaaaagacatgtccaacaaaccctgcatgtgtttgagcaataaacatgaaaataaagaacgagcgcagtaaaggacgtaatcaacaaacggaaatagaaaaacctaacaaggatcgataaaaatcttacgtcagaggcattgctgatgagctcacgaagaaagatctccttgttgctgtagaaggtgttgatgattagactgaggagctggttgatctcggcctgaaaagcgaacgtctcagtctccgaggccatgtcgtttcaaattcggaaaaagagggaaggtagagagttgcagcgaagatgctagaacagaacgaaaaggaaggagtgcttagagaaaatggaagaaagtggcaagttatatagcaagtgttggctagggttttatgtcttctagatccttctacgctccaactaatcgtcttgcatcaccgttttgccgtggacttggtttagttcgttttcagccattagattagatttgatagattacaaattattcatatcatatataatagaaataaatatatatcaaatgatcttgatgaaatttaataaatttgtttacagatgaatattaaatatatccaaatctaataattacagacttagtaatcctaattcatgcaattcttaccaaggatcacaataaaaaataaaaaataatagtttgttgtccttacaataacgtatctctataaataggagaaacaagatagtgtgagcaatatatgatataaagatggtttaaattaggtaagatataaaataagagttaggatcacgatatatttttggtttctctaagtttttttttatgattttttaattttgatttatataatttttttatttttttaaacttatgtgagtttgtactttttcaatttaggtttatgtaagttttttttttcttgtaagtttgtgtttttttaaattttgattaatgtaagtacaaaattaaggagactaaaaattaatattaaatctcttccaatatatttaaagaatcaataacgttggaccttattgtacttttcattttaaattgatttaatttaattttgtgctttatgatcatttaattgattatcagtgaaattaaatttataaaattgatttaaattataattaaaaataaataaaattttcttatccaataaaaaagttgtctataaaaattaaaactcaatttgtatacataatcaattcttcaatatgtgaccaaatatgtgaacgattatctaaaataacattagttgatattttaacatgattttagacaattcaacataaaatcaaacacacatttataaagtgttggattttagtgatttaaaataaatgttccaatgtttggtatcatgttgaaaaattatttatgagcacataatggattttgagttaaagcatgtttatgtaggtttacattagatgaaaaaaaattataccaatttttactattactttaaattttaaataaaaatataatcataaataaatcactttacttaaaaaaaataattttgcaaaatcaatttgattgtgattaccctaaagatagtgaaggaaatataaaagtaagaagtatccacaccacctattatattttacacttttttctcattctttcccaactaatatggagtgttgataattgttatgcatagtaaagttacatgtaaattacataacaattatctcatttttttctctttttaatgcttctttttgcgattaaaacttaggaattagtcattttatgagcttttatccagtagatgctaaattttgttgactataaggtgttgattgtatttttttgtaaaaattcactgcaaggacaaggaaggagaattgagggtctactcgctcaatgcgcagagatccactcagcgcaactagttcgcttagcgcgtggtcatttatccagctggacactaaaggcacgcttaacacgatatctcccgctaggcgcgtgaccacgacactaagttgcgttttaaggaaaaatatgagggaaaaagaggggattatcttggaacacttggacagacagaaaacaagcacttaggtcacgaaggagacatcattccacaccattggagctgtcattcatcattatgttcctcatttccctccatccactccatttcccttgccttaaccctccatttgtataagtctctcatgaaaatgagaggctagaattccattgttgggagctcaacaaccaaatataattattctaattatctattcaatgtcattttcgcattattattgttttctgagttattatcatgttagtggtttgatcatgcattttcatgtattgtaataggttttaatacattggaaaattgttattttcttataattgaaaaacacttctaaatgtaccatttctagggatagaatggttttgtttagcctaagttgtttatctttaatcttaatgcaaattggttaatgcaactcttaagggattaagagcaaaattaagtgatttagggtcttgcacttgaggaatcatggctagaatatattagtagatgaaggtgattgggaaataatattgaatagcgaaaaatctttaatattgcatcaaagttagtttcgattagttaagctcccaacatacatcgcatcgtatttcaaccatcactgcaatactctgagtgtttgtgtctttgttatttgtatttacactgcttcatagtttagtaggtcaagtttaattatatgtcatttactctaaagaaccaaattgattaattaattgtttagaaacgaacgtgtattaactctgagtacaaacaaagttcatgtgaaatcgacattcggacttaccgtctaattattatttggacaaattggtacacttgacaaagtgttaacaagtgctccatataacattataataaattgttacgtgtgtgtttgtggagatcattaatatttacacttctctttttttgtcttttaactatatgattgaatgatatcttttcatattatcaaagcttaggttaaacttggcatggaataaatgaaaaatacatgcaatttactttgaactaaaagtttaccctttttcttatcaaacttaaaaataatgaatagtaatatatatatatatatatatatattgtctcttatcatatgtgatgtgtatggcatcctcttttccctaatttcgtgtatttttaaatattaaataaattgttattttagtttttactattgatgctttgataattgttatgtatttatatttttgacttaaaataattaaaaagaatcctatcagttagtttagaagattattataaatttaagtaaattaagaatttgtggtgtatggtaaaaaaatggaattttaagtattaaaatgcgtttaaataattatttaggatttattttattgtatagataattaaatgctagtgttagatttaattaagtattttggttaatacttagattgggagagtgaaggatgagtcgttgaagcccaaataagtgtgtttcccctttcactttgatttgggccaaaaagcacctaagcccaaatatgtcaacaaaaaaaaaacaattttttttttcactctcctcagtcctaacccaactagcgcgaagaggatgcgtgagaattcgagtaattatataacagtattacgatacatttgttcagaaactaaaataataccagtttattcttgaaacctacaataggcttttgaactagcagatctgctggaatgagatttctaatctacccttatagtgcgtggtagattcaattttaggttcttggacaattttttgtgagttttatggtgtcatacaagatgcaagtaattttttcttttttactttaagataaatcacattttggattcttgagtcacttttaaggatctcacaataaactccacttaaatatattttattaattaattggggatagagacataaaaatatatatttttaaaatgggaatagtttttgggaagatttttaaattcaaaaatcccatgcataaagatgttcttccgtccaaacaagtgaattgtcagctgaaacttggaagtgacccatgaacatgaacattgctgatcatccaactcttcctatgatttcactgtttgttgccgcctagatcgatctgcacaacaaattcattcgtgttgcatggatataggaacacaacacaagtccattggtacagcttcgggtacaattaatggttccacaaaattgacaagacatattaagatacgtgcatgagaagatatatttcatgtaaaaaaaataagaacatataatgatggagtataaaatcgcaatcacaatatatatacaatttttcataatgttatatgtaactaattatatatacattataaataaatgctggtatcgtggtacggaatagtgcctagtacaggtacaagtatttaggagtaccatgacaaatagtagtattcatgcatcgtactttctaatcgcaagttaacactttcttcttttctagtcaacattatctaattgatgggctacggaaatctgttgctttcttccggttgttccctggctccctcccatctccaaaatggaatgtaaaatagctttggcttctttttatttatttattagatttaagtgaaggattcatgtatgtcagagataaaagggaagatctatgaggattgataaataaataaataactaaacggttgagattttggttaaaaacatatatatgacagattatatatataaggttatgtggaccttaaccaatatgaacaattaatggatgtaattatgtaagtccttaattttttttatcttcttaattaaagtgaaatacttgtttcaaaggggaaattattgtatagtggagatcattacattgtatatatcttccactaaaatgtaatatatataatcaaaattatgcgcacatataatggttccaaaaactctatagttatttttagttttatagggattgaaatctataggttcaagaccaccaaaactttaggcacgtaatggtcccacttttgtttgataacacattacctataggttaaattattctggttcgtggtttataattaattaatactgcatgactttgttttattttttgaatcgcatacgaatctttgaacaagttagcgagacaacgctcttaattatgtttcagtggacgccacaatattgattctaactactgttatcttaaaaatgacttgtagttatcttgatggcaaggaggtcgctttgtaatgatgaatggaaacagtgaatagaactagtttatcgaccataggccatgattaaagtatataagataattaatgtgaacaagatgatccgatcaagctaaatttttcactgtaaagatgcattgcaacccttgaaaatgtttctttttctactaaaataaaatatgaaaacttgttttgcaaattgcaagctaatttaccattggatgatgagtgcagtttaattgtgaactctaacgaagagatgatcttaaaatcaatgagtttccacacaaaaatattatagtacgtaatagataagatatttacgcattaactggcatggacgtataattttatagatatttacttatactttacgtaatatatttattgtacaacataactagaatttgaaaagaagaagaagatattttttaatataaaatatgtaattttactcaattggtatagaaaatttgtaagaaaggagttttttccgtgcatactttacgtgcatgagttgtaattatttgtaagaaaggagttttttttttttttttttccaatgtgaggtttatagaaaatttctctccacaccataaggagagatttctttacgtaagatccacaaaataatagttaggtcatttctcatttaacatgctctattttttccattttttttttttacctaaggataaaaaatttatgatcttttttttttatgctggataaaaatgttctgatctaaataagttaaaataatttttttaatttatcgtttatcatttctatttatccaaacaaactattattttatttatctctttttattttactttttttttttgtatttttaacggtcaaacaaagttatgacaaataaatgtccctgcatgtcttgctcatactaatcttgacgactgacatgcagcaggaggatttttttagaaaaataatagtttttttaaaataaaaaatattatttttcaaaataaataaattcaaacacagtaatataaatataattattttttaaaaaatggttaagaaaaaaaaaaaaagccactaacctccagaagacccaaagctagctagtttatttaattgcaaagtactaacagcaaaattcctgggcttaccattcatgactcgtgggtggagttgataggacacgttcaaagtactgggttcatatatgtaaaggatgatattattatattctaactttccatgcacacattacatataataatttatagcatttggaaagtgatttaggaacagaaaccagaacttacggatatatttagacagctatgaattatgatatgatcaaacagtcacttgatttaatgtgattttctttaggaccactatcttttatcaaagacgaagttttttcaagctaacaatatgtagagtgaaactgactctttggaatgagactgaaattgaagaccatatttttcttttaaccgagaagaaatctatctattcgcacagataatataaaatgacgtgaatacgtgatgttaattatttactttcctgtgcatttattcgtcattttgtgtatattttcttatttggtgattagtaacaaattcgttctttcataccaaactattggcacgaaatagcacaactcaagtaaatatgtatcaccaaactatataatccattagcaggttaatatcatttatttttttattggagttagaaatactatattctgtataatatatcaaaaaaagaaagaaagcaagcaagaaagattatatgtatatatgggcaagctataaggctatgttcggggatatggcaaagtctttttaataatggaatcttcatggaggaaaaacaagccaaaactcagtggagcactttgaaaggtttaaaaattagtatagtgaagatctagagaaaaacaattaaaattaatggatccatatatgactttaagcattcactcattgggtggcaatggtctctaagctcccttcacattgaattaatttgctaatgcggtaggtgataaatctcaattatagacaaattgcttaggatgtcgacctatatggtcttatctctatgatttcgggaaacaatcacaaattggaggaattggccaaataattagaaagaaacaaagatttcaattgttttctaaacagtaaaggatttgtgatattgatcagggatggagcctcccaaacgtgtgaattcgggaagtgtaacttggcaattcttcttacatgatttttgatgcccatggaccctatatatggcttattaattaattaatattatggtgatgggatttcattattatgtcactaacaaatcatgcttggttcgatcaatccgtgttattattggggattcaaaagtccacttgatgtgcatcgaattcaccacttgctgactctattgcacgtgtgccatgcattaaggacaaaagttcctatgatgctatactggtagacctctcaaagggtccacctcaatgcaaatcataaaatctctcgctatctttctctctctattcttctcatatttccagaatttggggcacggggaagccattctgtttttattgtatgattacacttgcttgtatgattgctaaagagctaatgttgactaggtaggcaaaacaacaaaaataaataaataaacaaaaaaagagagagagcttaatttaatgtgcagatcactaatcattaatttgataaaaatcggcttagagattacatgtcttttttatgtaataaaacaatcttcaaattaaataagactaatataaataacaaaattctccttcaccatatttaatataattagatacttaatatttaaacttgatatcccttattaaattaaaataatttcatataaattgattcaaattattatctatcaatcttgtaagtgatatcatattaagctttaatttaataatatgggtggaattaccatgctctataatggccagcttctttcatacacatcaatggcccatcttccagcactagtagtagaagttgcggctatatcagtgataaaatggcttccgacaatacaataagaacatgcatggacagaaggctcatattgtaatcgaatggagtggtgataatgtgttcataggcaatactaatgcgctgctctaataataatgtttagacactcgtactacatttataatttgtggccactctattgttggtcaaatttgaattttccactgatgttgttcaaatagattattgatcgatattctcctctcatgagcatgcatgagctcctacctagctaacaacctatcactaaagagaagctacctatcttacaaataattacaactctcttttccttatgcaattaatttgttttcccaaagtaacaaaaagctagctgaggcctgacactcacttttaataaacaaatattggagaacccagggagcttttttttgggggggggggggggggggggtattataatcttaatggacaggaatatcataataagttgataagcaatgcttcaatctaaacataaggtgcaccacattatgacagcctcagcagcatgtataggttagattttttattattgccatatatagaaaatccagcaatgttttgtttcatgtcatgtgcctggctattttctttgtgaggattagcttatgacttgttcctcatgttttttttaatcaaatgttggtggatccatgtagtacgatatacaacagcaggaatgtgatttagattaaaaaatacgattcttcatatacacaaacaataattttcgttcatgtttgtcgaaaaccgtcgtggtatgagtcacatagataatggaattcaaatactcagaaggaagaagggaaggtgtgtgcgtgtgtggatggggggcagtgaaaaacgaaaagaaaattagtatttatttttaaaaaaaaagtaattcttgaatttaacaagcaagcatgaaagaaaaattaaaaatgggttataagatatgttaattaattaagacagaatcacatagaggaatcaacaattatataacttggtgtaaatgggagtgctagctagaagtgttgcgtaattacatttttcaagaggagctaattatttatctgtggttatttatgattttctctgttagagatgaagaaatttatggtggaagtggaaatcatgatcacattttttttcttattgtctaatctttctttttcatttactgaattcatcttgcatgggattaccaagtgatccaaaagggccttcttgtttttcatagctattgggtgaaaaatgacatcatgccatatgtgtaatgtaaacttgattgttcataagatgcccccaggggaagccttttatgacttgctctctttttcttttggggttggatatatacctttatgactacttttttacaaagagatttaaagccgacaattaataaaatggtggggttagaggatggatcgtttcatactaatgcaagaattaatttccatccatgtatacatggtgccttttgtctcttctttttaatgtcattggggtccctttattcaccctcttttgcctcgttgatctcccctttaccatgaaatattactttttcttttattttcttttctataaatcttctgtcatcatacatcataataaattaatatgcttactttgaaattccattattttatgcacaaccatctctaaattagtaaaagattaagtttagggtcaaattaatgtggactataagcctatatctaagcagctatttggttctaaaccgttaagttaaagctattgaattcaatgaatccaaagctgtcaattacacattacacgaatgcatatcataaataaaacttgtcctaagtctacagtttcgatttgatgattcatgatgtattagtgggtgtagctgaaacttccccatcgatctattatcagcaaaatgaaggagatggtagatgggacaattggcaaagattaattttgatagtatcatgcaattgctagattcataatgcacagaacagagtcataaaagttcaaattagataaggcataaggatcttcagtcatcttcaagattcatttatatgataggtggggaaagcggtaccctaaagttgtgtgtgtctggaaaaggttgatatagctgtaaatgtgtctagagagtagaaacagcatattatatatatatatatatatatatatatatatatatatatatattattcatttacagcatattatttttttatagattttatagacaaacttattttaggataacatgatgtttcaaattgagagtaagggatccaaaataattttatgttctctcaagatatttgaaatgttcaaatttgaatatgcatgtgcctaaccataaggattcgaatttaatttaaatatattagaagtatatatttttatattataatttaattataaattgtcatgtatgtaaatattattaatttataataattattttaaaatttatattgataataaattctaattgactgatctcgatagtaaaagaattacactgacaatttatgaaaattaaactcttgtcaattaaaaataattttaactatgtttatttaaactatcattataaaatttaataagatatatgattattcatgattaaatgccagaataaatatctttacaaagttaatatatatatatatatatatatatatatacactttaattaaattctttcttttaagttttgttctctaactatggtgaataagatatatactggattagggatcgttgattatcttggcttccaatttttgtttgtttaaagaagagttgcatcatttgagttctactcccgaagacactacaatagaatttctttttgtttttcttttcctttgtcgcattaaacgtacaagccttaattactttcatttctataaggtaatcataatcctgtttattttgccatgtcccatcaatctaaactttttttttttttctcctttcattgaatcaaatcaatctaaactacctctatagctaaacttgtcacggtactgtacaaattaactaactatctgtttattggtatcgaatgtatagttctcttttttatattaaaaatatgttataaattgttggtagttatctacactacacatgcacatgcttcaccccaaaagcacaaaatggtgttgaaaataccttttacttccagaaggcatcttcaagtacatggcaattatggaacaggtagcttctgtacctgtaattctgtcaacacataaaaacaagaacgttttttttttttaatctcagtattttctagttttaaaccgtgacacgtgatgaccactttggtgcaaattaagaaggtagatttatgtatttaaatggacattttttttgctagttatctagctttgatttgcgaataattccaattcaatagttcaatctactgtaaatttgtaccttccactcttggtcaacatacctttcatggttttctttttatttctttaaagcaaagaccaacaaatacttatgaacagatcatgcacatattataatatcgttcttcatgtattcccttgcttccatgtgcacttcacttctccatcagattcctcacgcactccttcatttaagtatatataaacaaaccgaaatgtgtcttattactatttgtgaactaaattatgtccattttgctcctataaaattaatcaccacgaatatctcagtaatttgagtaaacttgacaccaatcatggatacccaatttagattttgacaatggaaccaaatcctttcgttgcactcttggtaatttgatccaaatatgcaagttagttgcttaaagttcagaaattcaaagggtagcatgcagcaaccaccacatcagtggctcatcaaaaactacagccacacaaaagcgatggaccacaaaatgggcctagctaattaaaggaagaaattatctctttgattaaccgaacagagagctattacactcaaccatcaaactgtctattctgtttgattaatcatccatcactatctagagcaaggtaagataattacattaataaccaatttcaaaaaagtgctaaagtcattttccgttgcttgctgctaattaatctcaacagctgattaaatacatgaagatgaaaagtaattattattaccaaattaaagcaggaaacaatataaaatatgtgtccacgtggggaacaaaaatgcaaaatcttctttacattattttcaccctccaccagtttcatgtctcacagttcactattaatgaaacactatctaacaggaactaacaaattgaattacatttagatcgcaaatttctaaaaatttcaactcactacttgacacgttaaccacaacaaaccaataaaaaagaggagtttaccaagatagtgtagtatgattgacggataactatgctccttaaatatatggtcataagttggatccccagagtttgtgtaagaaataacatatattggaaaaggtcagactcttagatagatttcaatatattgagagattagtctttgactctcgtctagagataccctaggttcatcttgaaataaataaataaaaagagaagtttagcttaataaaaaccaacaaacatcatcatgggtatggagatgtccttgtcattgaacaggagcttattacacaataaaagaacaaggaagctagctcttctgaccagagcttcttctcttcctctataaaaaaaattcatagaatttccccctctacaatcccaaaacagatcaccacttctcttctttcacagcaatgcctgtcatcttaagaaatctgtcacttcctcccaaaatcttctccctcaccttgcttctcttattaaactctcttttgtttgcatgctgttactcccttaatgagcaaggccaagctctattagcatggaagaacagtttatacagtacttcagatgcactagcatcttggaatccttccaacccaagtccatgcaattggtttggggtgcactgcaacttacaaggagaggtggttgagataaacctgaagtcagtgaacttgcaaggttcactaccttcaaattttcaacctctcaggtccttgaagactcttgtcctctcaacaaccaacatcacaggcatggttccaaaggaaattggagactataaggagctcattgtcattgatctcagtggcaattctctcttaggtgaaatcccagaggaaatttgcaggctgagcaaactgcagactttagctctgcatgccaactttcttgaaggcaacatcccatccaacataggaaatttatcaagtcttgtgaacttgacactctatgacaacaaactgagtggtgaaattccaaagagtattggctccttaactgatctccaagtgttgagagtaggagggaacacaaaccttaagggtgaggtgccatgggacattggaaactgcaccaacttgttggtgttaggacttgcagaaaccagcatttctgggagtcttcctccttcaatagggatgctgaaaaaaattcagaccatagccatttacacaactctgctgtcaggccctatcccagaagagatagggaagtgcagtgagttgcagaacttgtacttgtatcagaactcaatctctggttcaatcccaagtcaaattggagagctcagcaagcttcagaatcttctcttgtggcaaaacaatatagtaggtacaatcccaaaagagcttggaagctgcacacggcttgaagtcatagatttgtcagaaaatcttctcacaggtagcataccaaccagttttggtaagctatcaaatctgcaagggcttcaactgagtgttaataagctttcaggcattatacctcctgaaatcacaaattgcacttccctgaatcaactggaagttgacaacaatgctatttctggggaggttcctcctcttattggcaacttgagaagcttgactctcttctttgcatggcagaacaagctcacaggaaaaatcccagatagtctttcccagtgccaagatcttcaggcacttgacctctcttacaacaatttaactggtccaatacccaaacaactttttgggctaaggaacctcactaaactgctgcttctttccaatgatttgtcaggctttataccacctgagataggtaactgcacaagcctctacaggctgaggctaaatcacaatagattggcaggtaccattccatctgagatcaccaacttgaagaaattgaactttttggatgtgagcagcaatcatcttgtaggggagattccttcaacattatccagatgtcaaaaccttgagtttctggacctccattcaaatagtctcagtggctcaattccagacaatctgcccaaaaacctgcagttaactgacctctcagacaacaggctaacaggtgaactgagtcattccattggttcattaactgaattaaccaaactcaacttgggaaagaatcaactcagtggaagcatcccagcagagatcctatattgctccaagttacaacttctggacttgggaagcaatagtttctctggagaaattcccaaggaagttgctcaaattccttcactagaaatctttctcaaccttagttgtaaccagttttctggtgaaatcccaactcagttctcaagtcttagaaaacttggagtgcttgacctctcccacaacaagctctcagggaacttggatgctctctttgaccttcacaaccttgtttcactgaatgtttccttcaatgatttctctggagaattgcctaacacaccattcttccggaaactccctctcaacgatctcacaggaaatgatggtctctacattgttggtggtgttgcaactccagctgacagaaaggaggccaagggtcatgccagattggctatggagattataatgtccactctcttatgcaccagtgcagtactagtacttctcacgatccatgtcttgatccgtgctcatgttgctaacaaagcactcaatggaaacaacaattggctgataactttgtttcagaagtttgagttctctattgatgacattgtccggaacttgacatcatccaatgtgattggcaccggaagcgctggagttgtctacaaggtcacagttccaaatggccaaatactagcagttaaaaagatgtggtcatcagcagagtcaggagcatttacttctgaaattcaagcactaggttcaattaggcacaagaacatcatcaagcttctgggttgggggtccagcaagaacatgaagcttctgttttatgagtatctccctaatggaagcctgagctcattaattcatggttcaggaaagggaaaaccagaatgggagaccagatatgatgttatgttgggagtggctcatgcacttgcatatttgcaccatgattgtgtgccttccatattgcatggagatgtcaaagccatgaatgttttgttaggtcctggctatcagccttaccttgctgactttggcctagcaagaattgcaagtgaaaatggtgattatactaattccaagccagttcaaagaccctaccttgctggctcctatggatacatggctccaggtacttttttcacgctatgtttgaattagttatttttcggtacttgcataaccccttgaaatagtactaattttttgttgttttggtatatgtacagaaattgcatctatgcaacggatcactgagaagagtgatgtgtacagttttggtgtggtcctacttgaggtcctgacaggaagacaccccctagacccaacacttcttgggggtgcgcacttggttcagtgggttaggaaccacttagctagcaaaggagacccttatgacattcttgacccaaagctgagagggagaactgtttctactgtgcatgaaatgctacaaactctagccgtgtcatttctatgtgtcagcaaccgagccgaggaccgtccaacaatgaaggacactgttgcaatgctcaaggaaattcgaccttttgaggcctcaaccacaggtcctgatgtattaaagggagttttaacagtgcatacttctccagcacctcctatgaaaggtgtttcacatggaacttctaattgttcctttaatttctcagaggactcaatctgttgagcaagcatgcaactcatagagaacgtatgattcataacatgtgcatacaaatggaatgtcagttagagctggccagaagaattactagagatgttcaaatttaatccaagatatgtaatgcatatttcaagaatccatgtattcaatttaaataataataaaaaaaaatatattctagaatctagagactagagcctttcacccaacaaattaattaagtttcaggctaggtggttcctcaatccgatgtaaaagtcaccttggcattattgatatctttgtaacctttgtgcttttacctgaattcaaattttgatgttctgattttagtctttgtggtgaattaactaacatggaaaacgataataatttcctggtctacaagtgctgaaacttctcagatattactgccaactggggcatttctaataaacacagtagacttaaaagtccatttttaataaacttctacataagtacttaaaagaggaaaaaaaaaattgaacttctctcatctaacttttctaaaaactggagcacataagttgattttaacttattggacaagtttaattcatttcaccttcttatttttttctaaggtaagtttatccaaataatctgtcaacaagtgatattaattacaatgattggaatttttttggatattacacagaaaataagattcttaggctgcatctctctctctctctctctctttctctttcacttattcacacgcacgcacgcatactcaagtcagcctttcaattccacatggtcccacgttcaatacctcacatgtcccatgtgctctctgaaagagactttgcatttgcaacaattggaaactccttcagaagcacatattaagtttggaatgaatgaaagtctgtgtatcttaatcacacgcacatgtacatgcaggaccattattattctggaaatgtgaaaggtaacatgtaaaacagatagaccagttagtccagcagcatatgcagattgcaaatacgaacaagggaattttttttatcatttgcaaggttcacaaaattctctgaactgaccaaaaagcttattcagttatatcttataagattctttcgtgaacaactttctggcatttcttggaagagtacgaagaggactggaaataattgaggagcagagtttgtggcattgcattatatgtgaaaagaatgagtacgagaataacgatttaagtacattaaaatatccacaaaaaataaagtaaattaaaatgaagttgcaagaagatttcaattattttatactaatgaatgtcttcaacaataggaggaacacaaaagaaaattagagcatggatttgtcataaagtaacatttcttctcatcagaatatgattttcctgcttttccttttgactgtaaacactgaaaattgtattatgaacaaatttaaatccttttataataatattttcatttattagatattttttttatattttcaaagtattaaatgcatttactttttcatttaaaactattttttataagttttagaaattttgataaaaatattgtaaaaggatataacattttttttaatccatccatttattttgtactaatttgtaatcatccatgtatttgtactaatttgactagaggaaactaaattccaccctttagtttattctttttttctttacttttcagtaaaatatgttttttttttttttttttttaaaagatgaatatttttcaagcaacactaatatggttatattttatttttaatacattattattgttaacaaaattatgttattaataaactagataatattttatgtgtgactaataaggtaattataacaaaattactaatttttaattatataattaattaacagtataaaaaatatttacattgtcatacgttctagttaaattcatttaattaacatatttagttgaaaattttctacaaaaatattaattaatatctctttttaatactgtttttcttattataagagtctcaataaataacttgaatttactattaattagtaaagtccacattaaatttaacctaataataaataatgtattaaaaatatttttttataagcaaaacttaaagtcgatagttttctatgcaattcctcataaatatgttccagattttaaaaaagaacaatcgcatttttcacaaattttatttaaggaaaaacttagtgcacacttgagagacctttttttagagggaataattgcttatttttaataagcactctttcaaaaaaagctaaaccaaacaaacaatgtgaaaataaaatgatatatttaaaacgaaaaaattacataaaattctgtggtgctattgaagagttctggtaactgcacgtctgcatccaactagccctttaagtctcctacgctttatgaaataatcaaataattcaacacatgccattatatcatatcattaatggcactcattctgctctagaattctgaatgctagttgatgaatgactgttattggataggcatgttgataatttttctagcgtaagcacacatttaagataagcagacgcatcaattgtttctagatcatatcatatcacacgatatctacaagaattgacacagtggactcacaacaagtagcacctccttagtggtgcttgctgctgtctcagcctcaacaagaaaaaaaggtagcatcaatgtacccagacaagtgtagtcttgtgtgttcaaatgccacatggccttgagcaaattgaagcaatgaactattagttttcttgcaacagcattaagagccaaacgaggcttcaaccctaccatattacacactatacattttcaagaaacatgtatggagcccaccaatgaatttccagattgatatgaatgttggatgtcccaattgtgcactatggagaattctggtcctgcctgtctaatttctttagtatgaagttaatgacattccagtcaaagccacggtactgaagccaccgaacaattcgtgatttccttgtctccttgagtacattctgacctctgaaccactgctttgaggcctgagtataaagatgatccatggaatattttgacaagccaataactgacttgtgatcttcggcacaatcattgtccttaaagaccacttcaactgccttctcagcatcagcttgactaactcccttattgaatagtgcctgccacaaaaattgcaatccatcacacaaaagtatctcccttggatgaaatagcaggtatatatggctattgggcactgaaggcatgtggggtgaaaggtctgtgccttggccttgcatggcccacaacaacagtaaagaacctttaagcaaacactgcttttgtgcatccctagtgtgtttggggcatctaaactcgaggaaaatgatgagaagagaagattcaagccttcaatcaatcggttttaccttttctggaggacgggaagggattaggttcaattcaatctaggcaatttttgcatatttgggaaaaaaataatcagatagttttaaaatgaaataaatagagccctcaacaagtagccaagtaatagaagaaattattcgatcagataaattacaagagaaaagaattgggtcgaagctttgcatttgttgaacaattcgctatgaaaaataagccaaattatgacacaagtcaagcaggcaaaagacataattaaacttcagaagcttttagatgtagggaaaaatcaaaatatagattacatgcacaagctaaattttcagatacagataattacttagtaaatgatatattattattttaacattgtcctcgtatgcaagtatatattttcagattttcacatttgtgttcccaaaagagtaattgtggaaagggaaaaaaagtgaatgcatactgctctgctgaattagcaagatgctgtcacaatgcacgtcatcttttcctcctaattctatattctagagttaaaatgacgatgaattttagcaagcacaatataagcataatgctaacacaattatttcctcttctgcactgcaatgggattaataacaaaacacggggaagaagtattgatcaagaagataaaaaagcagaatggaacagccaacatgtaagaaagcaaaaagtaataggacaaacaaaaaatgcaaagaagattaacttgtttgatccgccttggcccccaacttgatgaagtccatctagattgagaaaatgtttcagcgtaaaacctatcattgatgaaccctctgatacaaaaaaggttaaaccaatcaccataagtaaacataaagtataaaaatgtctgcaaactcagtttataaatgaacttaaaaaagcatattttgaaaaatactgcacaatatcaaattaacatgatataaatgggtatatgcaaacttttaaaaaaaaattgagatgcatgtaccacacagtttattctgaatagaacagaattactttatctgcatatataaaataatagtgtttgaattaatatagaattaatcataggatatactctctttttaaaaaattcagagtctctatccttcctaaagcaagaaaagttaaatggaaaaagaaaacatgttaacttcatataaaaacagtagatctgttgtttatcagccattttcaaatgcatcctttatttgaagctttactcactgtcaaacaactacatcctaaaatggaaaaagaaaaaacaaaattcgattcccaaaacaaactccatgatttgtgttaataaatatcttcattacaaccgcacttaatgttcatcttcactcttctttattctaagatactaaaaaacaattttcagtgagttgattgttgacaagtaatcacccttcaccacaagtgacctggtaaaattataatgtcaaggtaaaagcagagatcatttccttttcattctacaatatcagcaaacttacataatttcctttttattataagttgttttgaatacaaaataagttagtccaaacacatagaataggtgaaactttttcggtttcaaaagcactttcaggaagcccaaaaaatgattatttgatatttctgcaaaacaagccataccaaacacactttaaatttcttgattccttttccctgttttctgtaatccaaatatgttatatccatttgctcttcaatgaaaaaaaggtggaaaaatagttcatcagtttctgacacacaaaataaattaaaatgaaaaaataagtgttgatctacgtgctgtataaaaaactaaacaactctatgcatatatactacataagacttaaattggtaaatgaccataagtcaaattatattagatgggccactcaaattctcaagacattcattcttcctcaatatccagttatctagccatttttctcatggagaccccatgactgaattaatagttggctagagctgcattcaaagtcacctttgtgatagcaatttataattgcagacatctcatttttaaggccagaaatcacataacataacatatattgctctcaatttgttgtaactggataaaaacttaaaggaaaccaaatttaggaagtagttgtctggaagcaagtaaagcttcaagtaaggaagcaattaaaattggctaataaacaacagctctccacagtttttatctagttaactacataccttctctggaacttgtttatcactgcctccactgcatcagcagagaatctctttccaagcaatttctttctcaactcaagtgctgtgagtgccctgtggaacagagagacaagcatgcttaaaagaaaagactgcatttttacatttaaacatgcacactcctctttccaaaagggaaaagatattagtttactaattattacaaaatttcttctcttagttaacaacttataagcaaactcaactcaaagaaattcattgttaatgacaatttgctaagatgtttctaaaggcatgccaaataagataacacttcgttcggcataacctcattcttcaatataaaaatatacaaacaacttcaatcaagttgaaatttctaaaaaaaatacatgggatatttgtaagtagatagtgactacaatgccaaagtaacacatactatgttttaaatttgtcttttagctttcatgttgagccttggcagttggcactatagtaaggtttttgccttgtgacttaaaggtcacaagttcaaatcttggaaacagccttcccttaaggagataaggatgcatgcatgtaccctccccaaactcaacttagatgaagtacttgacattttcttcaatttcttaatggaagtgttgaaagaaggtaaatacttgacacactgagtaaaacttaaaaaggaagtttcctcaacagggaaaacagcaacaattaactgcaaactcataatagcatggcaaaaattgatttttgttgcacttaaaaaatgaacaagcattatgctcgcccatatttggttcagaaactcttcaattggattgacaatacagtttataactagtctagcactgaataaattctatttctgggaggagggaaggggagacaacaattaacctagatgcaagtaatttaatagcagcttcctcgacatcccttgtaaatttgtcaatttgtatcaattcctggtcacaagagtctcctccctcatggattgtcaactctccaacctcttccatttgatccaaagaacctacaatcacaaattacaacgctcagaacaacttcacttcttagatatacaagttgtaagtgctgtttcatttctaatcataatgtttggttccgcagcagaatatcccattacaacaaagatagaaagaagccacaagttttaaagagttaaaaacaggttaaaagaagataatgaatgtaaattttttaatcggtgaaaacaaacacacaatgtatatcactgaatctagaagcatgaacctattatccatccccaatcttaatagtagaaggagatcgatcctattagaacctggagaaaattaactttagttaaccataagcttctcctttctttcccattattttcttaacaagcgtcatttttttttgtaagaagcttatttttattcaatttatcaattacaaagaccatcaatcacaaatcacaatgtatcctcaaaagcgtgaacaatctcttattacttttatggcaagctgagtttatccagtaccacaatataagaacattgaatcaccagacttaaatccgagtcaacaatcccatgtcaggcatcaaattgaattagaatgcttaaaatcacaaataaatctattgtatttagctataggtagtagtgacgtagttcccctgcatcctgcatagcgaagcacaactaactaccaaatgatgaaccaaaaccatatcatattaaatagaaaatagaagtttaccttgttcactgtcatcaaataataagtcagggcaaatttcattcgggtcttgagaaatttcacaatgtgcaattgttgcatgcacatcttttccaccatttatcttgagcacattaacatcaggacagctacaatatcccaggcttttcactggcagtgcagtttcaagtattttcaccctgcaggatgtgctggaaatgcacctaacaggaacagaagaactatagtctcttctcttcaagctaatctgaaacttccaaatactcctattttttaataccaaattaaaaaataaataattagaacaatggtcaaaatgtttcagaatctatagaaagctgaagcttatatttatatgtaagtgggtggagagacagaaagaaattgaagaacttccttcaacccagtagaatgcttccaattgggtagctaaactagaactccattactcatttactctcacaagaatcaagcttttctgccattttgtttcagtaaccaaagaaggtttagagctaaaaatgagagagagaagttaccgatgaattgaaaaaacgcgacagggaaagtgggacgggattttgaagccgatgtttgccgcgaaacctgccatgttcatgcaaccataatttgtgccttccaaacgaaggggttccccatttttggttcgtttctcctctcctcttttttattttgtccaaattttgttttccggtatggggcctgacatttgggtcggcccggattagccctcgtgggctgggctaatttgaatcgggctgatttccccatgacccagttaaaacgggctgtctgggcttggcctgtcactctctgacagtcagcaaggcataacatttgtttcctgcacctgcaaatttttattcccaaataaacttttcgaaatgtaattgaaaatgcaggatacaatagctggcataatcacatattcacaacttcacacttgaaccaatctccactcatattttagaatcaatttttaacgagtgataaggaattggatagtatgcatgatattattggttctaactttttgtaggaccatattaaattaaagaaaaagaaaaattaatgagtgtttttacgtggacacatgataaaaaataaataaatatattttttattaaaaggaaaagtttattgtattaaaacacaagttgttatctaaagtacaattgtaacaaaatatagttggtacaactggatcacctctttttcaaggaatgttaattcttattaagtagtaatttggtttgacatccaaaaagaagtagctatacaaagaaataattatacattcgaaacaagctgacaggagttattgtgctaaaactttttaaaataattagaaacatcaataagatggcatttaatgttctttatcatgtgcccatggacacaatatatatatatatatatatatatatatatatatatatatatatataaaccatttatgtatgtgtaaagagagatgtttcattatttgtattttttttaaagaattttacaaaatatcttaagacacaattagatggtattgacatttttaaatgttgttaagtggttggttgtgttataatttggtaaaaatagtgaattttgagtttataaatctaaactaagtacgtgtttgaaaatatttagttgaatttaacagtcaatccatccttccctttccttctacatttgtgtatcgagatgtgggaaaacttaagtttagaaaggtgtaaatagatttccaagtacaccctaattcagaagatccattttataatttaacttattttaggtcataccttaaaaatttaagctagttgtttagttactatttttcctggtcatatatatcaaatagctcaaggaaggaaaaataagaaagaggcaagagacactgttttcaataactcgatgtcaatgctattaaagaaaatgtatgaaaagcaacgcctttttgctttactaccaaaaaagatcaagactttttggagaacacacaatgaatctcaagcaattctccaagcataaagataatggcaaaaaccttgggtggatgaattctcctctagtaattcacttccattgctacccccacctctttctaggcattctatgctattagaatcgctagtagtttccaaaaagactggcttgaaaacaaagaaagcagggcctaaaccaaggtcattggtgaaaagccaatcatgaacatcccaaaagatttgcacaggcaaattattcaccatcactatttcattccctctgaatctccaatgcaagttcattattctactggccaacatcccatctatgttaatccacatttctggatcatcaggcccagaaagggaagtctcaatcacaacatcatgttctgtcttaccatcttccagaatggctctggtacaaaacattttcttcccatacacattgtctctcttgcacaacaaggtagcctcatctagggatggttttgatttggttctttcataagcatccttctccaaatctcccaacaacagaagcacctctttcttgtaaaccaaggcaacgtaataacccgagcaaggctgtggacttgtggcggagaattctgcatgccgaaaatcccaaaaaatgtctactcttgcacctgctatttcaaatgatctaagaccctttttaccccaagattgcccggattccaaatcaatcttgcaggtgtacttgttctcttccaaagtgttgtcgatgctcatggaaaggaaatgattcgtggggtccttgcaccatgaaactgttatacttcgtaacaattctgctactttggtttgataaacaaaggtgacaaaactctgaggggcatctattttcgtggctttattatccttgcatgttgttttcttcctggaatgtggttttggaatggctaacatcacagattctataacttggacaagtctggattgagcctgcaaatgtatatgattttcttatcttcttgtaggatcgaaaattgatcctctttggcctccaatggtcaaagagaattataattggtaaacccatcaaagatgcttctaacaatagaacaatgaaccatcatcttaatttcacgccttgttgattcaaaacacgaacagcttcaaaggggttcttaatcaaaggttgaatgactaatgaatctcaatgttgagaatttatgtgaaaattaagacacgctttgaggaacaaaatctaggttgtggttgtcaatgagatgtcacgagaacatatgatccttttattgcttttatctattaatagattaatgtctctctcaaattgaaagatgaaaatggaaataagttgcacttataactttaaccctactagagccgctttctgcattattttcaacctaattaattttagtaagcgtcatatttggaaaaaaggcatcaaaggaatgtgctggtcgagatgttatcaggtactaatatagcgtgcttttagaaaatccttccattgttattattattttgtaaatacattaaattgaatattatgacgaggttggacttaaatttaatatatggggtttgctaatatgcacacaccacattttcagttggtgtgcattagtaaggtgcaccgaaaatttagaataacaactgagatagttccatatttatgcagaggatattagcaaaaccgtgttgtgcaaattagcaaaacggaagccgcgattgaggatgatatgtcgaggagggtgcagtgcagatccgaaaacatggtgagagaatttgtttaggagagagaagcacctaatatattatgtcaaattactatattatccctataatgagtttattagaattagaataaaagatatagttggcttttctggcctaaattttttatgcaccttgctatactaactgaaaaattggtatatccatgagagaaaaccctatatttataatatattatatttaatgccaaaagttataaaaattaatttaatattctgatgagattgaacttaaatttatttctaaagcaataaacatcaattattatattggaaatcgtcatcttgttgcctcaattcctggttatcctttgaccatttcctgtgttttggcattgaacaggttgtgagagagagagagagagagagtaaaggctcctcaaaatatttcaattctttttatacagtctctcaaaatatttaaattggtcaactagttcaatcaatactagtgccctgagcattccaattaaaataaaggaccggaaatacattcaatttagtttggctcagattgacctaaccaaatttggtcaaatatagtgacccaaactaaattggcccaatttgatcctatcaagttttttttttccccctcaattcctatatcatgttaaattgttaatagttaatcattgaataacatataatataatcctataatatatatttttatctaataataatatataataactaattattatcatattaatcataatataatttaatatttatatgttttatacatatttaacaaacttatttatgatcatttgataacttttgtatttagtctttaaaaataaaagttttcttaataatttaataataataatttatagtaataaataactatataatattttatagttagtccatgacaataaatttaattttagagtgtaaaaatatgaattgatgacattatattagatacattatatatatttttaaaaatattaatatatataccggattaataaataaccctccaactaaacatctgactcactgacctaatatttcgatgtcaattttcataactattggttgttagttcttcatttttataaccattaagtacacatgtagcgtcctatagagattataattcaataattccatgggcgagttacgggagtataaatataatttgactgaatgtgaaacatgtatacgctaaagtctgaacgttgatatgaaatggaatgctaacagtagaagctttctaaaaaaaaaaaaaaaaaatacaggactaatttgtaaaatatattaaaaaaatacaatattttataattaaaaaaatattcaaccttgtacaattgtaataacaagcttctcaataaattatttttaccttcttccattacttttgttgaatttgtaatgggaagctgaattcataaaatgcagtaaatatacctcttatcaatgtagcacaacacctcaagatttcagaagtataatgacatccaaaaatttaaattacaaacgagcaacataacacgaaaacagaggaaaaggtcgcacaaactgacctcgagacctcagtcaacaaaattatgtgagccggcactccaacatgcacatcaatagttgtcactgtacaaaaataaataatgtaaaaaattatcaaattttaacttgaaatcctcaagagaaaacaaaaaacttcccacgtggcgtagatcggctccttctaaattcaggcaatgtagtattggtgccttccttaagattgcgacctgtaccatgtagtaaaattttgttttcaactttgctggacaataaaggctcagctgcttgcattattcctctacatgtgacaataatactcatttatcaatcaagctttgaataatgtcattttcaatgagaagaaacaaatcaacgagcatagcataattttttaatgattctttaaggcataccttgatccaatgttctgagaattcctagagatgttctggtgtatctttttaatatttacaacaccattgactgcagactccatgaggcgtatatcattttctggctcaaaataatcgtttttccgaagtgcctccatggtcatttcacggccaatttccatgtcaaaaccaggtatcatatcagccttttgaatcctaaagggcaattgctgaaaatgcttaaccttggccttactttcagccttgttgttcctagtaccaccttgtcttactgaacgaggagcttgcttgattttttcctcttcgtgttcttgatgaactttcctggagtttaccttctggaggttgaagagagtttcattagtgttatcctgcttcactggctcctgtgaatgcagattcacccttgaattattctctgtagatgaggccattggcattgtgacaagcgatttatttactagtactctagttggaaatggatgctttaagattggttggttgtctgatgtgtcacttttgaccttgcttttaatgacagaccctctatcagtcgatattgatctcctcctgactggaggtgatggtgatctacctttccctgagctcactaatttttcttcagctagaagagacatttttggcatggagtccttctctataaatgttgagggaaatcttgaccttctttgcttacccgaagaacaagttttagcctgtaaatataatttcagatttagagagtacaaattacacttcattgtgatacaatttcctaatataattttacacaaatttatcattaaagtttatataagcatgcaataacctcagagcttctatcatccatgggtctttgacaattttcaggtttcatgttgtcactggtaccatttttgggcaaacggaaaggtgaaacagctcttggtgctttctgagattctatggtatttcgtgtattcccagctttccattgttgtagttcagtttccttcctctccaatgctgatttgatatttgatatctataaaatgctcaaactgttataatgttggctaaagttaactttaaaattgctatagttatgaccaaaaaccaaacctcttcctttagctcccgaatttctccagtttctttattagattgagcagcaccaagttcaatggttgcaaccctctctgcaaacttaagtgtgctaattgtttctccaagagcattgacttcaggatttatatgaacaaacatcaaagtttttgcatggccacctattgatatagggggaaaaaacacaggttaagttgttttatacagaaattaaaaatataaaattactatggaatgatccaaatacattaatatcaatatttaaattgcaattcattaatcaacccatctcaaccccttcccaactaaaaaacaattaaaacaacagagggcaaaaatctgtagtagaaaaagatggtggttgaagctgaaaacgaaaacaatcccaacttttaagtttgttctagccaattataatgaggaatgtgtacagagagaaaaaaatcaatttaagtctgcttgttacctaatgaatcttgtagaacttgtgtgagcttgctatttctataaggaatatgtggactcttatgtgccaaagcagagataacatcaccaagtgcagaaagagatttatttatatgctgggcctcctttagtctctcgccaacagcctcagatttgtccactctctcacttccagccaaatccacaagatggagacaacccttaagagtggagttagacactaagtccctccctctgacatgaactgtcaacacactgcaattggatggtaaagaaatttatttaagaaaaatatattatatggttaaagtagccatcaatatttatgaagaagaaattttacctatgagaacggctgcttcgctcatttagagctgtagcaccaacagcacgattcttctgaccaattttcattaaatcaagaacatcttgagtacaattaactgggactaaagatgcatcaggcacattaagaccattcaattgagagttgtttcgtatatctaatgtatgtcttgttaaggaaatgaacaagccaaaaaaatatatcatattgttttttttggggggagtatgcaaaaagttttgatatacagaagggaaaaatgattacaatttaatagaaatacagaaagtatgggcttgaaggatatcttctgttagagccatcgctgactaataaatctctcacttgttcattgtatatttcaatcatctggacgcaaacttcatattttatggcatctgctctttcctttgaaatatgaaataagtcacgcaaagccctatagtttacaccccatgtctcttcagtcatcagatcagggccactctatccaagcagtaaaacgcacatgcataagaaaaatgataagacaatattaaaatgattttgtgatatcacactttcaatgtggttaaggtttgatcaagtccataaataatacaatcagttttctttgtgctgatgaaaacatatttaataacatgcaggtctttttaaaattttaattgtctcctttttaagaagaaacatctccaaaccaagataagatactattaaaagaattgcgtaccataacaaatcataatattcttgatttcaagtatccataacatgcaccacaaacagtggacaaaaatctacatttttctactagtacatgaaaagaaagtcaccaatttcagtgcaaaacacataaattttgatctttcttatgaggcatgcaataaaaacagagaatttagaatgaggacaacacttcaatttaagtaaatgcataaaattgtgatagattgcttctatgtgctagaatttttatgtatgtaatgttaccattgtgtaggtctttcctgacccagtctgtccatatgcaaagatgcatacattataaccatctaaggcggacctaaccaatggttgagtgtcagcatatatttgctctgcacatgacaaagaaaaatcatcataaaagttttgactgagaagatataaatttcaaaaaagattattttatttgtaacaaatacattacataagatatcatgattattatcatttaacatccagtatacaaatactcgtttttgttcattcttcattacataaccaaatctctattatctaaaacaacatgtcaaaaaatgtccattattattttcaaatctttactacattttacagagagtcatttaggaataatcacatagaacaaagtatttgctggccctatacattttgcaataatatgtcaaaaaattaaaataccttgggtggcacttgttgcaaacaccttattgaatgaaaatacccttctagcatcttttccttgcttatggggattcataatcattatgtttccattgtctcctatataatctacagtagattgtccatttgattgtcctggtaagaatggcctcactctgcagtagaccctaatggctcctgtaaggaagcaaatctattaaaatacataaatcatgtaagtagatccttgaaaaagcatctcggattcttgtgtacctttgagatcttgtacttgattgtaaagagagcgattctcctccaaaactttgtggtaggaagaggaggcctcttcaaggctctttatatgattctctaagtagtacatagaactcgacttagcattatgaaagaatattgcattataaaagattttacatacatgaagaatatttttcatggaaaaaaaagtctttggatcattaccaagccttctcaattcttggtcccacttggattgaatttgtttgacctccaattttatctcgtcatataagtacttcagtttctatagaccagggaaaaaaacaccattacagtgaatgatgctaatctaataccgcatgataaatcatctaaagcagtacattgtatttcccaattttatacctggagctctttttgctgggcatcacttatttcagcatgcttggcagaataactgacattgtgctgattactatcgcgttttccaccgtaagtgcatagtttagagaattcatttgatgccaaactacctctttgatttagatataatgtgatagcttctatgaattctctcttggagaggcaaccagtattgcctttcaatattttcttgaggaaatgtccaagctgcggacaattgttaaattttaggtaaccttacaaacactgaaagtgattttacattacaaacgtgatagcaagacaaaaaagatgcattaatttctgaagtacctgagtgccttgagaatcaagcaatgcagaaaaatcattgacaaccttcctgagcaaagtatcaattacctacacaatttcacccaatcacaaataagattgctgatcacatgaatcaaatgaatcttcatgcatatatttaatttctcaaaacaattttcaaacaacaatctaatttgccagtcctaaaaattacaaatcacaccacataggaaaggatcttacctaccattgcattcaaaggcagatcatcaaccccatcagcctctctgaggtaagccaggagaagtttgagtccaaactgatcaaaaacagaagccaaagcattagcagctttggtttcttcaactgaaacctctccagacagatgaagaaactgcgatgactcggtctcatcaacaactctttcagtgcccagtatgttggaagaagaccatttagggaaggaagtaatcctgacagttccaccatacctccacaccccaaccccacccgatagcttccattcataataccctttcaaacagagaatgcagtccacaactttgcttgacgaacccccctacaaaaaaactcaacccctatgatgcccatatatgatacatgtatccaatacgacacaattattctagaaacatataggatacaatacgtataagatacacatatagatatgtataaaaaatcataaaacataataaatatataattgcaattctacaaatccaaattaagaacatacttcttatatattactaaaaacaaaataaaattataaatgtcagaaagagagatgagtctaacccaattctacgaaccaagttttaaggtgaggattactccccatttataccgtgtatctcggcactaactttagacaatgggagacttcaacatgtctcccttttgcccacagctatccgccatgtgggactttcaacacacccctcagtctaggggtgaccacaatttaggtggtttttccaacaataaatcattgtaatcataaatcacttcctatcctattgtctacaaataagaataatttccatctttggttcatgaaagagacaatgtttcttgaaattcatgcattggacatatacacatagccatagtgaagtatccaaaccgatacgaaataaaagtatcggtgcttcataactcaaccccattaacaaaatagagcaaagttagtatcttgacgtgaaaggggaggagggtcatggtcaccttttccaaatcggaagcttcgaaggtcaaaagcttcatgtcgttgacggcttcgagaaagtttcgcatgttctcgaaatactgaattgcggactgggcgggtccctcagaagactgaacggcgacgtcgtcgaccaccgcattgtcgacaaccttgacgacagcgccggggttgactctgttgaggacgttgcagagaatgagaccgttgcggagtgcgaggcagaattcctcttcggagggttctttggagagtgatgaagatgcgccattgtccatttgccgaagccattctgctgctacgtacctccttgaagctgatctcacaagcacaaacaaacaacatttgaacaactaacaacaaagacatggcgggtaatgtccaattgtctatacgccgccgtttcatgcacacttttttattttttttacaataacacaacattttttttaagaagagaattgatggtttattcagatgtgctagataaatgttgtgaattattttataataaaaaaaaacaaaattataacttaaaatcttgtacacacttcccaattttcacattttagaacaacttttttttacaacaatattagaacaaccctagtgatagtctttcaatcaaaatttcattaaaagaattttaaaattgaaaagtaacgctattccttttataaaaaaaatcatgtcaaacttgcgttaaatttctttgaggaggtataatggtgattcataagagtaaataaataaatttaacatgtctactctcatttcatactcaagaaatgttacccaaaaaaacaatattctctcaagaaatgtcgtttactgttatgcttttatatttgtgaattctgattaaacaaaggtcaaagtttgaattttaattaatcaaaggttaaagttaaagtagtctagtcacgattgttatttacagcagtgttgcattaaatgggtaccaaaatcatggtgtttcctgtttgaaattaggccatattactttttgaaaagaataattaattgtaaagtagtgtaataaatactactgtattaacttgactttatttgaataccatataaaattacttttaaaatagggttataaatttaaaagaaaatattaaacattcttgatttaaagttttacataaataattaccgaaaaattaaaaatagataaacctaaactaaagtcagttacattcggcagtgaaagaaaaatgttaccccaccaatagaacaagattttggtgggtttttaaatctgaatttcaagcagtactagttcttaaatgaatagttgacatgtatttaaacgaccaggcttaaatcacaaaatttgaataacaacgtcaaagacccacgccaccattgaatgctggtgtgctgggggagtgatcccattttagagcaacacaacacatccccaggcattgcataatgcgctttataattttgtgctccacgatcttttcatttgtcctctgtccctttctttttctcttttccagcctcacttcgtttaatctagttacaataattattcattatttgtctttgtttttttatacaatacttttttcccttttcccttttcttaaacaaagcaataatgtgcaagtgcaagtaataatttagtagatagaatagaaaagaaaatgtaagaaacaaatcaatttcgctaagaaaaccagaggaaatggggaaaaaacaaaagaaactttttctatgactataaagaaacattattataatgccaaaaaaaaaaagagaaacattattgtgaaacaataaaacgttgttctctttttaagggtgtttttttaattatagggtatatttttaaaatgcgtatatatgaaaaatattattaaaaaaaaagagagtagtaaagatatttatgttcaaataatgaaacttttccaagaaatgtgcctgaattcaagcaacaagcatgtttcattatttaatcttaacagaagattaagtctttttttgtggagtataagtctcacttgttcattattcctaaatgggtctttggatttattttttttagaagaaatattattaactacttcaaattaaacacagatagtatcagtgctttctagtttcagtgagctctaaaactaagttcttactcccctgttttggttcaatcttgggggacaaccttaaattcctatgctctcaaagatattattttcagaatacaaatattaaaaagtactacctgataaaatctaagttcccaactcatagtttatttgtgatgaagcattaggtgacaattacgaacacatagcgagtgtaacaagagaacagtgctaatgtgcgatgacataatcataatcaaagttgatacctgcttcctctgcttttctctgagccaattcatgatcgttgatggtatcctccgtcaaactgtgtaaagtctcattgttgttacatgctgaagccgccgaacctttcaaattcaatcctctcttaagaggagatatgaaattagagtttggtaaggtttcctgtggcatgtttcctgcaacaccaacaattggagaaatgcttcaatgcagttcttaatatactattagaatccaaccaccgaaaaataaaattcaaattgttttgggtttaaaaagaacttggcatttaaaatacctgggaaagtgaagctttgggttatgaagattggatctgaggcagaagcgtgaggagaaacagggttctcgtggatttgatttgatgatgaatgagcgttaaaaaatgcgaagaggcttatattaaatgcttggtttgaatgtgttgagagttgagagagaaacagaaagaaagagaacttaaaacaaaacaaaaacaaccttaaacttgaacttgcattttgaacgttggtgtctccgtcactcccgtgtcctcgggggatcacaacgtcttaacggcgtatgtatccgatgtggcgtctgattaggtggcaactgtggtcctctgtgggacccaccgaacggcacgattcgccctgaatgacgtcgtaccaatattgtttgtgcctttcataacttttttgctccccaaaatttgctttcttttaacttttttgagttttgttttggttttaaaaagaaatagacacaattaacacttgggtttcaatcttacaaatggaagaataaaaaatataattgaaaagagagattatggcaactgtggcctgttgtcaacttaccacagttaaatttagtttatttctgtaacttaccacagttaaaaataaaaattcatagccaagagagattacgggacccattgttgacgggaataaaggcatatgataaaactatattctatccaggacatgcgttagatgtggaaagaaacatgagagccaaaatgttccaaaattcaaacatttttccgaacgttgattccccaatttagatagggtagatgcttgcttttttatttattttatctatttacatataaattagatttttgtacaagtattattgtataatttaaatttaatttattattttcatgtttttattatttattatcattgtttaacttctctaattatttagttccgtccttttattttgatgtttaaattatctattttttaccgtttttttattaatttctctaatctttttaatagtgcccacgcttctccttctgcaaatgttagacatgggcctctaaaattagttcgagtagcaacaactctttcatggtgatctcggatgcaaaccctctaatcttagttcattgttttaagtcacataaaacaattcatattattctgtttatttttttatttatataaaaataaaacaatagcttaagccatttatttctttttaaaaaaaataagaattcatttttttattaaagagcaaaatattttgctaattaactaaagtaattaaaaaatacattaaattaagaaaactaattacaaaaatctttaaacaacgaataaagtattttccattgagacaccaggtctgtcggtccgtccacattccaccacttttttcaagaaaaatttcaaagaagtattgtttttattttgtttagtggcagatatttttttaaagttttcttgtttaaagtactgtcagacaaaaatatatttttactatatattttttttttattttgtttttgaatatccttgaagacatttaatgttttgcttttgggtccataaaattatttatttttgttattctagaatgaccatcttgggttggagcatttgatacatgatgcttataagggtttaacttctcataccaggcaaatttttcatacacccaccatttttcataaatgacaataaagtccttggtgatttttaacatacatacaccagcctcaccttttcgccattcttcttcttttttcggtggttttctactcttgcgtgctgttgttggctgctgggtgcgtcttgcattgttgagctggttgtggaggtcgtggctagtgttggtggaggttgcgttggccggttcgctgtcggaggtaagctctgcaactcaagcactgacggaggaagctgacggattggcaatccgtattgattttacagattggcaatccgtaaggtccatacggattgacaatccatatgactcttacggatcaacaatccgtatgagtcatatggattgccaatccatatgaaatcaaatggtgtatgttggtatgtaacttacgggttatgagaagggtaaaattggtattacactgtgcatgttgggtgtattgaaaaaatgaatggtgtagaaagttaatccctgcttataaacgtttcaggtccaataacatattcctggtgcaatatttgttagagaaaatgttcaaattagcacctaagcacaagaaactatttaattcaattatgacctgtgggcttattctcctaaggacataactattggcaccctctcaattactatttaccacaatacattaaaaagatgcatatacccttattccttcgtacccctcaagacacaccttagttagaacacccttcaccccttttccctcacttcttagtttttcttctaccttcttgacccctttattgtttttggtgtcacgcccccttttccaatccctctcttcccccattgaactttctctccatcacactctaattttgttgaatcaaagtgttttaaactccattgattgtgacttcacaagagagcatttcaagctccttttttccgtcttaaagatttgatggaacttgttttcgttatatacctaaatgaggcgcacaacaaaaataagtttatgtcatgtacctaatcaaatacacaacataaataagttttacttgtgtacttggaaatcaatgtatgtttttatatgtttattaaatttatattgatttgcaggtttgttatgttgtgtacatcttatattggacacataggtcaagtgggctctaaggaggacatgccaaatccatcccaagttgaacgagtaccactgagagcttcaatttgtagacataaggctatggcaacacaataagagtgacaagctgccatggctaatgatacaaagcttgactacattgttgagccaggttgctcatgcatggaggcgcaagaggcatcataaccaattttaacatttattaatatttttttataattcaagatttgatctaactcaattctacaaaatcaacttatgaggtgaaggttactcttccacttatatacttttatttgtcaatattattagttgatgagatctcaagcaccttttctcatgtagaagactaaacatctcaaatgtaatatttgcatgatttaacatttgtaattggcctaataatgactcactagtgaatgactcaataagtccaacgataatcattgggataaacttacatatcatcttacaattgaagtttcagtctaactcaattgtacaaaattgactcttaaatgtaagttattttttacttatatattttaatttagccatattactaattattgtggaatcaccttttttttacataaatatgaaaatattacaacttatcttttccataattttactttattgatatttttattatcaaacttaataaatataaagtatgaataaaataaaatattaatattttttaaatacaaaaaatcttaataaagggaaacttataaaatacatgtacttattttaaaaggaaaagaaaattcatacattaaaagaaaatattacataaataattgaatgaaattaattaaaatcataaaatgatattatctctaattctatatataagaaacatatgatgaatcattaaaataaaataaataaaaactcacatttaatgttatcatagattcaaattttattataaaaattcttttaaatttgaatgttgtaagtaataatcacatttaatatcagtattcataatttaatgaatgaatatctagtaaacgaaattaataataaattaaggatatagatgaaagttaactctaaataaatttaaaattaattatttttagaggatttaaaataataatttttttataattaggacgaaagataatatcaatctgttgcttacactgtccataagaccagagataacagtagtactccattaaaataatcatgccttataattatttgactaatacaataattgatcatttgatttaatagtatagttaaagtgttaaacacaagagaatactctcgatttcaacaatttcgattttcaaggcatgattgaatcactgtgaatcaggcccgagacgtggatgacaattagtgggacccaagtggagacgggtaaaatgagaagtaagacggaaacgacatgacgtacatcaagaataatgtcatatttattttataacaaacaaattacaaattaacaattcttttattttctaaatattgtatacaaaattcaattagaatattaaatacacatatttattttttttatgaataaataatatattcacaaataatagtacaatcctttacattatattcaataacaaattactatatgtaatttattgatttttaataattaccttaagagtcataaaaaaatattttttattatttgatgatataaaataattatagtggctacggatgtttattaatttttttatacaattaataagtttaattttgattaatttattataatttttcattctattaactaattaaaaattacacttaaaatgcttattataaaaaaattaattttgatgtatagttagtcttaaattttttacattaccaatgaattaaaaatcatcataaatatgatttttaagattattaatataaaagttaacaaatttaatgtgcagttcataagtaacaataatgtaaaatctccttcactggttgggaacaatataagagaatggaaaaaaatgaagtatctattgaagggatgaagagagaatttaaataatttaaagtgtcctaagacgtaaactatcccaacgttttaaatttaaaattataactgtacgaaagtaaattaatctttaaaatttcatactctcttatgaaccaaataaaaaaaaaggctacattgatctccttcctttattaaaacctttcttctcccattgtctcacccaaacaaaatgtctaattaaaatccctctcctctttctctcttcattaaaatcctttctctcctttgaaccatttggtctcaattagtccctttatattgtgagagcatacattaatacactatttactataatcatttagtctcaatattaattagtccctttgtgttgtcgtgagagcatactttatacactatttactatatatatttatatatatatatatatatatatatatatatatatatatatatgtttgcacaatggatattctgatagttaaaaagtaattcatttcttttaaaatttagatatcactgaagtaagttttattttgcataagaaattatttttcaaacacaattagaaaaaaaataatcatctttaacactcacttcctctaaattcaaatggaaacaaaattaataattttatactatttaaagttgttagttaatttcatttaaaaaaagaactacattttttaactacttttaatcatattaatggaagataacttttacattttaattgaattaagaatattcttataataataacttaaataagattaaattagttgatattaagtcgacgaaaaatattattttgctataattcagttcattaaattggacattcatttcttaaatattttttttgagaggtcctttcttatatttaagtccataaaaagtatattttttgttgtaaaactattgatatttacgattaatatacgagatatcgactagcgtatcacaattttaaaaaaatttacccaaatgtcacgcggataatagtattttccatactgtcacgccacctatttcactataaggcccagcgaaataagtagctgatgtggcacaattttgttggccgcgtatttcgctgggggccaagagaaatacgttacaacgaaaaaaaaaaacgttggaacacgtgtcacgcatgcatgaattggtggtgatattaattatataaatttcaaacggtctaacttttgatagaaatgtccgatcgagatgtacgatatgtcaaaatgctcgaaattaaaagaagtaattaaaaaaataaaaatagcattaaattaaataattaaataattaaaaaagtagaaaaaaggaattttttggatgattgaatcctaaatcctaattttcacatacttcgaggcattttttggagaaaaaaaatagttgaccaaatcccttttaggaatttgtctagaccttctcttctaaatttcgagcgttttaacatatcatacgcctcaatcaaacgtttctatcaaaagttatgaccgtttgaagtttatataattaatatcaccaccaattcatgcatgcgtgacacgtgttccaatgccacatattttgtttggctctagcgaaatacgtagtgtctgccacgtgtcctacccgttgttgaccgcgtatttcgctagcctttatagcaaagtacatgacaaacaaaattgtaccacatcagctacttatttcgctgggccttggagcgaataggtagcttaacagtatgggaaatactactgttcgcgtgacatttggatgaattttttaaaaaaatgtggcacgttagtcgatgtatagtatattaacctagattaagaaatatttaataagaataaaatattaatgtatttagttagtttaaagtaagaataaattaaagtataataattttaaaaaggaggtcatatattaaatgacatattaaaaaaatgtgtaaattattaaatatgaataaatctaatctaattaaattcatactatcagaaatgaatttaaaataattattgtttaaaaataatgaaaggtgtaaaaaaggaggaaaaggcattaggcccgacatgagattcagtgtcaaggtggatgctcaaaatattagatactgcgggcgtggggccctcaaacagaagacagtctagtgagtgacatttccacactgaaacatagacacattaagtcattaaccacaccacacgtacccaccccacactcccctgtccctgtccctctaccacttccatacccatacgctacgtatactatctgattttccgtttctctaatctctaccaatttccaatacgtgttcctacacattgttctaagaaattaaaaaatatatattttaaaaattattatataaaaatatggtattccatgatttatttatttcatttttaaaaaaatacacttatggttgtgaggaatattttttttaattatgatattggtgtgaaatatctatcaattttgataatgactaatttttatcgaaaaatctgattgatcactttaataggattttttctcttaaaaatatttttttattcacaaagtttaaatctgacacctcatttatggtgaccaaatacaaaaatatttgcatcaacgatttgttggtattataaggagtattttagatgtgtttgaaataatggtaaaaattagactatttgaataatcaattatatgtttagttaattatttgtataatcaatcataatcatgatcaatttttatttgagtaattttgttgaaaagtgatttaaaaataattgatatttttgaatgcaacaaaagattagcttttacataataaaatagtataaaaatagccgaaacagaaaataagctgtaaaaacatcttcttttttttcaattttttcttcttctaaatttaagctaggatcccaaacaaacaaacttattttagaaacaaattattttattaaaaaactgaaattatagattataagaagattaatattctttgaagagctaaaggttttaaaggtaagttgccatttttgacttgattttctttatgcacaaaaattaaaatttgagcccttactcccttagttacttgctcaaggaatataaatccatcaccacttaacttaacccattgcttgttaatcatttgtttaaaaacttaattgcacttgtgattttctaggtattgtacctaaaccaaagtaaaataactagaactcaagcttttgacctactggcaattttttttattagttttataaattaaaaaggcctcacatattaataaaaaagataacatatttttaatagaatgtgttgcataacattgacgtgataattgatatattgtctaacacatatgttaatatgacttatgcatttttaatctctcacaattataaggcttgatagactagaagtataactaagctatgttaatataagtgtaagacaatatgttaattgtcacttcacattatcatcgtcaacttatgtgctaccgtaccaaaatttattagggagtttttgtttcacgaatttaattatattctttggagaatacttgtgactcaatttgtgcaactaaaacctataaaccaaaattacacaattaccctgcaggataaaaaatgcaattaatccttatatttaataagacatttaatatttttttttcatttgcattatgaacacattaatgaaatcgatcaatagttttaaataaactttggacattagcacttgtttatattgattatatttgacaaaattagctgaaaagttagttgaaagttagaaaattggaaaattagttatagttaaaaattgaagacttataaactaacttattaaattataagtgtttaataaaattaattattgaagtaatttaaaaatgtaaaataacatttctaaaaaggataataaaaaaattgaataaatatgttaaagataatatatatatatatatatatatatatatataaaatatgctagaagttagcattaaaaaaatattatttcaaatagtattttaaaaaatattaaaaattacttaaaaaaatttagaaattatttaaaaaataagtatttagttagtaaaaaaaaatagcttaaatgatttgtccaacgtagcgcatgcttttgggtgaagcagtgtagtagtttcaattcaggatggaagaaggtggtaatttgaagatcccctgaagatcaaggtctgtttatagctcattgcctcattggacgtcactatatatataaactaaaagaaaagggtaaataggcagcgtctgatagtgcaccaaatagcatcatatctgtctgtcactatacattttccctttttctttctttctttcgctccgttcctctttctctatttcgtacaattctgagttcatcaggtacgttttgccatcgttcagcatttggttatttgatcttctcgtctcctctcctcatttaactggatctggatttcttaactttaaactgcattcattcattcatcactgctatccctgtctttagtgcaatggctgcgctaattcgctcacgttggaactgaaccagttttaatttatctgtttgtttgcactttgcacttcgcacgcaaatataacctctcactgactctggttggatggattgttacgtgcaccgcatggtgatgatatcatgtcttttgttcatcggatcggatggaagcgtgtcatgtatatgtcgatgatgtcctgattaatttgatttgatagatcatggcgtggagagaatgagattggaaattaattgttttgtccattacttgaggaatttagattaacactttggttttattgactaaaaaagcccttggtatatatctagatggctttaggaagtgattttttttatttttttttaatcaataaatgttagttgttagttttattagtatattagtgagagtttggaaaggacttcgaattaacaacttctgtgaattctccctttaaccacaaagctaaccttataattcctgaagtgaacttgatgacaaatgatgcctcctaaagggtgaatccgtcttgagcattgttctactggctagtcttttagtgaaaattagtaacattaccaaagagtgaaatggttggcttgatccaatcagccaaatttgcaagctgttaaaactattgttattcatattcttttattgagtagtatttgtatgttattgatttctctatctgtgattttcaggtattatttatccaggtcattgcctatgggtactaaatcagttgttgacttaatggagtctttatccgaggttcatttttctggatttcacatggatggcttagagcaaagaaaggctggcacagagcaaccaaccacttcagcaactgacatgtataaacaacctttcgtgataggtgtgtgtttttgcattccaagctgcctatgtagtcataaattcctgatttgtctataattcaatgttggtacttggtacatttactttgtcttgtgtttgttgggtatcatctaatgtataatagggtactaaatatattaagtttttgggatgatataaactgaggttctagagcccatatgtggattttgctgttctgttatggcagagaaatctcagcagctttctttttcctccccgcatttgcatatgattccattgagcccttagtttttaagtgaagaagaacaaagttacctttgaagactatcatacttcacaatttattttatcttctctaaaaactaattttaacttgggcataaattaattttatcttatgagaaaattttatttcattttttctttcataagtacttacggagaagttgaaccacataggatctagtccacgttcttgcatcacaatttcatttcagctgatcattcctcttacttggtcatcctacagttggaaattgtggttaactcacacagctaacccctaataatataaaagtagagcttcccgcaaacttacatacttaacattgaagttttctttgtttcaaagtttagacgcacgagttttgaaaataagatcgtaacaactttgtatgtcttaatttcacatctaaccaacttttatttggtatctacggttctaattcattttctatttactttttggtttgggtatgtcacaggtgttgctggtggagcagcatccggtaagacatcagtttgtgatatgattgttcagcagcttcatgaccaacgagttgtacttgttaatcaggtatctaattcttgcaaagtaccaatcatttatctcattttggtgtagattgaaatcataggaagagattagaagaaaaaagaaagataaaagagaaagtaaatgtaataaatgatgaggtagaaaagagaaaaaaataaagtgaaaataatatgaaagagagagcatctgtatgcttgtaataaccattgattttttctaaacgtactggtgaatggtgatcaaattgagaatttataactatatgagtctgtgagtcagatattaagggaatacaactaatagtttgcggttaatgcttcaagccttataagcatcctgtatcctccattatctgaatccccttggtattttgttcggccttatctattggaatgattttatcatctttgttttgtattttcattgcaacattgacattctattggctaccattcaccaaaatttctccacctctttctttttcaagtcagattctgtattatgttgttctaatcacctcttttatcatgaacatgtatgtgtttctccctcaaaatttccatccaaatgtcaatgattttctcaacaacagaacacatttgaatacaccattttttagttgacaaaagtaaaaaattctttggatgtattttctaacatttatgctgttaagccatgttcaatggaattgctcttttggcattagaagtgtctagtaactcgagtcttattcttcggatgttggagagcaattttcatgggttacaaataaagcaccgttactatataaagcaactagagttttctactttttaatggactttaattagttttatatattaaaatattagattttttaaaaattatttaattaacaaataacttagatttgtgtattgtttataaattaaactatgttttcataatatattactttatattttttcacattaaaaatattattaatttataattgatttgatttatttaaattattagtacatagtattttccatgtattctaaaaattaattaattaaaaattaatgcaaagttatttggaagtgaacattttatggaattaaaaattattatatatttatttcttactaaaacaaatgacataaaaatattttaaattaaaattaagatgaataataaaatataaaagagcaagatcaattgtggagcctactttttagagttgatagattggagaaattttttattgaattattaaagtcataaaacattatgtcagcgaggaagtgaaaaattataaagtaatagcaactcgtgtgacttgcttgaaggagatgcccttaaccttttatttatttattacatattttacttgttccctttgtactttggccttcttttatcttttttgagggtatgtgttccagaatttgggttgatgtttcttattgtacatgatgatacgttgagcgtaataaatgaattatttattgtacaacaggattctttttaccataatttgactgaggaggaacttacaagagtacaagattacaactttgaccatcctggtcagttcaattgtacccattagtctctcattattaatcagtaactttctctttacattaagacattatatagcatcatcactcaggagaggattggataaaaaagtccggagctacatcaaaatccttctttagatagtcttgtttttattgtttaggccttgtcttgggtccttttataaataaaaaataaagagagagagaagaaattatacaggatgaaacatgcactaaatttattcggatgcttgttttatttcctttattttaaatctacttattctcctatatctggagttctgtttttcctaaaatgcttttcgaggatcgggttagaaagcctaaaataatattcaggttttagtattgttttgtttttatcaggtcttatgtttttacgtagatacttaaatttcttgcaaaacaagttcaatacattcaattagtatcaactccatctttcttactctcagaatgcttcaggaatatcaagggtggtgtcagggaaaaattaacctttgaaagatgtaaagcagaatttacctcaaaattaactgattagggacatgaaagtgttaatgaaattccagagctagaatattctcgcatttagcctagagatgagtatggttggtgagaccactgcaaattttacatgtcagagtgttacaaattgtgttatatgcattatgagccattccaaaggttgaacaaaagttcattttgtatggtacgatacttgagtacctagcaagcataattagtataatacacctaaaaactgataaggtagcaacttttgatatggaaattttaacgtttaaatttttttatatatgtgaataatggttcttagactgctatagctactttattcctaatgtatgttgttgatgtcatcagaagcttttgatactgagcaattgctacgtgtcatggacaagttgaagcatagccaagcagtagatattccaaagtatgactttaagggttacaagaatgatgtttttccagcaagacgggtatatggaacattcaactttttagtagtaactttactcctcgttcttgaaatgcataacagaacaggccaagattataattttctattttgagtttttattatcatgctaaagaatagttttttattgcataggcttgagatgacaatgattttcgtagttgaatatgaatactttgatgtactaatgattgccaaataatgcagtacatgtttcttcttgcgttttatctccattagaggggaaattatatggaatacaatttcagccatacttcccttttatgttggtttaatgtttgccgatcaaaaaaaaaaaatgttggtttaatgtgttttgcaggtaaacccagcggatgttattattttggaaggtatccttgttttccatgatccacgagtgcgggcattgatgaatatgaagatatttgttgacacaggtcccttattatttaagttccaatataacttttataacttactgtattgtatttttctgcggcatttcttactatatatggatctgttgtcagattcattttccttttagccccatggacttaaatttcccccctcctaatccacattatgatataggagaacgcatattcaagttatgctaatgacactatcttcatctttttttccccacatttatttgttggtttctattttattaataattgcctacgtcttccttctaactatttacaagcatgcatattttatatctcgttgttgcactactaagttatgctatcactttacattgtgaaatgttcagtgcagatgccgatgttcgtctggctagaagaattaagcgtgatactgctgacaatgctcgtgaaattggagctgtgcttgatcaggtagctaccgtcagccacaccatttgcacttccattatcatattttgattatcttctggtttttttgccttcacgtttcttacttgtactgcatttcaagacttggaaatgttattttagttcatgttgctgagaggctgttatgaaatttcattgattagaaaacatgtaagaagtcagtttttatgaaattaaatctttaatgatctgttttaaggttatgattataaatcaagctaacatatttcctttttttatgtttaccatatattagtaattccatttttttgtttaccatatattagtaactgtttcttataatatatacttgatgcagtattctaaatttgtgaagccggcttttgatgactttattcttcccaccaagaagtatgctgatatcattataccccatggaggagataatcatgtggctattgacttgattgtacaacatattcgcacgaagcttggtcagcatgacttgtgtaaaatatatcctaatttatacgtcattcagtctacttttcaggtacccctttcttgttatttatcgtctttatcaatcatcccatctttccccgttcatctggaacatccaaattcaatttttttatattaaaagttgaataatcacaataattgcttcgatgcagatacggggtatgcatactctgatacgtgattctcaaacaacgaaacatgactttgtattttattctgaccgtctgattcgtttggtatgtaaatggggttcatttgttgctcttaatattagtgatggcatggcattttcttcaagcattaatggtcaaatttcgcccacttgaccaggttgtagaacatggcctagggcatcttccatttacagaaaagcaagtaacgactccaactggtaagctgttctttttcaatgatggtcgcctttacttgtattttatgtgcaactaaggatgcaatattctcttctcattgcactagaaagtgttgtggatgatgtgcctgttgggtatctctggtttctaaaatcctgccatattattgtcacaaaaatgaggagtaacatgaactacatgtttccagccttgttttagaattgtctatgtcttagaccacttgaaacttccaagttatccaagacatagttagacataattcagccaagttggaaggactacgaataacttctgctgtctgaattcccaatctaagaaatgcttcatataatgggaaccaaaggggtatcatgttattttacagtagagagacatgttctgttcatgatgttaatttctgcgattgccatactgaaaatgattaactttcctgtctgcatctttgctgatattctccttcaaatatttacaaaatagaattagtttgtttcacgtcttaacctttttatggttacagctaagctaatacttgtccttcaatgcaggatcggtatacagcggggtggatttctgtaagaggttgtgtggtgtctccatcatccggaggtatcgttttagtccagatcagaagtcacttgggcatttgtttaaatattgttatccttgctacaaagttttgactaaaatactttcttgaacaattcaataaagagaaagatctattgttgatttgggtttataattaccaaattgtttagattgcatatggtactctacttgttatccttgaaaatattatccaacccccctctctatattctaagaaactagttcttctttcctaattactcagtttgatgtgaacctatgatcactgcaattttttataaatagaatttgtccttaaatttgatatgcaatctaatttcagtggggagagtatggaaaatgctttacgagcatgctgcaaaggtatcaagattgggaaaattcttattcatagagaaggtgacaacggtcaacaggtttgtcatttgcgtgtgcttgggtatactgttttgattcatttcatgatcactaacttatcctttttttttttggtgattcactaacttgtcctttgattattgagcagctaatatatgagaagttgcctaatgacatctcagataggcatgtattactgctggatcccatcttaggcacaggtttgtcattctcataatgtttatttttatggtgttttttatgttactagtttaaaataatatacaaaccgtcagtagccaactgcgacttaagttacatagcagttagcataataagggtatataaaaaaattgatatttaatttgtttgttttcattttgattaactttagaatatcttcgtctttaggtaattcagctgttcaagcaatttctttgcttttaaagaagggtgtaccagagtccaacattatatttctcaatctcgtatcagtaagttacttgtgcctgttgttgttcctctgtatatcatatatatcttgccatttctttgttattttctgttgcttctttcttttcttgtacctaatgatttgcatatatatatatatgctctcatattgccaggcacctcaaggtgttcatgtggtctgtaaaagatttccgagaataaaaatcctgacatctgagattgagattggtttgaatgaagatttccgtgtcatacctggcatgggtgagtttggggaccggtactttggaacagataatgatgaccagaaggtggtacccgcttcacagtagttatacttgggaggaaattcacaatattttttggttcgtcatcattaatgagacttttactgcggaagggggcaataaaatttgctgaattaagattctgctggtctcctagttattgttcaaaatcaattttgatcataatcttttgtttgattttacaaacatacgcataatcggaatattccaatgcaaattttgatttaccttttattattataccagaatttttctttgaacttattctttgccggacactggcttatcaagatacatttttactgtccggagatttttacttcatagatataaatgagtatgtaagttctttaattaaatatctatcactctcaaaattgagaatatatagcgagggtaaattgcataaagatgtaacttgaggatggaacttgattctgaaaaaaagacaaaaaaataaaaataaataatgtgactgagacattgttctgcaaacaattttcataagagcctttaggttgatatcttaatatgtaaagccaagtccaagaggatgacgggtgagagctttccacaaaatttccttgttatatatcatgagttgagtggaatatatattattgaaacggatgaggtgccacttgggcaagggaaggatcactcgttgctttatccaagagtgataaccttcgttaggctaatcactggacacgtggttcctttgcatgggttgggtagaataccacttggtatattcctttgagatttttatctatatagctttggtctgggtaaactcctttttcgtgctgtcgtctgttatctgtttcccgccatatatccaataagctttaaccatgtctgcctttgttggaaagtacgcaggtagtatctcatatctcctcttctcttaatattactcacatctctcacccacacgtaaacaagaacaattcttcattgaatgaagtacaagcttgtcaaacattccactttaatgtactgattaacaagaaaagagtagccgagaaatgcatcatattctcattagttattggaacataatatcaaattataaaagattcattcatgtctaagaagctcattctaaatctttatatgtttacaactcttagactttggtttccaaatgggatgtatgttataacttacatcaattccagatgagcttatcaagaatgccaagtacatagccacacctgggaagggcatcttggcagcagatgagagcactggcaccattgggaagcgcctatcgagcattaacgttgagaacattgaggcgaaccgccaagctcttcgcgagcttctcttcaccgctccagatgccctccaatacctttctggtgtcatcctctttgaggaaactctttaccagaaaacctctgatgggaagccttttgttgaggtacttcaagagaacaatgtcatcccaggtatcaaagtggacaagggtgttgttgagttggctggcacaaatggtgaaaccaccactcagggcttcgactctctcggagctcggtgccaacagtactacaaggctggtgcacgcttcgccaagtggcgtgcagtcctcaaaattggcccaactgagccctctgagctttccatccagcaaaatgcacagggcttggcacgctatgccatcatttgccaggagaatggccttgtacccattgttgagcctgagattttgactgatggggctcatgacatcgccaaatgtgctgctgttactgaaactgtacttgcagctgtttacaaggcactgaatgagcagcatgtccttcttgaaggaactcttctcaagcccaacatggttactcccggctctgatagcccaaaggtaacttaacattttcaaaatcatacatccatatgtatggttacattctatagttgaatacttactagtcttagaaataaaattggaatgaagtatagtgcaatattgttgacttcaaaaaagatttgtggacaccttatatgctatttgacacagataaaggaatagtagaggtatgatgaatgatatgacgtgataggaaaagagaaatgattggtgttggtggagcattagtaatttaagggtgtctaaatatcattgttcgatttacttggaaacgaatgtgagttggcaccagtagttaagaatctggtcagttcgaactctcaccttccacataggtatggattcaaatttccttgatgccactttcttgcttggtgtgcaaccttcttcaggaagctctcttggagcttagaggctagttaagtagttgcaattaggtgaaactactggtcttccagttctaccacttttaggaagaaaaaaaaattacatattattaactaggaaaataatttaatttgtgtgcatgcaggtatcacctgaggtgattgctgagtacacagttcaagccctccgcaggactgtcccagctgcagtgccaggggttgtgtttctgtctggtgggcaaagtgaagaagaagccaccctcaacctgaatgcaatgaacaagttggaggtgttgaagccatggactctctcattctcattcgggcgagcactgcaacaaagcacactcaagacatggggtggaaagaaggagaatgttgccaaagctcaagaggcatttctggcaagatgcaaggccaattctgatgctactctgggaaagtatgttggtgggagcggaagtgggttgacttctgagagtttgtatgtcaagaactacaagtattagacttctatgagtgtgtttgtttctccttttaaaaaccttaaaaacgtcaatccatgcttttggttcagtcacgttgaggtctataagaaagcatgacaatggagaaacaaacatactctaaatggacttggggactgatttggggtgggtgcattctggcatatgtatgatacagcctaagaagcatttgcttctgattaacatgcttatttttgggttacatatttttacaaatatcagttattatgttataggagccaattttaatgtcaaatggtgatggcgcgtaccactcaaaaataattgttggagggaggctggtatatattgtcagaaacagtaatattgtactttataaaatgtgcaattacttaacacaggatgatggaaagcagtcaattatattagtccatgtaaatgatgtaataatgggcgtgtactttttttacccgtcgaacattctttagcagcaggtagaacaaaaggaatttgaaggaagaaaaaaaactagaaagaaaagaatcaaagaaaacaaaagaatatttgctcaaatggacatttatcaattatcattgtacaacctagttactgtctgcacctattacaaattaatgtttagcttcagagaattcagataattaattttctacaaattatatttgatagctcaaaatccgctgtggtgttaaccatggataatagtaatgtctcggtgagtcactagtcactagctatacaaggaaattaccgtttgtgtgtgtctctctctatatataaatatttggctcactttagagacattttctttcatatattaacataggtgggaattattattaaattaattgattaatttttgtcaaaaaaatctaattgatcactttagtagaatttttttttctaactatattttttttatccacaaaatttaaactaacactttacttaagaaatcaaatccaaatgtttacactaacaacttattaattgcttcagtgtcctttgcttgttatttatgttgaaggatcttgttgcccgacctatgtccattgtgttatggacatatgaatcctacactcccttatttgaattctaaatgcaccttccaagcaattcgataaagaccaaattagccttaacgagaccacctcccttccccaaccctaacacctcattggctcctacacccaacctaacacctcccaaacctcgaaaagtgtgacaacagctttgcaaagccctccttcaccctccttcctttgtacctttcgaagtccctgcacggctgcaccctcctcactgaaccccgaaagcatcatcaaaatgggtggtgcaggattcaaatgtctggtttgaaaaaaaaataagaaaaactaacgtagtaaataacagctaggaagattctggattaagagattattttagtgcagctaacacgacaatataaaaggaaagtcggttcaaccaagccggcttttctgatatttggggttgtgtccacacaagtgtttctcatctgatccaattcttttgccttgcctcgcaccttctcatctcaaaaaatacgcgtttatatgtgtcataatagagcagtagatttccacgcctccgccaaaccacaatcacagtttcacttgacatggccgatgtaataagttttgctgagctagtggacaattcgataaggagtagtagtgctagtgggtcagatgttggagcatcccctgtccatagttttgctgagctagtggacagtgcgataaggagtagtagtgctagtggatctgattttggagcatcccctgtccatagttttgctgagccaggacatgttgctgctgctgctgcgcaattattcagccaaactgagcttcaagcagccaccaccaatttctcacttgacaacagggttggtgttgttcatgttggagtttttatttaaactccatgggttatgaataagaggcggttaacaattcaaaataataactactcctaaccgctcttgggaaaggttagaaaaataactactcccaaccgttccgataaccaacggttacgatggttcatcgccgagagtcgcgatgattcaacgccaagagtcgcgatggtttgccggcaactcttcaccagggttgtttgttgtctataaatagacacagagacagtcagaaaagaagaaaagaaaaaactgatagagttttgatagttaatcttttctgatattctcgcttagatactagtgcatttccatatcacataactctgtggttcctcaagcattagctttgttcgtttgggctgttgatttgaagtgccatcaatcttcagacgttgatccgttctatcctgggagacaattgttcatcaacctttggcatcaattggagggaacaaattgtcttaaggagacaacattgttgggctcggatcctttcatctctttgcatctgtgtctgattcatactcatcatacaggttctatttaatttgttttttgtacagttgtagtagattatattgttcctcttgactactcagattctgacccttgtgcaattggatatattccaattctaaattaactaatagatccaacaatcttaagacaatttgctttgattgaatctgggttcagtatattctatctttttgtattatatactgttgtctactctctgtacttttgaacgattaatctgtgtgattaatcagtgtttctgtttgatctgtgtgattagtcagtgtttctgtactttaccttttcttctgttgatagatcaactgaattggtaaatttaatacatactgatatatgtgatatgaaatctgtaccatctaggggtaataagaaatattttattacttttattgatgattacagtagatactgttatgtttatttacttaatagtaaggatgaagcacttgtggcttttagacaatataaaaatgaagttgaaaatcaacttaacaagaaaattaaggctataaggagcgatcgtgggggagaatatgatggccccttcgaggaattctgtatagaatctgggattatacatcagacgactgctccttacgcaccgcaatcaaatgggattgcagaaaggaaaaatcggacattaaaagaaatgatgaacgctatgttaatcacgtccggtttaccacagaacttgtggggggaagccattttgacagcaaactatattattaatagagttcctcataagaagacaaagagcataccatacgaagtatggaaaggaaagcaaccatccttgaaatacttaaaagtgtgggggtgcttggctaaggttgcggttcctaaacccaaaaggttgaagatcggacctaaaaccgtggattgtgtattcattggttatgcacttaatagtagtgctagtcgttttttggtttatagatttgatatgtcagatatacatgttaatacaattattgaatcaagggacgctaggttctttgaggatatatttccgtataaaaaggcatatgaaccaagtggcaatgacaatgttaatgttgtgagacctcaagagactacaactagtgttaatcctgtagaggaagaatctagacgtagtaagaggcaaaggaccaccacatcctttggacctgattttctaacatatctgttagaaaatgagcctcagacgtacaaagaagctgtaacgtccccagaggcaccattctgggaagaggctatcaatagtgaaattgaatccatcctgtcaaatcacacttgggaattggcagaccttcctcctggcactaagcctctaggaagtaagtgggtcttcaaaaggaagatgaaggaagatggcactattgataaatataaagctaggcttgtagtcaaaggctataagcaacgcgaaggtctcgactacttcgatacctattcacctgttacaaggattacatccattaggatgttagtcgcgctagcagcgttgtatgggttagaactacatcaaatggatgttaaaacaactttcttaaatggagacttagaagaagagatctatttggaacaacctgaagggttttctgttccaggacaagaacggaaagtttatcgcttaattaaatccctttacgggttaaagcaagctccaaaacaatggcatgcaaagtttgataaagttatgttatcaaatggttttagtattaatgaatgtgacaagtgtgtctacattcaaaatactgataaagggtttgccatagtctgtctttatgtagacgacatgttgataatgggtagtaataatcaaatgattaaagctactaagcaattgcttgccagcaaatttgacatgaaagatttgggaagagcagatgttattttgggtatcaaaatccatagaacatcaagaggtttggctctatcacaggctcactatattacaaaaattcttgaaaaattcaagagtttaaatatatctcctgtgaataatcccatagactctagtcttcgactattgaaaaatactggcaaagctaaagcacaaaaggaatatgctcaagtattaggcagtcttatgtatgttatgaattgcactagacctgatattgcttatgcagtgagcatgttgagtcgctttacgagtaatccaaacatgtatcattggaaagctatgataagagttttaggatacctaaagcacactcaaaactttggtttgcattatgaacagtatcctgcagttattgaaggatattgtgatgcaaattggatcaccggttctaatgatactaaatctacaagcggatatgtgttcacccttggtgggggtgttgtatcttggaaatcgtccaagcagacttgcattgcaagatcaactatggaagcagaatttatcgctttagataaagccggtgaggaagcagaatggcttcgtaattttgttaaggatgttcccaattggtcaaaatcagtaccagctgtatgcatacattgtgatagccaagccgccattggtagggctaagaacatcatgtataacggcaagtctagacatatacgtcgtagacatgataccgttagacaactactctcgaatggaatcatctcaatagactatgtgaggtctaaagagaacatagcggatccattaactaaagggattcctagagagttagttgaaaatttgtcgaaaggaatgggtttaaggcctatcaattgttgatcatcgcggtaactctaccttgatgagtggagatcccacgaactaggttcaaagagacaactaagtcatgatcgactgcttaaacactgtggagtttttaaactcatactcattcctatgacaagaccgtgtatatgagggtaagcataacggcttttaatggtttcttaatctgatgtgttcagatgatatatgtggaggtatatcacaagaaatcacctatgtgagtgtgaagtgagggccgcttcaatgagaacttaaaaaggccgattctctataacacttgcagaaccaggaaggtgtccacggccaaaatggacacaacaatgaggacgagcaatgctagggaaacaattgtgtgtctcctattgtctcggtatacaccataaaggtcgacggttcaaggcatcacgaccaccgattgacctagtatacccgataggtttacactagagaaggttcaaaggtgacccctacctatctcgatgcaattgtttctcgccgaggaatcacacttgcatacatattcatatgcatttagtcatgttgaattgatctcttattcatgtgggggattgttggagtttttatttaaactccatgggttatgaataagaggcggttaacaattcaaaataataactactcctaaccgctcttgggaaaggttagaaaaataactactcccaaccgttccgataaccaacggttacgatggttcatcgccgagagtcgcgatgattcaacgccaagagtcgcgatggtttgccggcaactcttcaccagggttgtttgttgtctataaatagacacagagacagtcagaaaagaagaaaagaaaaaactgatagagttttgatagttaatcttttctgatattctcgcttagatactagtgcatttccatatcacataactctgtggttcctcaagcattagctttgttcgtttgggctgttgatttgaagtgccatcaatcttcagacgttgatccgttctatcctgggagacaattgttcatcaacctttggcatcaattggagggaacaaattgtcttaaggagacaacattgttgggctcggatcctttcatctctttgcatctgtgtctgattcatactcatcatacaggttctatttaatttgtttttgtacagttgtagtagattatattgttcctcttgactactcagattctgacccttgtgcaattggatatattccaattctaaattaactaatagatccaacagttcatggtcgtgaggtcgcaatcaacaagtatcaaatctggagatactggtttcgtaggcctaaatttaccttacaccaaaacatagttatacaggtgcaaatggactgtgatggatgcagaaggaaggccctcaaaattgcggcagtgacaaagggtacctttattttgttttattaattaaaataacttgcttggcttattattaattacaccatgaatatttatgttatgaccaagaatatctaggtatacatgtacttggttggttaagctaacagtgggaagcatgcatggatgcgcaggtgtgaagtcagtgtcgctaaatggagcagatagagataaactggtggttacaggatatgggatcgatatagttaggttggttatggcatttgagaagaaacataggcatgccaaccttttaagtgtgacagagtaacattaccaattccgaggctactctggggaagtatgttggtggaagcggaagtgggttggcttctgagaggttgtatatgtcaagaactataaggattaggcttataaaagtgtgtttgtttctctgtagttgaacgccaatccgtgattcctgttcagtaatatattatattatactttataaaatgtgaaattacttaacacaggatgatatacaaagcagtctatcatattagtccgtaatccgtatagtaatagctcccatacagggccatacttttccccgtcgcacattcttagcagaagctagaacaaaaggaattaaaaaaagaaaaagaaaaaatatatgcttaaatggacattcatcaattatcattgtaccgccgagttactgtctgcactctgcactctgcacctactataaattaatggtttagcttcagagaattcatataattaattttctacaaaattctattttgatagctcaaaatccgttgtggtgttaacctgaaataatagtaatgttttggtgggtaactggtcatggtcactaacaatacaagtatattccgttttgtataaaaagaaaatagcaatggatattccgcatatgctttagtggcctttgagcgaacatatatatgaagattttgattaagacatggttttgggatgtaactcatgtaaggctcaccacaataaaattatgtatacttttgaaatcttagttgataccacgcaatgatcaacctctgacaagtccttttctgcttttaacagtcaaaaggcattccaattagtgcagctgacacgacacaattaaggaaataaaagaaaacagtatcagaaagttaattcagcaaaagcgcgttctggaaaacaaactagtagatgaagataaaatagaaactccacccacaacatattctggtatggaagggcttcaacacccctccacccaagtctctatctacaaataaaaacaataaaatatcaaaattaaaatcatatggtgtgtatatatatatatatatatatatatcctctaatattctctttttcatttctcacaaaaaaaatcatatcactgttttgcacactggtatttaccattagctatatctcctaattaataaagtagaaaactagaaaataataagaaaccacaaagaattctatcatgtttgttggctcttcatcatcggtttgttatgcattgtctggctactagaataccagctggaggactagtcatctctatctggcatgtgctatacagagagtaagataaatggataaggccaatatggaacctcaccttaaatgttccccttgcattgtaattgaccctgttattctccacttgcctttgaagttttacaccaacatcttgcggcaaaaacaccaagcttgatatcaagttcactgattgcaacctggtttcccttggcctttgagtgaaaggcttgattgtttgtgaagacacgagtctgtctgagtagaaaagctcaatgttcaaggactcaaacctcaccccaattctcctgttaggattggaaaaatttgcaaggagagtgaattcaccattgaggtactgtggtgagtcaaagtacaccacattgaggcttgcattgggaatgtcaaacgtggggtttcgcggtttcatggaaaggtagataatcagtgttgcaattccaaagaagataagcactaggctgaatatgaagcacagtattgcagcacaccatataattggttttgtcctttgaagtcgaggttgcccgaaaattgctctagtgttggcaagggaatttggtgcttctgattgctgagaatgttgattccttggttgtattggtgtgccaagttcttcttcaacagaggctagcatgtttgaaaaggtgcactactaaaataggccaatggaagtgaatgagggagagatagaagtgatatgtttatttattctaaatggggtgatggatcaatataagtgaagagggaaaaaaaaaaagcttttgtagttgagtaataataatggaggggacaatgtgttttttttttggtattatcaaaaggtgacacaggtgagctaaagttgcaccacattgatgtcttaatttttaatgtttatgctttttggtatatatgcggcaacgtttgggaaggtgctaaaagaatgacttcaacagagccccctcactttgttgatttcttatcctttaagttttgaatggttttagactttgtcaaatgtgaatgtaaatgagaatagtcagtttgattaagggcttagattatgcgtgtataccaattataccagggtttaactagtgctctttcttctattctatttgaccaagagaaggtccttaaaagcaagttgctgcctggattatataatgttaataggggaaaatgataacttgaagcacctaaaaccaaaagctaaatattaaaattgattgtatgcaagttgatttttttttctcaaatcatgttaagactttgggatgagaaattataatgcactatataactactgtgttatgtactgaaaaccagagataataaatgatgcaaaaattagaaagacgtgagacaagtagaagagcttacaaatctataataagtatttaatttttttataggctaataataagtatttcatggagaaaatttcttccttctatgggtgacgttcattctctatatcttgtgtttgctcgtgggaataaatttttctttcaaaagttgtccattttttttaaaatttatatttgcaaaaattatatttacggaatatctacagtactgtattggatacacaaattaccatgaaaaaaaaaaaaatcttctccctccacaaatgatggtctcttcctagacttccccatttcctagaaagctagaaccgaccaaatcgccgcctactcgattcatcaaaaccacatttgggccagattcggttgggagtgtcaatttcatacttgtaattaactactaattattattttttttattagtagaaaatagaaatcaaagacaaataagtattaaaagtttacaacaatttacattctattttgctgagttaaactatttgacaattaatgaatttaagtgtataattctgagatgcaagaaattgacaaatgaagtgttctgactaatggtaagtgtgtcaccttaatttttaagagatgcgattttgagaattataaaaaattcattcacaataggtacttgtttaagaaatcttaaaaagttataattactattactcctgttatttttacactatagtttgtttttttataaataaataaaaagaggtagtatcatacacataagttattgagatgagaagaacttttcaacttacaagagaaaacatatatatatatatatatatatatatatattaaccaagaaatcacaaaaaaacatattgatgcatctttatattgattcatagactttggtattttaataacgagtttaatgaaatgttgaagtcaacataaaaattcaaaatgtgttaatttaacttcaaaatgacaatggaaagattacattttaacataatatgtgtttgatatttgtcttctttgattttataaattgaataagcaaaaaaaaaaatatttctagttaagcataactgatagttattattataaacatttgagattgtattgtcttaattacaaaaaagtaatcatcgatcacgtgagttaattgacaccagatttttttaacttaataaaaaatattgagtttgagttatgaaaatacaattattatttttatgagtgaatattcaattatattaaatactcggagaaattttttttccattcataatggttttaagattagcatgtaattgttttttattttaattttaagatatgttgaacttttttctagaattttattctagaagtgatttgtaaactcattttcaaaagtactttataaactacttcaggattgcatttttccaagtgatttgatacattgtaaaattaaaattttagaaataatttataagtttttaaaattaaaattttgaaagaaaagttaatagattttagaattaaattgctgaaaataatttaagattaaattgctgaatataatgatattgttcctttacgatttacaattggttagtgcattcgtctgagcctactccctcaggctcttcatttttcttggcttatccgcataaatactctgcccaatcttcttttctttcatgtcatttttccttctttttttatgattaagtaaatagcgaaatacaagagaataatgatgctgaaatttaattaagtacggtaattaataagtatattattttttaaaaattatatttattgcaatcttaaattaataagtatattaatcttcttccaggggtgcctcaatcccttgtttgtcaacaaaaaagaaaaagtatacaaaatttataatattgttattcaacaatgtgttaccacattatttaatgagtttaatgatacattattaaatcaataacatgatttttcttatcataacatggtaatttttctatgctaacattatatatattaaaattaaatttaaagatttattgtctcaataacataattgataattcctttttgtacagtgaagctgtttttcattggatattatcgatcattggtgaatggtgattcattcttcttgtggggcaattatcgccaaggtctcctgggttacgttccaatgttccatgactgttatgcatggaacatgtggtttgaaacctttcgttgaatatacctggaaattagaactaaaagttaacgttgatcacaagaagaattatgttctacaaagtctaagtctttgtccacatcgtattaacgagtaggctttgcttcgaatgttgatagaaagtgaaagaaagtagcgtgaatcgaagtaatattttattaggttttattgtttgaattgaccaatttttaaatgtgataattatattccatatatctcattcaaaattacctttggcttttttacatcttctttttttaaacctaaatccctctttgttggtgatgtccttattctgaagttgtgtatcatcaatttatcctacttaagagtaattttcccccgctgtctaacgcatgatattatttttgttatagaaatataacacattatagttcaagaaaagatttggattttcattataaaaatgtatgtcttttatgagataaaggaaatgaaaaaaaaatctgatattcttatgttttaatattggataaactcacatcattatcaaaagttttaaattcttatttttcaaaaaaaatacataaaaatgtgtgtcctttccctaaacagtttttttttttccttccagcaacgaacgggtcttgaacctaggcacaggccgtccctagatattagtttagttcaattgatttgagttgagttgatttttttatttatatatattttaatacctactgagagaaacagagtgagagtgagggaggaaaggtgaaatcatataacaatactaacatttttggataaagtataagacattcaacacttatcatatgattcatatcataggaaggaaaggatgaacaacgattatgctatgcagcatacagagtggaaactacatgtgctcgtcttccacaatccgcaaatccaaccctttcaacattggcgcatggaattggtatttatgtatgtatgttattccgttaaatttcaataaactttattctttaattaataattaatgcagatatctaaacgatttatgatttgattgtttaccttttcattcttcacagtgatgcagatgtaaaagaaaattagtgagtggggagtagttgggagagatgtggtaagtatgattcagaaggcttttgatgatccaaatgtcattgctgaggttaatgaaactcttattactcttattcttaaagtggagcacgtggttaattagtctttgtaatgtctcctgtaaaataattacagattttggctcattgtttgaggccttttatggaaagatatatctgcccgtattactgcaacttcattcccaatagatagagtactgataatattgtgattgctcaagaaatttttcattctatgagaaagaagaagggagctaaggggtgaatagtcattaaaattgatttggagaaagtctatgaacgcttgaaatgggagtttgggaatgatactttgtatgacattggttgcccggccaagtttattgatattctttggaattgtatttgttcccccagtatgaaaatgttatggaatggagagctactccaggagtttgatcccatgctaggtattagataggatgctcctatttttccctatctttttgttttgtgtattcagaggcttttccaattattcaagttaaaccatgttattttttatatttaaatcatgtttttgtatatccaaaatcttactaaaagaatccaagtccagcttcactcaaacttatccaagctgcattttcccaagcttttcttttggtccatggcacacccttattttcggctattcagatttgggcttaaggattgtaattgattataactcttgggttgggtcgccttatcctttccttcctttttctctaggcctttgtggccccttgttttcttacgaccaaaactaaactacatcaacattaccattaaaattaatgataaatcacataatttattttaaaatttatgaaaaatctgatttataagaatgtatatatacctttttatctgagttgtagaaaaaattctacattatcagcgataggatagctagtgccagatatacaggaggaaatgcccctcaaaagaaatgaaataaggaagaataaactatttttcttgttctctagaattaattgcatttggtttctctacgcaaaaaaaaagtgataacatccgaacaatatgtcgccgctttggagaggatattctgggggcaaaaaaaacatactagtatcaacaagcgtagtggttaaaatgattcaaaccattaatcaagcatgtttgattaatcaattatgtcaaacacgcaaagtacgaatattagggggcaagtcaagtagaaaaccatcacaagcaaaacccactttaaccaaagagcatttcttttttatgatttaaccagagagtctatacatgtggagcacgactcaaacagagagacataaccacgtaattcttttttctattaatgttgaaaatcttcatcctcacataagaagtgcgatgcaatccgaatccttatccatatccatttctctcgaatctcttgctctcacttcgggctaattcattgagattcaatagtatataactatatattgatggtttgattttttttgggtacatattgatggtctgaatttgattatacattcagataaaaatcaaatttatgaactaaatatagttcaaatatcggcatttacccctttgatgtatcatcaattttgttagttagacaataagatgtttcaaaaattaggaaacaaaagctatttatttaatgctgtcaaaaaagaaaaagctatttatttaaaatttgaatgaacagcaaatgattaacgtgatgacaaaaattggtaaaacaaaatgacttttcaattactatatgttaacataattatttccaaagaaaaataattagaaaagcattgagctttttcttcaaataattaattgatgaaaaatattgcttttttttctaaacatggattctgcaattcgctaattataaaaccaaactcgaaaccccgaaaagaaacagaataaatagtgacagcattgtaacaaaggcaattgaatattaaatcaaacatgaatcccaagaaacaggtaattacaaatatgaacgctaacgaatgctaatttataaaaaagaaacaaacaaatccccagaacaattaacaagaaggaaatagaacaagaggatgctgtgaactagaacaatggcggcggtgcataaccgatgaaaggccttcctccgccgccgccgccgccgccgcaagaatcgcagaaactaacagtgtctttgatcttgtggaatccatgcttgaagactccgaacccgaataccaacccgatggcgatcaccaccagaaccagacacgtgcaaagcatgcaaactctccccccacaacacatctttccccagagatcgatgaaagggtatctcggatctgggaaattcgggtgctgattctgttcgggaggtggtgggaaaattgagaaagataatgcggaatttaaaagaaaagggaaatagaaagaagtgtaaaagtggtaaatagaaggaaggggaggcaacattggtgtctctttcaccaattcaagacgttttgatttgacgcttttgttcacttataaggaaagctatctaatccattaaaacaagattccctttaataaaataaaaggaacaaaagaaatttatctttttctcaactttttagatgccccatatcacataagtaaaaccgataattcattccatgtatttaaaattataagatagtaactagtgtaggaacatatttaaattttcaagacaatatacatatatttagaattaacttttgatattcagtttcaactgttatatggatgagggaattatttaacaagcataaaaaaccactaatttaagttaatttgaatagattcatctggagagtgaaaattatttaggcttctgtttgttttttttttttattattcgaattcaatatcttaaaaaatgttttgataactattttgtaatttatacaatgtttaaatatgtataagtgaggattattttatgaaatcatcaatatttcttcttttaaaaaataacattgttataataaataaataaaaacgaaaacgtgaacgttttgttgccaagtttcatgggaaacgtggaaggtgatgcgttaaaggagagtggtgaagtggttgagtccgttacaacaagaagctttgggaggctacaaatttggtgattggtccatacgctgaagttgaccgttgttaatactgaaagatactaaccacttacttaatctcccatatgctatactttaacgtctctttcttccatttccaatcatcaattccagtttttataatctagtattaacatcaacaaagtagtcacaaacgtattatttattacttccgtttttagttataagaatttttcaaaaatttatttatctattttataaaaaattattttctaaatgaattaattattttttcttttatatctttacttaattattctctctccaatcatttatgaaaaacaattagtatttttgctattaaatttgtttaatgcgagttttattaatttatttgaataaaatttcgtttattaagatttgtgtaatatttatttaataaaaagtgcattgaaaatttaacgcacctttcccaacaatcaacataactagtagtattaactaatggccgtggtttctttttcttgtctaattgcttttggacactaatgccagtagctgaaatattattatatgggcccataaaatatgggcttgctacgtaaaatgaaacaactgtagtcaaaacaggttaagcctactcttgacccaaaaacatgatccactgagttttccaacgccgaaataaaaaaattcaagcctgttaatattcaatattaacagtttaagctcttgtgattattagtgttgctctgtgtttttctctcgtttgaactttctcatagttatataaatattttgatcatggactattattctctctggattcctcttcctttgagccaaggaagggtgcttttacttctgcagcagtttgcttgtaatgttagcaatgatacatccataaaaatggttcatgcgacgaccaacctttgaccaagtatatcagatgctaacatggcagtaatactaataatacttctaaaaaaataaaaaataaataagaaggaaaaaagaaaaaacaattgcaagaaacagtaggacaaatcggttcccacataatgtgtatagaatagaatacttctaatgaactaataattattttcaattatttctccgtgtttttttaattactagaaatgtattatttaggctatttaaatcgctaataagtcatcttaatcacaaaattaatgaagttttgtgaaaatagttcaaaatcacaagcttcactaatctaaactaacaaggtaatatattatacgagtaaaatatattatcattcataaagtgatgatacattataatattagtatatacattacattgacaccatttttctttgtatctgttttttttataatttatatcatctaacatattcatatttatttttattcctaaatatatataatattgataaattcattcttaaaagataaaaattcaaattttagtccccaaaaatttatttgacacattcatatacgagattgtcaacgctttacatattcaagacgaaaatgaatatttatctaaaatataatttaatctcatattctctcctttttgtttaattattacaatcataccattacaataaatactttaataaaaaacatgttagaacaaatataataataaacataatattgattaataagtataatttatttattgttttgaaatttctaatattatagtaccttattcaaaatatgaggttcaaacaaaaatgtatagtcgttacattaatcctaaaaaaataaaactcaacttgattttgttactttataatattatcacaataaaaattttaaaacaacaaataaattataaaaagatgaaaattaaattatattttaaataaataattattttggtctatgaatatataaagcactccttaaatgtattacttaatctctttcattaataataaccaatcaaaaattacacttttttcgctttcaaatattaaaatttaaatttttattataataaaattgttaattctcatattgatgaatatgaaaatgactatttaaaaaaaaaaatcttagtttgtactttgacttcgtaatacattttgtggcaaaggtccaaaagtgtttatattttaattgtttttaagtcgacggaaagttttttggtggccgatagacgtatggttgtgaaattgcagcagaaatttctcccaaacgaaatggacaaaatgacctgggagcagcactacataaaaatgagacagaatttacagaatcgtttttttgttttcgtttctacattttaatttttttttccgtgtaaatttgttaatgtcagaaaatatattttctcgttttttttttttcttctacttggaagctatctaccagcattggtccgtttcccacttacgggtctgatagtagaatccggaagagccattcggagcagccaccacagacgacaacgagcgattaccatcaagcgccgccatcaacgacagatcatacagtgctctcgccgacggatccgacagcgtctcgtaagcgtcgtggatcttgatgaagtcccgttcgtccgattccgaccgacggagcgccgaatcagggtgatacaccttcgcaaggttccggtatgccgactttatctccaccgccgaagcgttctgcttgatccggagcacctcgtagaggtttgccgctcgccgggaatcgatcgccgtcgccgtgaatgcccgaattgagatccttaccggtggccggagagtcctgccggcaccggtgagaggcgtgagatttagggttcccgccattgagatattttctgaggtcttctgcggtgaggggtataatgggaaatgaaaatgttgcgtttgtggttgtggttggttgaatttagctttgttttgtgcagtgaaatgagagttgagagaggtttttatatggcggtcaaagatggagaatagcacaagattgagagaagggtatagtggtcatttaaatggcagcaggtattggtgttggtgcacaataacaacttcgtcttgggtttgcaaaaggttctagaagctgccccaccacgtcgtctttttttagtggagaaagttttagaataattgttttttcgcaacgtgttaaggaaaatgagatgcgtgtgggtacgacaaaaccagggaaaataaaataaagtgagtcgtggaggtgaaataaatataaaaaaggagatacaaaaattataattaatttttttaataattaattttttttttttatgaacgaagttgaagtttgattccgcgtgataggctgatagccactgaatctcaggagtcaatttatgttgaataatgatatttaaaattcgtgtttgaattcaagattgtgcaatatttttctttttctgtttaattggcaggtgctttgcgttcatatattgcacctgcaaattatatggcagtccttatgcctttttcatgctatcaccaagaatgtaccgataaaatataataaaaggcatagctaccaaggttttgagttatatagttgacaaatctttttgacttgcaaattttgttcgccattagcacctaaaattgcaattaatgtactcattatatagattgatccatctaatgtacaacagtgttaaacaatttaaatctttaatagcatattaaaagttgaacatttaagttgttgagcataaaggggaagaataacactaaactgatcttatattcataaagtagaaaaatgttaatgatattttgtgtaacattttcttctcaatattttctctgtgattaacattttttattaattattatcaattttggtggattcaacatttaagtaaagagaaataatcattaaataataaacaaatttcaccaaaattgataattttcaataaatttttgtcaattataaaaaaatgtaattgtcatttctctcacagaagatatgatgttatctttcagaatagtgatatataaggaaaagtttttggcatcgtaactaatacgagttgagaaaaaatcagcatgtttaagtactaaattaattttggcgccagctaaaaaagggaaaaggggatttaaattgataattcactagggatcaagatcactggcagttcaaatggaccaacggatacatgcagttttgaatctaacagtgaataatttttaacttattgtgatgcagttgaaaattcaactgcagaagttagaagagtgaggtagcccagcacagaaccgggacactttctcaattactgtgggcgtcgttgacatgattagtctggtaaatcacaatcaacgtgctcatataattcacttttttttttttttttttttgtgaatgtgctcatataattcactaatccagtagcttaacgctgataaaataaaaaataaaaaaacccagttgcttaacagagaagaaccgtgtactactcaccaaataggtacgtatacggtaactatttttgttagaaaaacaaaaaacaaaaaggtgaagggaagttatctttattctaatataaatttggtataagattataagtcattcacattcagtatccacgagtcaaatcttgattcattttggttttgaaattaaattaaattccacaagttgcattgccagcgacgaaatcacatatatcagaagcattaatctagcataataatcatgcacaaaaaagtcaatgtgggtgtacggattcctatttgagagattaattttgaagtatcacccaattgaggcatgtggcagctctatctctatttgacaactatttttctcctaactcttgtctcgcgttgtccatgcaacatttcaaattattgtgacaccctcgtcctttactccaacactcatcagatgatacccttgaatagatagcctttgtcctaaaatgtcagcaaatactataagattatattaatttcatctaactgattaattgtctctaactaataagctagtatgcacagatgcgagaacctgttagatgcatgggttgctttgttttttctttttggtacacctttgctcttatttgcatattctgttgtaaggtggtgttcttaacttgactgggcactacttgtgttaaagtaagtgttattataaatgtgcggtctttttaaatcatataaatgttcaggctttgggttatataatcacaaaatttaaatatttgaattggtcagtcattgagtggcacattgtaaaattacagtttcaacaccaaaaagtaataagtttttttaaaaaaatatgtaaaattacaataataataatatggtttaaatactttttaaatttttgtaattaaacattttttgttctactaacttgataaaaatggttttagtcattttaaattatgtttgttttttgtcatttaggtgatttaaataatatttttcattatttaaagcattatttaaattgttttaaggacgaaacataaaaaaaatatgaaattaaaataaattacaaagacaaaaaaataaaaatgctaaattataaggcgatctatcatgggatttttttttcctaaaatcaataaaaattcaataatttgtacaaatattttaaaaataacattgcaggttagacaagaatataatcaatttatattatttatatagtttattgtatacaatatttattaatttttataaatgggttacaatgtaaaaataattaattatttttacaaaatagacatctcatacatcttaaggtctcgccaactagtagatgtacattttacgccccataataaaaattaaagataaaaatctacatcaaaatgaaatatattataatcttaattatttagacacttccaaacttttatctcaagcaccgccattgttgaaatgtctaacaatcaagacttgaacccaatcctgaattcatgtgaacaacaaattcattagatttaacacactttttttttttaattttcatttaaccataataatgttttttatgtccttgcctattctttttagttttcagggatgtttcttgagccttttattttttctgtgaaaaatgatcatttaatcctttctcacttttcacagtaatttgacatagcgtgcaaccccactcttgctagaatttcttctgtaaactaattgaacaaatgctcatagttatcaacgacacgaagtgtcactattttgcgctttgcatcaacattcacagcgataaagttgtgtttttgtgacttgttgatcatgagttcaaatctgaaaataactttttttgcatatgcaaagataagactgtatacaatatctttctcccttacctatgcatagtgtgaagcctccggacattgggatacgtaattatacactaactagtgtgatcatttgatccctttaagtctgtgcattatattgttgaccacttatatattggaacaccaaatgtgttagagttcttaccccaacaatcttgattcaaagacatcaaaattcattttggggccaagattgcctcttgtctttgcattgagatgcctaacgccttcttcgacctcgttttcctcataattttctcttataactctttttgtcagactaatgtcatctcgtcaacgaatatcattctccagctatcatcatatttgttcattcttcaactctcgttgaaatgcttcatcgacattaatcaacattgacattggaaaaacactaggtgttgaaacattgacaggaaaatcacttggtgcgaacgcacaacctataaataaactagtgttaccaaactttttttttttaaataacaacacatgaacacaaatgggtcacttgagaggaacgtgaagaaaaacaagtgttaccttataataagcatctagaaatgtaggcaattgtggaaaaagggtgtgatattggagatggagttctttggttttggaaatcatgatatatgaactccatgacaaaaagttggaacatgaaaaaaaataaaaggagaaaagggaaaaaaattgtatcaaggaaattagagacaatgtatatgtgagcgtgtgctgtgtagagtttggaagtatgattaaataagtgcaagaggtgagtatttgtaatgcgattaattctactttttttgctcatgtgagcgatgatcaaatattgagaatttatcaaatttgtcgttcaacgcttgaaaaggaaaggaaagggaaaatgaaatttgactcagaattctctcatttttttaacaaagattaattatttgacttagaaaacttaaaaagtagtttaacttagaaaagaagcattaagtacaaataaatatttgataagttaaggttaaattgttatttttgttttctataatttgcattcgtgaattaagtctctaaatacatttaattatcttatttagaccgttaactcaacgcttatgtgacaaaggattaaataaagtaaaaaataaaagtagaaattgaacacataatcttttatataaaaaccaaaaaaataaattattaagacacttactttgtttagtcagttatataaatattcttttacatatataattagtcaagaactattaattttttaaaatcataaaaattgtatattaaaataaagtatttaacatttaattttatgtatttatttttctcacaagattttattttaatataaattaataaattattatatataaaaaattattcttgtttaattataatattttttaaaattacataattaatatatatatcattttaaaaattattttatataatttatacaaattacataaatttaaaataatattcaaataatctaaaaaaattaaaaatttattaatttttataattaagatatttgtattaattatatataaaaataaatttgcataatttaaataaaagatttacatattaaaataaatttagttaacttatataatttaaatattaactgatgcaattatattgatttatataactatattaaaaataatttttacataaaaatatatttacaaaatattttttgaaaataacatatatattaatttgtgaaattgataaaataaaaataaaattgtattaaataaacttaaaaatatttatatattaatttttcttaatttataaatttttatagttctaaaaaataataattttttaattactatgatatttgtgtgaagtatctactaattttattaatggcaaatctcgattgagaaacctaactgatcacctttattgaagtctcctttctcaactatatttttttcatccacaaaacttaaactcgagaagttgtctaaaagaaatgagccaatgacttgttggaaaaaaaaaataactctttagtagtaactcatataaaatatttataaaattaactaaataaaatatttatctcagtaatttattatcttttatgaaaacacataaaattaagttactttgatttataaataaagaaatcaaaatcataaaattaaaattataaaaaactaaacttataatttcatagccgaatattttccatttaagtttttactttttactcaatcaacttttgttcagtggttgattaactcatgttataaatgaatggctgaaatgaaataattttagttcaggtgaacaatattacggctaataatgtgaaagcgtcgcaatgttcgggtttaatggagtaagcttcaaaataactaaatttactattacaattacaatttttacaatattgtatccttttatatatttttaatttcaatattataaaaaaatattaaaaaatgtttaatatttttatttaataaagaatactaagagataatttaaaaaatttaattgttcaagtcctttgtatttgaagttttttattggggtgatcgctcattatttgaatgtttagataataaatccaactaatttggtatttggtgataacttcttaatgtttattatttatctatattctgttagtttaagagagagaaaaaagtaaagggaagatatgaaatttcattaaaaaatataatgggaaaaatatctaattctttatttttttaaaataaaaaataaagtttaatgattaactatagataatataaaataattttgtattattttaataataaatttataaaatcattattaatataatttgtaaaacaattattataaaaattaagaaatttatcccacgttataattttttattagatgatagtctttttttctaatttttttacacttgttagtgcctagtcttttaatctatgcaattaaattttaggaaacaaatgccaagtcagatctgagctgtgaacgagttgtaatcttatcatccacgtcactggcatgcatattgttctgagtgatgtcatactactcgtttttgtaaacatgaaccattcctgtattttcattgctcaattattttagaatttagtcatgtattcacaatataaaatataaaatagtttttatattattaattagaaattattattcatgacttttaaaaataatattataaaattagtaaatttattatatataatttgtgattaaataatataaactaaaatctactactttacaatgtaaattcataatccatttattcttatttttatttgtttaatgaatctaacatgttgcataaaaaaaatcaatgtaggatgcaaagacattgaatgaattgaagtgaaatgcatgcacagcagagcctcaagtcaaattgcactataaaatatcagagaaactgacgccactccatagggttcacgtgtgccttcgttgtagatcattcatcgcctttcacccgattaccggatttttttgtctgatcaaaaacgatttttcttgaaataggcgtcacgtggaccccatcttctatatgccacgtaggtcatttcaccactcacgacgcatagatttttcttccactgattgtgatatgctgcttcgcccttgcgtcactccacctacacctcaatggccttatcatatccactctgcgaatcaacgactctcaaatctcaagtatcattattgtggcccccccacacaatttcctgtgctttcacgtgtgctgataaagtttattttcttttccttttcggagaataattaccgtaagtttatttattgtttatgtttacttatttattttagtttattcattaaaaaaagatagcactgtattatttatacataaagaagtacgattttaaaaacaaaatatctatgcctcttaatcaataattggagagataatttatgtcaattactatattttacgaattgtataatagtgcaatttgcaatacgaatctataataaataagagacgagtaatgtaataacaaaagattaatcggtgcactatttaaataatgaaaaaagattgtcattgaaacttgaaagatgtgttattgcaatgtccttaagtttttgaatgtctcgagtgatcgcttacctttctgattagccgatcttttaagttttaaccacaaaagacaaaaataaataaatacaaagtatgttgtaaataaatgataaatataagatatgtccacatgaatatttgtagcagcaaattttcttaaaagagagagaatttagtctgggagtggctagattgattgcatggtgttgataattcataaattatggatcaataatggcaatagttcctaacaaattgggcaccctgctgacacagctttacgtgatattatcattatcctgttgctataaatacccttccctctccttcccatgctgcattgactcatttggatttgatttggaacaaacaacagtagagcggttgcagtgctctgtgtgctgcaatttccttttgagcttgtgtttgattcatcaaatcatcaaagatgactgtaggggcaggaatatctgttgcagatgggaacttgatggtgttggggaacaaagtgctgagccatgtccatgacaaggttcttgtttcccctgcatgtggtggtgctttgctcaatggggcattcatcggggttcaatcccatcacaagggtagccgcacagtcttcccaattggcaagcttcagtatgtactcttcacttttctcttttcaattcttttcttcttcttcttgttggtgaaaaataaaatctttgtaattttgggtgaatgctgtattttttgttgttgcttgtcacaatcaggaagtgcatgtgcatgtactggattgcttttgatgtttcttatagtgtgtgttggtgcatagttaataatatttattttaggatactgcaattctgatcctaggatgatgttttttttttttttttcagggggttgcgatttatgtgtgttttccggttcaagatgtggtggatgacgcagagaatgggcacttgcggacaagaaatccccattgagacgcagttcttgcttgttgaagcacacagtggctctgatattgaaggaggaggagaccaaggtgctgctacctatgcagttttcttaccccttctggaaggagatttcagagcagttcttcaggggaatgatcaagacgagattgaaatctgtgtggaaagtggtatgtgatcttcagaagaagaaaaaattcattagtttattcgcatatttgtggggatttttttgctgttgtgcaaagtgatgaaatttgtatctgatttcaggttgtcctgctgtggaggaatttgatgggactcatttggtttatattggggttggatccgacccttttgaagtcataacaaattctgtcaagtgagttaccacctttcaataaatttcatctatgtttttccctaatttttagtttataccagtcatcgaaatctataagtaaggctttcgggttgggatcattgacttttagttattacaaaaattgagtttaatcttctgaagtaatatttttgttttaacataactgcacgtttggatgtgcagtgttttatatgtctaaacaagtcaagttattgattttattttaattttttgcaattttttttaggaatgttgagaaacacttacagacctttgcacatcgcgagcgaaagaaggtacatagcttctccctccctaaaatggaaattccatagacagtcttatttctgagcactgcatcttaaagttcactacctctaattttactttcccccccacttatattcagatgccagatatgttgaactggtttggatggtgtacatgggatgctttctacactaatgtcacttcagagaatgtgaagcaaggattgcagaggtggtacttccttccatggacaatggacatagttatgagatataccgcatcacataaatttgtgactgttacatttttatttttatttttgcagctttgagaaaggtggaattcctgctaagtttgttataattgatgatggatggcaatctgttgggatggaccccaatggtgttgaatggaaatctgatagttcagccaagtgggtacttcctttctaagtttcattatcaaattgtaattccatccattttacattgttgaatcagttcatttttgtgctttcttgtccaatagctttgcaaatcgcttaacaaacatcaaagagaatcacaaattccagaaagatggcaaggaaggtcagcgagtagaggacccggctttgggacttcgtcatatgaccaatgaaatcaaactagagcataatataaagtattgccattttcattttattgtttctatttctccataagatattcagttcacacatagtactcatgatcatctttggaaaatctttcccaggcatgtatatgtgtggcatgcaataacaggatattggggaggtgttaaacccggggttccgggcatggagcactacgaatcaaagatggccttccctatctcatctcctggagttgagtcaaatcaaccagatgaagctttgacaacaattgccatcaatgggctcggccttgtgaatcctgagaaagtttttcatttttacgatgaactccactcatatttggcatctgctggtattgatggtgtcaaagttgatgttcagaatatccttgaaactcttggagcaggacatggtgggagggtgaaacttgcaaggaaataccaccaggcattggaggcatcaatcgctaggaacttccctgacaatggaatcatttgttgcatgagtcacaacacagatggattatacaggtatggattgcttataaaacttcagtgaatgcttttattaacacaataacaatagattttttttattcatgatgatgattttctttataaatttacttgtgtagcgcaaagcgttcagctgttattagggcatcagatgatttctggccaagagaccctgcatcccacacgattcacattgcatcagtggcttacaatactattttccttggtgaatttatgcagccagactgggatatgtttcaggtaagttaccaaatacaggatccttccttcttttttcatgaaaaaaaatatgaacttgcttctgcaggagctaattaacttcttgtgcaatatgcagagcctacatccaatggctgaatatcatggtgcagcacgagctgtagggggatgtccaatttatgtcaggtgagtagagcttgtagtaattttttttttcagtactttttttatttgataaatgatgtcttacctttggatgttgttctattgtgcagtgacaagcccggacaccatgactttggtcttttgaagaagcttgcactacctgatggttctatattaagggctaaacttccaggacgaccaacaaaggattgcttatttactgatcctgccagagatggaaagaggtaaagaatccaaaatgatttggctacctatatagttatatacttgaccaattgatgtagtatcttactctttacactctactacaaaataaagtatgcatgcttctttatatttgtattttacttaactccttgtatgctgcttttgcagtcttctgaagatttggaacatgaatgatttttctggagttgttgcggtattcaattgccaaggagctgggtggtgcaaagttggcaagaagaaccttatccacgatgagaatccaggcattgtcacaggtgtcattagggctaaagatgttgactatttatccagggtagcagatgataaatggacaggagatgccattatttattcccatcttggtggtatgtttttcggcttcacaatgacacttgtaaagattacaaaatttaacccaaattttcttttgtgtaatggtctttttatgatgtcaatttgcaggagaagtggtttaccttccaaaggatgcatccatcccagttaccttgaaaaccagagaatatgaagttttcacaatagttcccgtgaaggaattgagcaatggtgtcaaatttgctcctattggtttaataaatatgttcaattcaggaggggctgtccaagagtttagttggggatctaatgaaagtacaaatatagccatgaaagtccgtggttgtggccaatttggtgcttattcatcagctcagcctaagttgataatagttgattcagaagaagtagaattcaagtatgaggaagaatctggattggtgactattgatttgagagtacctgagaaagagttataccaatggagcatttctattgatttttgaatcagagactttgtctctagatgaaggggtttagagttatagacttgatagtgtatccatagttcgcaacaatatgatgagtgtatgtagaccaatagcaggaaatgttaggttccctgtaaggaataaccagaagcaatgaatgaatatcacgaagttctctacctattttttgtgatatacttgagcagaatgtaaatgcagcctttgcatcgtttgccatacagtatgaattggcccatacagtatgaattggttgctctttagtttcattttgcctcatttctaagaagttcattgtagtttcgttaagctagaaaagaaatatacggatagaaatgcattatgattagcccgcgtatcctttaaatggagaattaattgatttgataaattcaaagattacatgtcttcaatttttttatgctccactgcaaatattactcaaggcgtttctgcaagtatggaactcctatgctgatatgctctcattgaaagcagttactgagaaatctacattgacagcaggtccttgttgggttggtctagaactctgaatgaatcctctcaatttaacaagtacttctgaacaaacctaaggactctgcagcaggagacaaatgttaaacaaagcaccaaatatttcctctatgtaagcctgatttatatgcaagcaagtattgatactaaagattcaatgatagcacacccttggaattccagcttcacataatggtggcatgagtctagggtaaaagtatataaattaaagaatcaaaattactaataaaataggccttaactatgcttagcaaaccagtttatctccaaactaaattcattataagtagaacaatccttgcacctttttttttttttttttttttccttctgatatagcttgatagactgcagaaaaagatgaaagagctttttgtctccattcttgcacctgtgaaagaaaacagaagtccagtaccaagattaagagagcaaatgcaaggcaaaggcatgtttttggccttttgagcaccaccaaatagaccaccaaatgagttcatttttttcttttgtgatatgagatccctactacacaatgccaaagtgattcactagaattatgctaattacaccattaaaaatgtaactcgcagtccaaaattcaagtgcagagcttctgactttcaagcctaaaatgaccctcaaaatgacagaattgaccttagcttatctctgacaaaattgtagatctttttcttatctttacagggacaactcatatgtgtcatttgaagttctatagagctctctaggtcctgcacaaaaaagatagattaagtgagcataaaatccgaaaataaacaataattagcaattaaatcctcttgtttgtctaagacaaaaactgaattagaatgagaaaataaaaatctaagagaagtcaaataaactaagaagaatagaaaaatattaaattaaaaatgctcaatcaatccctactacacaatgccaaagtgattcactagaaatgtcatcaatcacattttaaacattttgaagtgcactaatgccgagcttactagcaatagcctaggcgtttccttgttgttgggctttttgctaatcctttacaccaaaaaaaattgatgcaaattctccaaaatctaatccaaaaaattcattaataagctccttcagaatataaattggataattttttaagaagtctgcgataaactcagataaatttatggtactaaattgaaatcggtgctgctattatgatatcaagtgctgaaaatcaaataccaatcaagcgcttcctgaccaaagttctaaaaccaagaacactgtaatattttttaagaaaaaagtaaaaagaaggcaacagcccagcccacaggccacagccaggttgtgttttatttatataattatgggtaaatagttaaattggttttgaacaaattagttcttcaaaaataaaaaatataaatttagtctttgaatatgtaaaaagtgtgacaaactaatctcgtatttaattacttaaatttataagatcattttatcgttaagttctaatgtttaagaatttgacaatattatatttgtcgatgatcaatttgacaatattatattttttgacaaccaatttaagttgtaaagtttaaagatcaatttgtcaatctgcataataaatttatctttcaaatattaatttctgagcatcttaccaagttgtgtcttcaaggatgaatttgccgattaatttttaattattgtttgagaaattatatttaaataaatttgtacaacaatgaaagaaaaaggtgtaaaaattatatgaataatatttgaggatagaaggctataacattggagtttcaatacaatggttaggcctacaaaacgccacgtcggtggtgggaataagcgtttaagtagtttgagtttgggtttggcaaaacaaaaccttggttaaaccctgaactgaaagttgcattgcaatttgcaggagagaaacagagatgtttggtaggggaacggtgtggtcagtgttgaagcgcggcaaagaagcatgcggaattcacaagctaagccttagaggaacgcctttctcttcttcttcaacccaaccaccacctttcaagttcttaacccctcccgtcgccacccattacattcatgctttccgatcccaactaatccccaaggttacctcactttctcatctgggtactcttcaattttcaatttttatcccttttaaacttgtatgatcttatgggtcatcatctgttcctttactttttatattcacaatcactcctaattctttaatctctatctcattctcagaaatacccactattcttcctttttaattcctccatgatgatgctattatgtgtgaatgattagttactagttactactacatctagttagttctgaggaaattgtgttgggatgatgctttttatttagggtcatcatgttcatgtgccacaaatgaggaacttttctaagatggtgtctgctgaacaaaaagaaggattgaagctgctagtgagtgggggttcgcgtgctcagaaattggttggagtatggctctttgggtcagcggcatgggtgttcagcatggtggtgcttgggggtttaaccagactcactcgatctggtctttcaatgaccgattggaaattcaccggcactctccctcctttctcagatgacgaatggttgcaagagtttgataaatataagcagtcacctgagtacaagcggtaaactgaaaacacttgctacacctttttaatttcccattaacttaggaaatgcaccaagggactttttatttttatttttctgcgagaaaagatactcattccttaacatatgtaaataagtcttcttgaagttggctgactaattgttaatgattgaaatcaaatcataataagcagatgattaaaaatttaggaataatgttttaaataactgttctcaaactttgtcataaaattaacacggttaaataatagtttaaacttttttgctgcaagaaaaattgacatgattgtgtgtttcagagtatggggatgataattaatatgacagtgatggagaataattgaatgaataggtcaatttttagtgctgattgtgtatttattgcaagaaaaacaagggaagggattagttaagtggaagtgagttgacacttggtctcaaagagcttagtagttcttatgaatgtcatgatgataattagttttgcgcttgtggcagtgttaacagaggcatgaagattgaagaattcaaattcatctattggatggaatatgcacatcgtatgtggggaagggcactaggagttatgtttgctttgccatattcatattttcttcataagcggtatattacgttgagattaggactgagactctctgttctgtttgccctgggtgctggacagggtctcattggttggtggatggtcaaaagtggtttagaggttggaacataaataatataaattcctctctttatttgaagttaaattgaccggccctgtcagattctaataacattttatttctttaggagccaccatctgaatattctcagccaagggtaagcccttatcgtcttgcagctcatcttacatcagcatttgctatttactgtggcctcttctggactgcactttctgttgttatgcctgaaccaccagctgaatcgctaacatgggttcgtggggcagctaaagtgaggagacttgcattgcctatcagcgtacttgttggtcttactgctgtctcaggtgcatttgttgctggaaatgatgctgtatgttctcttattcaatagtttcttgcctttcacatttatacttgaaatgataattgagcctttggtgaggataaagataatcattctgctcacatgttaattcccaggggcatgcttttaatactttcccaaagatgggtgatacatggataccggaagacatttttgaaatgaagcctctgattcgaaatttctttgagaatacatcaactgtacaggtaatccatgctgatatctctgaaaagcttaaatagtaataatatctttgttttcttgattttttttttggatggatttttattatcttttcaagaattgagaaatttgaactgaatgaaatgttttgaaacactttgtgagccattattgttggattggttagtagtaaatttatcctcaaaagtgtggtttggcggccaaagttttaacaacatgaagttctaattggtgtttcgcattgctcttaacagcttgatcaccgtatacttgcaactgcaactctgatttctgtggccattttatggtggtcaacaagaaagctggagatacatcctgcagtacgatctgtgattggaggtgctgttggcatggcagctcttcaggtcttaatttcaatttccagttttatatactttataataattatcattttgtattgttgtttctagctagctctctgcctgtcgatatattgccttctttgtcgaactgaatactcagacctgttattccacgtgtttttgtctgattctttaactaaatgaagatgatgatgataaatagataaaatagaaataggaagaaagactttatggtgtttgtttttgttagtagtctagtatatgatttcccagaggctgttgtcatccagtatataatgtaattaattttgcatggtttcaggtcaccttaggaatttcaacgcttctttcatatgtacctgtttcactgggcactgcacatcaggctggagccttgacacttctgacatttatgttacttcttaatcacacagttcgaagaccctctttgccccttctcaaatctctgcctcaagttgtcaaagcacactaatggtttcccggtattatattgcatcaaggattaggctttttaagttgataaaatctgtgactactattttttccatgctaaattgtgttgagctccttgtccaattttccactgttggaatcttctgtatttgttttgtacatttgaagcatgaaaattcatgatgatgcaaccgatctgttgattatgtaattaacagatacataatattaaaaagtataacctgtgattggaggaagagaataaaatttttgtaatttaactgatccgttaaattattgtctgtctagaaaccttaaaccaaagaataatatgatatccaaggtttttccagggtggaggctacctcaaatgaatattttgaaaatgaagcgctaaacacttgagttggtttattcagaattataactaaccaaattcaagctcgcaacatagttcaataccacaatatctttacaccattatcactatatagaaatcttaaaaaagcattggaagcaattttttttttttttttatcacaaatccaacatcttattcagcacaactttatgctactgggagtctaaattggccttaaaataccataccataaagcaacattaaaatcacaaagaacatttaagtactttcgtctaagcctttaacagttttactattatatattattatatagcataatatacatacatttttctttcaatgttgtttttaatgaaattgtgttatcaattaataaaattactagcatagttgagtttaggaaaagagactatctctactgctcatatattcagtatttgagagtatctcaaacaagattaatgtgaagaaggatacatgtggcgaacaaaaaagagttaataaaatttatttacatatattgcttttaaatcttaatttaaattttaatcacagataaattgatttcatgtaatttatatacttttaaagaaaaataagttggttatacttttatatttatagttaagtcaatcatctattacatgtaaataaggacacagttatttaatttttaaaatataaatagtttttttaatacatcagtaataatctagaactaaatttaatattttattttattttgcgagtattagtgagttatatcgtggaataaaagggcactacgacgtaggtggtttatgatttttcgcgtaaaaaggctgtttccactttctataacagatcaacgctaaattcatattatcttattacgtggttgtatgaaaaaaggttcaagctatcgaaagaaaaaaaatgaaaaaagattcatgaatactagaaaggtcagaaacatgggttaggtgtctcgtggatcttcgaatgaagtttatttgagaggcttgcttgcgtctatatataaatatgttatgccttcgaaaaatgcttactcatacacccttttaattattttcattataattcttgggccctgagtgtgtgatttttgagaagcaaatcgatcaagcttgaagggatacaaaaatgagtgaggaagaaacagatgattctccattgattcaagcttttccttcccttgacgtgccatttaggagaacgtactggtaagtggttattacatctgtttttaatcatttataatatgaaagctttatttatttctcccatcagaatgcttttgtatatgtaaaaggaattacttttcttcttcctccttggaatttctgccattaattttctctgcagccagatggtattgaatttgaatagcagtagtgagatatttgttggactgactggtgtgtgaatggcagttggtagcacctttgtcttttctaatgagtgtggtgtttgttgagaaatttaagtaacaagtattatttaaaaaatgtataactaattaaaaatatttaataaaactgataaaaaaaaacttctcaaacttttaatgaaggagtttatatcaatattcttaattaccatgttacatttttttaatcataaattttatgtccaagtgatgaaagttaaagatgaatatagtaattgacattaattttatatatatatatatatatatatatatatatatcatgcttaccattcaaatattcaaaagaaagaaaggtaattaaaattctaactatatattattctttatacatgtgacatgaattaggtaatgtagagagggcagtggtacatataataagtggtgtgataggggcaggggtgctgtctctagcatggtctgtggcacagttagggttctttgcaggaacaacctttctttcagcaaaccttctttctgactgctacagattccctcatcctcaatatggcaacattaggtgcccctcctacatcgatgctgttaaggtctacctaggttagtgatcaaacactattatatatgccatgcttatttccacttttatgattaataggaaatattatgatatgataaattaggagacacgaggcaaaaggtgtgtggagtgctggtgcatgcgggcttatatggtgcatcactgcatcaggtaaccccatgcatgtgtttttaatttggcatagctttattttctgttctacttatatctaatggtgagttaggatgagtgtaatatacatatttgggtttggatacctttgatttctcttgaattaccataaaacaccagagtttatcaacttcatatagctaaaataatgtcaaagtttgacaaaatgcctgcaacattaaaaaataaaatttattatgtgatataaactttagagtttagatgcatatagtagacatttatttagtcattttttatttgtatttatttatttataaatgaagattaatatagataaggaaattatgggggaaatataacctggtgcattaatttggtagagtttctttttcaaatagaaaagttgagaaataatagaaaaaatgtatctgttaatcaaatcaacgttgaaacgtgaaaataagaaatggtaagcatttataaaattgatttaatttgaataaaaatgattttaaaattggttttgattgtaattgattgtgaagtaaagttatttctttatgtttaaaaatctttactctaaaagcaaattagtactaaaattcagtatttttctttatctaacgcaaaactatctaaattgttttaactcagtaaattataaacttataatcaattcttcaacaccggactgaacattagaaaatttgcctataatcacgttaactaatatttaaagtgattttacattactcaacattaaacagagcacacacttggtaaatcctcttgtgcttgttttcctttttcttttattttttcagtcaaaatattttttgggtgaattcttatatttgtttttcgaaaatcttcggacatggctctaactgtacgtttgcttttgctaagttaccgttaacgggctgggctagccataatacttgctcggcctagcccaatttgcaagtttacatgcagactgttgttcggaatttgaatcatgcacttccattagtgtatcttacatcctcctatttttgtttgaaaatatcaaattacccttctccaaccctaacacttccctctttgtgtgaattactcccgtgatgacaacttcttctcccacaatttcaccttcttcacggcagctttgtgatctcctcctcacaagtcacaatgtcgcacaacgtccttcccctccctccttccaatgcacatcatcattaaaggtaagaatgtaatccgaaacatggtgttttgtcttctggaacgaccattttaaaatattttttattttcaactattattccaaagacacaatttcgaaagttatataatagtcggaatgataattctgaaacacagattgagttctagaatagggttttcaaaatacataaaatattttttattttcaaccattatttttgactattatgtaacattattttttattgttatgaaacatctattttaaaaattattttttacgattatgaaatacctattctagaagccataactattttttattgttataaaatacctattctaaaaaggtttaatatgaaaagggtagtttgtgatttttaaaaatttgggagatacatgattcaagatgggaggtagaaaattcaaatctcttgttattctcttataactaaactgggccttattgtagtaagtaataaccactgacaacaccagaaccaaaagattaaaaaaaaaaaaaaacttaattcattctataatctttttttgtacaattgaacgcaacacgcatactaggggttgaatttggggagtgtttgatttctaatttctaaaatatatttttggttttcaaaaaataatttaaaaaaagttggtagagtagaggatagtggaagtctggaagacacaatgagtaaatgaggaaaaattaaacaagataaaaatcgaagattagaattaattatatttttgatcaatcaaatttcaattatgcaaattgaatcttacgaagtaccgtatttattttttatccacaaggtccgcatcccaaattttacttaaagaaaccgagtctaaaattacttggaccaataacttttggtaactaaaagttttattaagtattttaaaacatttttaaaatgtaatagattttaaatgaaaatttaatatatgaataatgtgaaattgttttgaaaaaaactttttaactgtgaacttgttttgcaaaacatttttaaaatcaaaaagtgaaaacatacatgcccttaatatgacatccttgcattttcccaccagatggcacttctactactaaatcaacagagtatcagaaccaaattgcaacttttgaaactaggggcttcaacagacgttatttttttgaaggagagtatatatgttattttgaacagacgttattcctattgagttaaaagacacaggtccaacctgctacataggctacagtttatgagaaattctggttcagcgaggtagacattttggcataaaatacgtatatactttcctttatttgatgattaataggtggtccatctgagtctgagaggcaaccgcaaaatatatttacctagagatttccaagcatttaacctaaccagttattttaacaggaattcatatctactttcctttagcacattgctaatccagtggtggggtgcaataagtgctggtggaagtgcagcatttattggcaattggtgaagggcataatttattagctgggtaaaaatgtatgacattggttttttgctgtggcaattttggctggacttcatttatgttctgtgtgcgggcgtcaataaggtgtaacctttgtgggtgctgcacaaaaaagactatatactttatctttgcatatgggaagttcacaaagtcccataaaattagcacaatccttgcttacgataaggatgagccaaatgatattccaatcaattaaagtagcaaaagacattactcaactgaataaagatggtgcttttacgcaaaatgattctacatatttttcaatggaatcacaaatttgctcttcgttccttgagcttgaagtgaaagaagctaaacggtagtgggccttagcccttaggtgtgataaggaagggttgaaccatgttgccagtatacattcattttacgcaacctattctagtcctacatattcttcatgaaatccaatattttccatacgctccttggatagaaagaagctacacgtaatgggctataggtatgataagcaagtgttgaaaataggagcataaaacactctggtcttccacgtttggcgtgctttcaacttcaaggacaaaaccaatataatttcaaatattcattcacttagtttgttgaagactgtcaaataatagagtccttctcgtacgggaggcatagtgaaaaaagcgaaaattgacaaactcttatctctctctttttgaggggggtgggtgtgagaaattattaggtggataaaaactattatcatttcattaattaatctccacgtgacatgtatgtaaaaaaatattattaattatttttcataaattgaaaattttgaatacgtgacgcttaaaaattagaggagactatgaatatgtggtggtcttaaataatctaataatatgtagtagggtggggtatgaagtattgtgatgtatataaagtttgtacacaaactaccagaaagagatgatgttggagtatttggtgtgttgactaaggtgagcaatacccaacatgatgttaaacataatatgtaagttttctaaattatctattttgtacattttcaaatattctgaatcttcctacattaaccccactatttcactcacgtacctctggtcatctgatagatactgattactgaatcattttcacaatgttgagcattgagagaatatattccacaagaacacgacagctccattattagaaagttatgatgacgagtacatatctttattaaaaggttaccacagtcatacaccatacagcttcaaacttcaaagaatctctttcctcttcacatcatgttctggcctgtattttttataatgaaatctagtacaataaagttttcctgattttatgctgtgtcctgtcgctagtaatgtctgttttagtacataccttagttatcaagaacatggcttccaaaagttttaagatactagctattttaattttggtttggcacagacacacatgtttatcagcatagtttagatttatttacactatttcctgcaacttcttctatgctgctcgtcaattacttaattttaggagagttgtcctagacatcaaagaagagtcctttatcaattttgaaaattcatataaaatgtcatctccttttttaatttcataagcatgtgacatgcagaccaaaattatgtagttaccaaacaaacataattttgaattcaagtagctgccatatagttcctttgattgtagttggctgtagactgtatacggaattcaattacactgaactccatgaataccaattgagttggatgcttggataaaaatggctgttcaaaaatctctccaaataactagaagtggtagtggtggttatgacgatgatggacgtgctaaaaggaccggtaaaaatctctaggaccattccatattcatatatatgaatttgactcctgaattttagtccttccatcaattttaccaggaactttatggagtgctgtggctcatatcatcacagccattattggtgctggtgttctgtctttagcttggagtacttcccaattgggatggattgcaggaccagtttgcttgcttttttgtgcaattgtcacctatgtttcttcattcctcctttccgattgttacagaactctggatcctgtaactgggaaaagaaactactcttacatggatgctgttagagtctatcttggtagttccttgttcttgtacaagcactctagtctcaaattcaggatatggttccagtgaaatgctaccatattttatgccaactaattatgttttctgttagtttaggcaataaaaggacatggttggctggttcccttcaatatttgagcttgtatggggttagtactgcttatgtaattaccacagcaacctgtttgaggtacaattcccgttaaatcccatgtaaaattaaaagatcattgtatatatgcaattttgaatttgtgtagtagtttgttacttgtatcatctgttgcttttttttttatctcatgtaatattagaggtactagtctaccttaatgatatttgtgttcatgttctaacgatgcttggtctttctacaaaatgcagagcgatattgaaatcaaattgttatcacaaggaagggcatcaggctccttgcaaatatggggatgcagtatatatgatgctgtttggactagttcaggtcataatgtcattcataccagatctccacaacatggcatgggtttcaattgttgcggctataatgtcctttacatactcatctattgggcttggacttggaatcacaacagtcataggtaaggttcattttcacaattagaatttaatgttttgtttacttgtccgttcaagccttctgatcattgaagaaacaagatgaaggaaaaaaaaacaagtactattattctaaaacacaaatgtagctgctaaaaacatattaaatgccaaaatatatggaatgtggaatttatgtatgaagaaaaaaactatattatgatattttcttagaatcaaggagtggaaagagaacaatggatcatgagacttttggttgcttttgcagaaaatggaagaattatgggtagtttaacaggagtaccggcttcaaatattgctgacaagttatggttagtcttccaagcaattggtgatattgcctttgcctatccatacacagtcatcctccttgagatacaggtacccttcatattccaattgggtgggagaggaacgtgtaaaggagaatttaatttaaatgcactcacaagtaaactgtaaagatattttatattgtgattcaataacaaattgttatttatagtaagtttgtttacgttataatagctattttaaaaattgtatttaacatgattttttatcagttgacggtgcatttttttttttcattatcagtttatagaaattaaactctaaaagaagacacaatttacagctgaagctaagtattgatttttttttttttttttttttttaactgaaggacactctagagtctcctccaccagaaaacaagaccatgaaaaaggcctccatgattgctatcctcattacaacattcttctacctctgttgcggatgctttggatatgcagcttttggaaatcaaacaccagggaacctcttgacagggtttggattttacgagccttactggctcattgactttgcgaatgcttgcattgttcttcacttggttggaggatatcaggtactagtgctactgatcaaagttcacattttatacttaagactgtaacttcttattaatcaattgaactactacattctttcttaatgtaaaattaatagaaatgatggtattcataccgaaagcacaattgtaacaggtaaagttaccataaggaagaaattaaaacaactaatacaagagaagttctaaattaatacattattaggaaaggtttggctggaaatagttagcttcctaacttagcttatgaaatgctccaatgacatttattagaaaaaataaaataataaatattaagctatatgaattcttgtccatatgcaacaatatctgaattcttttcatgttaccagacaaatcatagttgtgattcttgtttatgatcttttgatcagatttacagtcagccgatatatggtgctgttgacagatggtgttcaaaaagataccccaacagtggatttgtgaataatttctaccaattgaaactgcctcggttgccagcttttcagctaaacattttcaggatatgttttagaacagcctatgtggtttccacgactggacttgctatcctatttccttacttcaatcaagttataggagtgttaggagccttaggcttttggccattggctatatatttcccggtagagatgtactttgtgcagaggaaaattgaagcttggtctagaaaatggattgtccttaggaccttcagctttatttgctttctggtgtcattagtgggtctcattggatcacttgaaggaataataagtgagaaactaagataatgaagggtgcttcatttgtttgagtttattgtcttgttgccatatcttccatgtaattcagtttcacattaattctattactatttactattgagagttaataaaggggataccaattatgtggggatgtctcaaagtggtggtggtgtggacgtggaatagttctgtttggtgaaaaactccctttaaagaaagtgtatgctacacaaacaactctatacacataaacttgaattgatactggattattagatttagctcaaaatttgtgcaatgtcacataactttgttttacattgacataatataaagtcatcccaaataactagtgtcctaatgtattggttaagaaatgaataaatattttttttattaaaaaaacatgttgaaaggcatcaaaaatcactatagaaatccattaataagggtatacagaaagatgaatgtcaaaatgtcagatgcaaatgcacagtttaggaatgaaaggccctcgttatcttaatcattcatatattactttatcattaagattaacaaaagagtgcccacacgagcgtactataaccaaaaagagaaaagaaagaaagaaccaatggaagcttttcaaaataaagaaaaaacacaaccctcggcaatagatagttctgaaacaatctacactcttcacgaattatacacgagcgtactataaccaaaaagagaaaagaaagaaagaaccaatggaagcttttcaaaataaagaaaaaacacaaccctcggcaatagagagttctaaaacaatctacattcttcacgaattattggtcggtataaaatcaattggccatctttactaaatgctttatatccaaaacaaaagttcagttgtagtatcattagaattcattaagtagtactaaagctgagcatgactatgatttaaccaggaagccaagagtttcaaaatcacaaaatcaaattataaaataacttgttcaagccacgaggaaatcaatatcgagctagtagagatagtaaattgacaacttgagtgaaaatatcttccatgacagcatagttagtttaaggaaaaacttaaacatagctagaaacatcagtatatgggcaagtttaatgctgctgcgatcctgatgttgaggttccagattcagctggggcatgtgcagcctgtccagaccctgtctgtgaagaccctggctgcatagaatgctgataagcatgatttgcagctggtggctgggatggagccactgcagcattgtatgaagatgggtactgttgataagggggaactggtggcatataaccatatggaggataatactgatgatgatattggccaggcggaggtggcatcattggatgggtataattttgcatttgctgcttctccaaactaggcttgttctcccctgacccagaaggcccaccaggaggaccatcttgagatgcaacaagagcacccattctttgaggatccatagatgggtagtagcttctttcctgctgaagaggtggtggtcctggtggattgttatagtaaaccattccttgtatttggtcctggttctgctgctgtgatatcactgcccgaggcaacaatccactatgagccacagaagcctgctgccttgcttgatcagagccatctgactcaggtttcgatgtctgaggcctgccccacatcagctttagcctaaggcccttaatgaccagtttgttggagagttcttctgctgccttttctgcaccttctctggttgtatatgttacaaaagcacaagcccgttggagaaccattttgatggattcgatttctccgtgcgcatagaagtgatcccgcaaatcctgctcagtgaccctagcatcaagtccacctacatagagagttttaatgttctcatcttcaggagcctccagagtgttcatttcccccgccttaccaagtagcttcaaggccactggatcattcaccctgaacgttttaaagcatgaacagcaaactaatgaagtcaaaaccatgaagcaaaattaaaaacaccaactactgcaactagaaatatcatcagtatctgtagtcacaaggaattcatgcagagaaaactaagaataagtagaggatacgttaatgagattgaaaaggaataatctttatacacatatagcactaaaatatagaaccaaaaggttatcctcacaataagatatttgatggctgttgactgtctgctacatcatttttggccacgatggaaaattaaacgtaacatattataaaggaatcaaccttcatccatgtcaaaaaaattctcttactacatatcgacaagtagcaaagtacaaagaaaacattcttaaaagtacgaaaaattacaggctaaggacaatgcaggcaagataagccattccacttcactaaatactgagaacaatacaatacatgacttcagtttagccacatatagaaggaaaaaaaagaaagccaaaattgcaagtaaatggcagttattagccactttttattaacataatgacaccgagctcttattgtagcccgtgctactgaatcagctgctttttttttgtaccaacaattaagaaaacttagtaagcaataaaattttgccactttggatccccaaatgttaatgtcaaatagtggttttgacttgtatatctgaccccacttggtggaacaaggcttgattattgttgtttaaaacaaagcttcctacaagcagaactatcacatgactttgctgggaaaaaaaaacctgcatgcttattatcttagctacacaatagttcgtcacacagaacaaccacaaaagaactaagtgagtgcctaataaaccaacaactatatccatcacagagataaaaaatgcttgagttgctgcccagtgccaaatgccaatacattaaaaaactaaaaaagagcaattgaaagagagatcgagtaagaaaagtcaaaagcaaataaggaagtcatttttaaccatacatacccataataacgatctttaatattttgttgagacaattccccagtttctggcatctcatgtctataagggcactcagctcctctggtacactcacccctaatgtagaaactgcaaatatgtgcccggtttcttttgtagtatggtgttgttctttgaagcttcatgatagtatcatttgggcgtactttaccataagaggattcataatctataccagctctagcctgcaccatgcttttattcttagtaaaaagatcacgatcaagtaatgaccaaagagaactgagtcaaaatagtagtcttatagattcttaaaaaaatggataaagaaaatttgaaattttaatagctgttgtcaatttagaatgtgaaaatcagagttccagggttgagaaattcttcatgtaaaaaaaaaaaactccaaaatattacaaaaaccatgcaagccacaaaaataacaattcactcatgactacatacagaatgactttaaacccataactagttttccaatcattaattatgttcagctatcataaactataaacatgacttagcataagaaaaacataccctacggtcatgctcttcagcaaaatactcccgattaacatcactctttggaatggcatcatgggaatcaatactgagagctgtgtctcggacttgaactggtagtccatactcaagatccagaaggcacacttgacagacatttttcaatttactacatgtctgacagatctcagttttcttatatcttgcatctcgaccaggtctccatctaaaaacagtgaatggccgtgtacaaatcttgcactccttgtcatactctgctcttgtctgcaccgaaagataagcataatgaaaagcaattgaacaaataattggattcccacaatctcatctttaatggaagatgctgaaatctgaaaattattaactaagcacattcacggactccctcgactccatagtttttcatagtacaccagtaaatcaactataccattttaaatttcaacattaactactctgtgataaaaaaaaaaaacttactgttcgatacttcaaagatgaaaaaaattgaaataattaagctctttcatttgaaaagccctagaagaattaagctaagatgctccaggaatccaagttcagacatttgaaaacaaaaccattggcctgcctgaataacataaaaggttttaaacttagcagttgccatctagaaatttctcattctcaggataaaaatactgcaaagcgcaaaccaaagctattgaacaaattaactcttctattcttagtagctggtcacatgacgaggttccacacattaaaatctgactcagtttagttgttccttcaacctttaattcctcactaaacaatcattatttttattatcactataactattaatattccaataataactcattcaatctcgcaagaacaaaagagaaaaaaaaaaaaaaaaacctaacaaacgaagaggatccgaaacagaccattcgaacataggggctgtcgccgaggcaggattcgcagatgatggggaagtcggagcgttcccaaccgtcggcttcgtgatctctgagcaacctatgcgccatgcttagggaaacaacgacaagcgcttgctcgttgaaccaaaatggaagctgaagaagaagaaacaagagattatggttctgtatttagcatgaaacaaaaggaccccaacgtcttacattacattacatctgaatcaatatatattgtcaatcgaccaccactactctaccagtagaacggaggtcggtggttgtttgcggtggccggtagaagacagtcagaggaggcaaagaaaggctaggtttcttacctttataatacagttaaaactttaaaagattagtagcctattacaaatgggtttcgattcaaatgtcctcatcttattgatagtttggagagtaaaattaggatttattttgtattcaaaatatataacacataataaatagaaaaaaatagatttgtttatttatattatttacatttttgaaataacaaaaattttctttaattaagtaaattaatatctattatcaattttttgatgagtgaaatttccaacaacaaagtttctaactttctttctacttctcacataaaaaattagattttaacttttttaattttttcaattctataatgagtgaaactctgataaattttctttttgtttctcactaaaaaaaactaacttgaacttttttaattttttctggtgtagtaaatacttctgtttataatgttaaaaagttatggagttgggccttttcaaagggagaaaaaaaaattatatctctttattttttataaaaataaaagttatctcatatatctaatttaataaacaataaaatattatttttattttatgaacaactttcacatttataaaataatactcttttttatattaattatataataaaataatatttcactagaatatttatttgattaaattctctaatttaattatcaaataaattattttcttttacaaagattgaaacattcatttcatttgtgcgtgaccctgtttcaatgttaaatcgatagtaaattaattataattaatttactaatcaaggtagacatctatcaacacccttaaagtcttttactttcaagaaccaatagaagaataattaatataatatttacttccatcatttacatctaaggttaactttagagtatattattattgtcaaactttaataagctaacacatctaattaacgaatgacctaagaaactcttttcttttttcctccaattgtcctaaccaaggtcttaattctattatagagctcaattattacctaaagtttatggattcctttttaattaatcattaattctacaaatatttaatcatatccaatattcattcaactattcatcaactagtgtcataaggcattaggtgttcaaaattaaaacaacataaataacttgttaattactatgataatctcatgtaaaaaaaattattatatttcttattgagaacttcctattgacatatcaaggtaatattaattattaaaaatttttaattgaatcagttcaatgatgacattcacatgtacattatctatatatgcaatttaataaatgagatatattaatttttatccaataaagaccattacacatatattgatctatctagattatatatatcatattcacaataatcctacaataaaaaataatttagattaaaattataaagacttatttctcattatcataatctctatcatgataacaactttctaattttaatcaaagatttctcaaattaacaatttaataaaataataaatataataaataaagaacaattttttattaaaattaatgacatgatgaattgtatctaggacatacatatttatctccaacacctcgtaggaatagaaaatgtttaaaacttatgagtataactttcttgagaataacttatatctgaaaatatattatcataatctcttaacaaacatgaaaatattgattattaccttaatattcgtggaatctcttaacaaacatgaaaatattgattattaccttaatattcgtggaaataaaagaagatgacgtgaaacaatttttgtcttaatgttgaatttttgtttgatgtttatggcaattattgagcaatggcagctttgttaggtaagggtgaggattattggattctagttcgtgatgattggatttgggaactttagcgatgacatattgaatatgctcaactctttggctcaaaacaaggtggaagcaatctcctatttgtatgtttaaaataataagtagcaagttttgataattggatatctattcttgacatggattgtgttattattaataggtaagatgttttgttggtccactttatccaagtttgcatttttttcccacttagtagtcaacccttaactattgcacataattgaatcattgctattggataggttcacgatttttactttgtgcaagtatacgtttttcaattattttgtaatttttagcattgaaattctgtcaatttgtttgctaaccttatttagttgtgtcctcttataggcttatttaaggaggaagctcccctaactcttactgcaccacaaaggcatagatactacggtgacagcttgaatcgcatacaacaaatcaattcttcatttcaaattagaatagatgactatgtagtagatataactagagatttattgtaatcattttctcatttatatttacttcttcataatatatagattgattagttcgacttattttgaactttgatgattaatgcaatggaattggtttctatgtgatattatggatactggtttggctcttgttgttttgttttttgttttttcaatagctaagtttgtctgtcaaaaaatactggtatatgtcaaaatacagagcagaattggacaaacactctttgccgctgctgctgccagatcaaaaccttatgccactacagctgctgttggtagcaaggagagttctttgaggcagacaggagccctgacgatgacaaacctgttgtatatggtatgcactaggcacctcttttgttcgtttggatttgggatgacaatttttctctgattttcattatgatcagacttgtctagtacaaatatttctgattttcttcattgacctttgaaagttgtgccgtttttttgctctggttatgaatttgtttacttttttatctatttgttgttaggtcggagttggaaggcatcggaattgcgtctaaaatcttgggaagaccttcataagttgtggtgtgtgttgttaaaggagaagaacatgttgatgacagagcctgcgttttcctaacctgagcgcatccccaaggtattacttcacttcttttcccttgttctgtgttacataaatgttgctcttggccttttcttacccttagttatgtctacgtttggcatagaaaaatcacagaagtggtgcttttatcttattttcatgaacaatgttttgtatagatttgattagagagaatttgaatgttgcatgtttaactctataatagatagtgttgagattatagggatttaggtagggaaggaagcagagagaatacaaactagtattctttttttttttttgtcatcctaattagggtctttgactccagttaagatattcccacaagttttggtcctttgaatcggtaatggaactaatttttggttgggacttagtcacactttctgttcctcttcaagaatgtattatgggagaatcgattttattagaaactaatattctgaaattgatattaatttgatgtgataaataaggaaattaatcagtaattctgtcaatttaatttgtgaaatcaggtgagaaagtcaatgtgccgcatcaagcaagtacttaccgagagaacaattgaagaaccggatcccagcagatctgctgagataaagagaatgataactgctctttgatgacttgaaatggatctgttcctgatggcatgttattggctatgttgttagaataggacattctaagaatgtaagattgctgacttgaggtagtttgtcctaaacattgtttacaaaagttattgatggattcttacttgattttgtttaagaggcagtcttaacagaaatctaatcaaccatttattgttcccagcactccagttatttcaaaaaggtgcatctcattttcagtcacccctcttatttttccatatacgagagtggtttacagggcaaaacttcggtggaccagtgaaacatatgatccattatggaccatatcttggaccggctatagaaggttgttttcgatattttatggttgcgtttatcatcttaaaatatattattgttttaatcatttagtctcgttctattttatagttgcgtttatcacacgaaatatattttattgttgcgtttaccacacggatctatattttatggttgatctttgattttattttttaaaataaaaaatgtcatttatggatcatatactaatatgtaaaaaacataaaacaaaaattaattatattccttttattttattctattttatttatcaaacatttttagtatatttttaattatgaaaaatagtattttcaaaaaataaaaaataaaaaataaatttaaaaacacactttaaatcctaaattgttttttggggttatgtgtattgtactaaggtctaatgtgcagtactatcttacgtaatttgtcaaacaacgatgcatgcagcccaaaccaacaacatacacttaagactgtctcagagtgcgagtgtgcgaagactatcttctataaaataaatgtaaaaaataattaaactaaataaataaagaaataaagtccgatttattaagacattatcaacgtactaaaagaaaaaaatatttatcatataaatcataaaaaatactattttttctaattaaaacatttattttcttttaactttttaatattcttatgatactagtcggcgcgtttgtcaagaaaaaaaaaaaaacggaagttattttatttcgctgactagtagcagcttttggcattacactcttggtaatccttccttctttttcccacatgggcttttgacatttttgcccatcatggctgtaacaacaacaggagaaaaatccaaattgtgtcttcccattttctccctgtgtggcttttatttaaggtcacaggaatggaagtggcaaagatgacatagcatctgatctgatataggtgtgaagatgggtgtgtcagctcagactgagtcaaatgacaacctcccactgttactcacccaatctctcaaaaggacaggtttgtgttgtgttgtcatctaaaatgttttgttttgtgcaaaagtgaatagattatagtatagtataactaagtaacatggtggtgtgtgttgtgaatgtgatgaagggacggtgtggacagcagtggcacacatagtgactggggtgataggatcgggagtgctgtctctgccatggagcactgcacagcttgggtggcttttaggcccattctgcatccttctcattgcttccaccactctcttctcttcttttcttctatgcaacacttatcgccatccccatcccgaatatggtcccaataggagtgcctcctaccttgatgttgttcatttgcatttaggtacgtacaaggtacaattccctttcttttcttctacaatttaacatcgactcttgtgtattgaaaaaatcttatgagtgtctccagatgaacgatcgattatactccttccaattacctcatttggaacatttaatatggttctatagtctagaatgttattttataagataagatcctctttcggtggtaacaggattaagcaatggacggctcagtggccttcttgtgaatataagtctgtatggttttgcaattgccttcgtcatcacaacagctatcagcttaaggtgtgttgattcatcacttatcatactgcttcctctcctgttctgtcatttccttttctttgttcttcttttcatccgtttgtgcaaaacaagatttttacactggtactccactaaggaagcatgtgtctatcccaagaatctcaccttatgttgccaatattaaatttgaactgctatttttatttgtggctgcagaacaatccaaaattcattttgttaccacaacgaagggcctgaagcagcatgtgaatctgtagatgcatattatatgctgctttttggggctatccaaattgttctctcacagatacccaacttccataacatcaaatggctgtcggttgttgctgcaattatgtcctttacttattctttcataggactggggctttccattgctcaaatcataggtatgcgtatggcgagtctttgcttaggctcacaatgactggcttgtgcatggacgtttgcttgaaaaatatatattggactaattattatgtagaaaatataattttatgaaaaaaaaattgctcagaaaaaggacatgctgagggtagcattggaggaattagtacctccagtggagctgaaaagttatggctggtttctcaagcacttggtgacatatcattctcatatccgttctcaacaattcttatggaaatacaggtacataccccgtgaactcagataaccagaatgtaacttgaccacagctcgggggggtggggggattttaacaattataaagactgatataatctactgcaatccttgaaggatactttgaaatcgcctccaccagaaaaccaaaccatgaagaaggcctcagtaatagcggtcaccgtcacaacattcgtgtacctcagttgtggaggtgctggatatgctgcctttggtgataatacaccaggaaaccttttaacgggttttggatcatccaagtcttattggcttgtgaactttgctaatgcttgtatagtggttcacctagttggttcatatcaggtacatataaatatagagataccatgtcaataattcttagtatggtgctcccatttaatatctcttcaattcctatattctccatcacctgtcttagggtagtgtgttatgaaatcatcatatagtctacttgtctgtactattatacattatagaaattagaatgcatgttcatttaagtgtcatctaacttgtttggtgcaggtgtatagccagccactttttgccactgttgagaattggttccgttttagattcccagataatgaatttgtgaatcacacatatatgttgaaactcccgttgcttccagcctttgaacttaattttctcagcctgtctttccgaactgcttatgttgcatcaacaactgtgattgcaatcatatttccctacttcaatcagattttgggggttctgggtagcatcattttttggccattgaccatatattttccggtggaaatatacttgagtcagtccagtactgtatcatggacgagtaagtgggtactgcttcggactttcagcatttttggctttttatttggattgttcactcttactggatgtattaaaggaatagtaactgaaaaaataggctgagaagctttgagacctctccaaggaattagactcagatagcctactttattttttcttccactttaatcgttgcaatggcctttccacacattcactcagttagtaacttggaaccattagatgaagacacgatctttattgaacggttgcaaatgcaaggaataggagactgcactgaatccagttggacattaaacatgcagattctctcatattttcaataggactggtggttctgtatttggtaacatgcggaaggtatccactactgaatgaatgaactcaaactcaacatttctacttcctcggttattcttccactatgttatacaaacaaattgaaagtggactttttttctatttcgtggggaaattttcagctctaattgattttttgttttaagtcttatcgataatatttagattaagccaagcttggtataattacaagctcctcacaagtgaccctgcaatgttgttgaccttttacttcagtaactttggtggaactcgatcttggctttggatgggattccctattgtaaaaaatacagtatttaatgtactaaacaatctattccctttgttaaaatttattgttaaactgcaaaacatccatgttctttgtatttccattcagagcatgacaaaattggagtatgtcaagaaacgtgaagcattctgtttttgatttacccaacagttactgcaagtttcgttaactagatgagatcaaacattcaaacttcagtcgaactaatgacctgatgacacacaaaagcaaggtaaaaaaaatgtcaaaagcctaagaagatgcgaatacaatcatgcagcaaatctcttataatgtctcatatttaacattaataaccggtgagttacataaaataaagccgccataggaaagtgagtcagtagatcaaagagttcttttcatcaagtcttctgattcgttggcttgacttagctcactactatctttgtacaaaatgcaaaagagaatataatgaaggactggttgatttcaacgacacaaatatgatggtccaataatcattcttctccccatatcatgaacagcagaaacacagccaagaatgatttgccgcttgacatgcaaattgccaatgtttacagactcaacctactactccactaattatataccaacctcagcatcaaacttcatgcaatggtttactgaatggcaagacgcctctgtgaggtgtgctccgacgagatgcttccccgttgttgacctgaacagtccccttcctccgctctttcacctgagtgcaaacaaaaagtagatgatgactgcaaaacatttgcatagttgtgttcttcaaatctctcatgcacttgagatcctcttgcatcttgttgcacactaggcgaattccaggtctcggcagaatcagagggcagtgatccaaaaccagatgaactaattgaacgtgacaatgggacttggccagtacccatatccttttccttgttcatgtggtttgaagccttaacttcagttttctttgcaaaacgccctccattacctcgtgctcttcttatagcatgctgatgccgggattcatgaagataaggctgtgaagaaatagaagttagtatagtatgcccaaggatcgcagatttgcatgtacaaaatattaagtacacagtattatactagaagccaacctgtctcattaaaaacaaattttgatttttgacacgtttgtgtaaacctaaatgaagataacatcttattcttcttaatttattgagtctttcaagatccatagcatttcacatttaggtaaagcagcactcttgttaaaatcttctactgattttcaaaagttcaacggttcagaggttactagatttccaattatcttactttggtatcctgtgtagatataaacacagttaaaactccttcatgtcaaactaaagttttagctctgcagaaaggaaattggttgtagaacaacctaaaataaaataaggtgacaaatatcccaaacctgaaatgtgttgagatatcactttccaaaatagattaaggcaattaactacagaactatagagtaacaatcatgcctacagaagcataagctagtgcacatttgtacctttctgacttttattaatttcttttcaagctctgctttagcacgagcctgtcttcgtctcagaattccttggtattgtttggcattcacataaacaggctcttgagccatctcaaggggcaaagccattctggcatgaggcattcctataaaaggagcgtatccctaatagtgaaaatataatatgttataccattgcagtgatatcccaatgtcaccattgtttgaaacagaaaaaaaaaaaaaaaaacaaatagcatgaaacaaaattatcatgtaataagaatctatccttcagggttatgcacaaactacatttctaaccagattgatttatgggaaatgcaaaacagtgagtttgacaaactacatgtaaaaaaaaaaaaaattgtatgagcactggttagtctcacatgccaactgttggtgcacatgtgctaccatcatacccccgtaataaggatttgaagcacatgcctgtagtaaaagaatttgaagcatactaggatccattagaaaagcatgcaagatttgacaataatttttccaataattgaattttcatcattgacatgctgaaatcagcaaacatttattctattaaacatagtcataaagctatgatctttgcaccctctcttcatgctaaaaaataaaaataaaaaaataaaaaaagggcaaagtcttacaattgagtggccaacaagttccagttgtggagcctgtgtaaggcaatcatcacgcaccaaaggtgcagatgatgaagaatgttgcatcgcttggtggtcttgtccataatttccttccaagaaaagaatattgtatttcaatatccttgtaaccttgtaacacttggactaaaataaaaaatcaaatgaacataatttgggccactatatataagcaaattttttctttccttattttaatgcttatatttttctttacaatcaatctaaatcacctgattgattaggagcagtgggttgtggttctttagtggcatcatcatcttcttcactggattctgaatcaccattagggcgttcaagtgaagatgaattagatgcattcactcctgacattgcttgggggacaggattgcactgaatacctcgccaccagggttcagaataagcatggttaggtgtaaaggaatgtggatcagacctcagttgatttgcagtttcagatttggattgcatatcttatcttcagatccctagttccctacaaatgaatattggattacaaattttattccttatgctaaaacaaaaggcaagataaataaaagtttataatgacagtggttattcccctttacaataagagaccctccaatggaattaaaaaaatggataaacaaggtatttctgaaacaaaatcacgtgaagtgaaaactatagccataattgtctcaggaacgttgatgtccaaatcttttagaggtacaaattgatcaatgagatatcaagcacaactcacagaaagttacaatggtgctactgctagttcatagcttcattaatgaaaggctcttaaaatgcagcatgctgattgatagtaaagccacattaaaaagtttcatagcctcatgtgtgaagttataagacatgtgcaacttacagaaaattgagaaacccaaattcaaaattattaaaattcatcatgaaatgatataatacttcttaagcaaacagaggcttaaaacaaaaatagtttccattttgctcttacttgatcttcagcaggagccgcagctgtttgaaggtaaatataaaatctttcaactcttggtcagtgcccagcaaccaaatgcccctagaagaacacaatcataatcagcaacagttgtttctgccatatatttaggcacacaaccaaacagcaccaggtgatatactgatattccaacatgcaaccatagctagtgttcacataagcagatacacactagctagtgagctacatttaatagaaaataccaaaatttggagtttatctgatcctagtacatgcaccaaaatcccaattctcccacatttgcaaccagaaaacattcacacatcacatgtcatagaaaaaaaataaggtttgggtaatatcttgccagaattcacacatgcagacacagaaaatactaaccctaatcctcaaaaccccccaaagagaatgaatcacaattagaccaaatttcccaattgattaattaaggaaattaagggggtgggaaggcaaatcaaagaactttgctttctctataactagaatttggggtgctgaatgttgatatctcacttcagttgtgatatatgaggataaaggaattcattcacgagtcaaagtgaaaataaaaaataaaaagtaaaaaaatcttaacaacaatagcaaatgaagtccagtgttgccttgcctgtttaaatttcaagtgacatcttatgatgacgtcagcatcaagtttcacggaggagacacgtggagagaaatgggagggaaaagggtatctgagagggggagggtgggtgaggatatcagagcccctgagaaggaaaaaggaacacaatttatgggccacgtgacaggcacttgactagcagaatccggtgaacgcgtggcctaagggtggggaccatagcctccgagaattgacagcaatgtgaggcacgtgtccattttcctttgtaaacatctttttttagtttcctcggattaataattgattctccagcaccatataattaactctattttctttactttaaaaaagggggaaaggtgagccttacctgccagtgaggactgaggggacacctattatcacgtcacagcccataaacaattcaatttattattttattagtgacttctaaattaaacaaattgagatctcttgcaaaacgtggcaccacttttttaagttgttgtcgtttttttcttctttttctcggagtaatttaagggcttcgtctatttttcttaattattttaaaaagtatttgccttttattttatttattatactataaaacagtattgtgaaaatcgattcggttattgaaccggttgagatagtaggtcaatgatttagtggttcaaccgatggatcaataattaaaccgatttgaactggtctatattaaaaaatttaaaattatattatatatataaatatataactaatattatttgattaaaaaaatactcaaaaattcaaaatatcaattgaaatattaaaattgataatataagtaaagtatattaataataaaatagagttaaatagcaactaattaaattaaaacacaaatccaatttttaataaaaaaataagctaaaaagactacagaaattaataaaagggtacaaaaagcaaatggaggccaaagctataacctaatcctaataatataggtgttgagcagctgctgcttcttctctaatttcatttgcgtggctgctacgcgcttccattttcatgtgctgcacacctcttcctcttctctatgttcatcacctctcctcttcctctttttcttcctttccctatggcgcgtttctctcttcctcttccttttgtttttctgttgggtcatattcactttctgctgtgcgttttcaaaatcgggttttgaaaaccattcgatttgtccgatttggccggttttgatcgagtttgaccaagtcaactgcatgactggtttaatagcagaatcggatcggttatattaccgattcctgatccaaccggtccaatccgattttaataactttgctataatgtaagaatttaccttttaatcatgtttggttcaatctttgtttactttgttgggtcgaattcagttcggacgatatccatccacgtggaagatcacaagaaagtagttttctttctggtataaaatcagaagaaagtaatgaatttactctataaatttaaatgtgtttcaattttaaaagtgaaattatataataatttaattattttataattatattgtaaaaaattatagattttataatatttaagtttataaagaatgttttgaataatttaaaatataaaaaataatttaagtaaatggaagttattgaaatcaagcattatttaaataatttctattgtattctttaataaatatttatattttattaacactaatgtgcgatgagttgttatacgtatttagtattatttgtttgaagaaaacatactaattaataaataaaagttacgctttggtcacatatcaaatagtcaacaattagctaatgtttagtggctttctacaatgaatccttttactggtctacaaggtattattattattattattatatattattgctattattattattgccaacaacaacggtgagttattcatgttgtaagcatactaccaagtttgtctaggtgttaccatgtgtcaaagtcactctttttatttttattttcgcgaccttaatgtgtctagacacataatatacatgcattgaacccgctgttcgtccatatatatatatatatacggaattatcaagaaattattgttattattggcatattttgctgggtgttgttatgtgtcttgggttgaagttgaatatttttggattttggattttgtttatgatgtcgttatgtagatgtagacacgtcgtaaataaaatagcaggtttatctagatgttgccatgtgtcaaagatacctattttttaagttggtagtaatgtcatctttgtgtgtctagacacatgatatgtatgtagtgaactcgatgttgttttttcttttggattttgaattttgcttatgatcgtgaagtttttttggacatgatgtgtcatgtggattctcaataaaaaatattttaaaaaaataaaaatgttgatgtggtttggaacccacttatttaactgacaagttaacctgatcaatattaaaataataaaatttggtaatgttttagagcatcctattatggtaattagcttccaaaaatatcactattttaggggttaatttactgaattggaacatttttagaaactaccgaccaatataggattattttcgaatattaaccatatgggatttgttttgactattgatttaaataaaatgccagtcaaagtagtattttttcatgacatgtaagcatttttttttaaaatatttacctaactctatatttgattggatggaaggaaaataaaaaaagaaagaaaattttaaaatttaaattgagaaaaaagtgtgaggaagaaaaaatttaaatttttgtatttaaaaaatatttttttctttcatttttttaaataaacaaaaaaatatttcattaatcatattttttttcttttatttttttctctcattttttctcgtaccaaactaactcaaaaatcttaagaaatatttatgttagacacactagttgaaggactgacatgtccaacatatacactacatggactctagaaccttctattgtgtaccccatgtactacttgcaggcactattggcaatttcaattatattttttcaccacaaaataattacatgctaccttttcgcaatagcgcgtgttcaggttgcactgttgcttcccatttagtcacgttattttacactaaaaagtaaaaacgcaaatagtagtggcgaactggcatataagctccatgtctgcatgatgaattacgaaggtataagacatatttatattttatcagtgatagagttacttttaaaaataataatctaaagttacttatatgttatatgattacttaaacatatttttaaactaagagcatctagcacaattcattttactctgttgagttgttttaaatttttggtgtttaaatttgatttctataaatgaaaaatatatatattaaattttattttgtacatcgaaggaattttttatttgatacattggaaattaatctctttcaaagttgagaaattactaaagtggatataactattttcaacaaaatatttttcatatatatggtaagaaaattaaatcataatccgtatgcttaaaaaacttattgtctgtcaactatatgccaaattttgttagtttctatattgtatttaaatttacacataattaattcgataggtcagaaagtatggattctggcctctataatatgtacatcttttaggcccattttaagagatggtagatccatataaataaatttaaaaagttaaaaaaattgttaagtacaaccacccccacacaaatagatccttggaaagaatcatacatccttattcaaggatattccttaattatttctttatacgtgtacaaaaatattaccacatatcacatatggcacaccacacacaacattcaattcatttcttctattcctttactccgaataaggttttagaaaatattctacgactctaatttttaattttactttgttaagatttttgaagtatttgtaaccgtagttatatatatatttatctttaattttttacaatataaaaaaaacgacgaaactacgtgcaatcgtaatttaaaaccttaattccaaagtatctatctgtgtgcatgtgtacatttacacacgcaaggctattgctacaaataatgattataaaccaagtagcaaaaaaaaaaaaaaaaaatagtaacatttgagggacactatataagtatcgatcatcaattccactactcttattttatcacagaaaaataaattcccgtatgagtagcgacaagcgagtagagcaagtagcatttagcaacataaaataaaagcaaaaatatgagaaatttcttgagattctcattctctaataagagagaccccttcattggattctcatagactgtggggccgaactcagagacacgtatagtacagtcacacatctgacaaaattatttcagatttttaaaataacatttcacttttatttcattttttgtttgaaaaaccaaaaaccaaaatacacacacttattagtgggatttaggcataccaattacaacttatgaataaaaaaaatactaattacaaattattgcccggaattaaactcctaaaaatacagcctagatgtgtcaaaatacaatcaatacataacaaaataatttctccatctcatctcattatattttggtttgtctcaaaatatgtttcattttataaaattaaatatattaattatttttctcccatattatatcaattcgtttattggcatctgatcacctgaatattttaaagaatttataactatattttaactctttaatttgataagattaattttgccaacgatcgaaaatccttttatcgttataaatggaagggtcatctacccacacaagttttttaaagacaaaaggtacgtagctactaactaaatatcaaacttataaccatcatcagttgtgcagaagaaattagtagaagaaataaaataaaagatgaaattgaacagaaaggaagtatatatatatatatatatatatatatatatatatatgataatatgatcgactttaatttctctcagagcaaccacttgactaaactatgttttgttttgtagaattccaagctatgacgctcaaatctacaaccaaaaccaatattctttgcactcatcacagcacccttcaaattaaggtcagaaaatatatcttctatatataacagagaaaaaagaaaataaacttaaaatctatatctaattaggagagcacacgtacccctagctaaatttagagagagacaaatcctacaagttgttaccctcctaaagttagcagaaagatagggtgaataactgttcctaagatcaatcactccaaaatcctccaaggttctctcaaagcatatacctctcatttgcaagagatgtagaaaaaactaaaagtacataagaaaagtccatgcatgttctaaagtttcacgagatcgtctacttatatatatatatatatatatatatatatatatattaattagcaaacaaatgaaacgggaagatcttgaagcgcaaagcagaagaaggtctctatgtctggtggtgcatagaatggtaagggtgatctacgcaaagagcaatcagaaagcacccttggattcttctttggtgctggagggcatgttgaaacttctggtatccgaaacttttcacctttgggagtggaacacacagcagcagcaacatcagaatccatgtcccttttctttggtgtttcttgttttctctcttcatgctgcttcttgcaatggcttcttgccagctttcctcttgtttttttcttttttcttgaagttgttggttttgtcgtacttccagaaggaaccatgtcttgatagaaaatgcttgtgtgagtcagctagctataagctaggttaattaaaagaactggtaaatgtttctaaaacaaaaagctggcaattggaagaagaagcctgagacttaaccaggtagagaagatataactaactagtgtaacaggagaggacacaagcttatcctattggagagtgctttaaaatggaaatgatatatatttgtccaaaagaggattttgtaaatgctgaagtaataagtgtatgagacgaagctttagattgaataaaaatgaaaaggttgaatattatatgactgtgaaaaagattcataaattttaacttcaagtttttgattaaaatgtagtcttatatatgatttattattgatgtaaattttcttatgtttatctctcgtatgacaaaagaaatgaagtaatgattcctcaagaaagaatctataacattttgtgtagtagctgacaccgaaaaagcaactccttttactatgacacttacactaaagaatggacaagtgatgaaataaggaatccaagacgacaagatttctttaaaaggagaccaaattaatatatataaagataaagttgtgtataataataactctctcatgcacatttacgaaggaaaaatcttctaacacttactaaagtacgtaaattaattagtattatatctgtattctttttatctctttgttgggctttacctccatttaaccctaggtagggagggaaaaaggagaaggaattggaggcagagattttcacactcgtacatatatacgtcttgtcttgggggcctatattatggttataaattagaatggccgacaaagtggggtgaaaaagtggctcgttcaaatattctgggacctattggacttatatttggtgtacgatgacttttaagtttttggatcactaaaaagggtcggtgacacatccacactattcttttattttggagtttttaattacatgcacacattagtttgtaggctaccacacgtagctttagattttgaactttaagacctttatcaaaatagatttcaaaatttagtacaacttttaagaccttaataaattttgaactttaattaaaaagggaaatgataaagagtacgaaacaatttcaaccacatttattcaaaataattttttttctccacttatccctttctattggctgtaaagtcatttgaaagtcgtaacatttttaattaaagttatttattatcaaaataacattcctagctatccaaaaactgcaacactattttaattagtttatcaaatataaaaatacaacaaaattaatttttatgcaaaaatcaagaaatttaataactaaattattttttatcactatttaaagacttaattgtattaccagtccccacaattaatttatcaaatgagtggttttagtagttatatcaaatgggtgattttacaacaacaaaatttgtggttaagaaggaaaataaaaaatcttttttaaaggtaattttagtagtttatcaaagggataattttggtcctaattttctcaaatcaaatccttatatacttttaaaaataataaaatctagtccaatattaaaacttcaaatttcttttcaaggtgagatttgaacttagtacgctagtccaacatataacttttatttttttaaataacgatactacttatattatgtttggatagctatatatattttgtttggatagctactataattaattctgagacccaaaattaaggtgaaattttgaaagaaaaaaaatattaaaactatatattactttgactttcaatgtgatttttttaaaaaatctaatccaaacatgctaataattaacatacgtgacagaaaaaatgaatcaattcttcaactaaagacaaagaggggagggacaggagctatacgtgtcttcattttacaaataaaggtgtgatagttgctttcaattttaaacttaacgttaattttctttccaaattatatttgactaatcttagtagaattctggcatgtttgaataagcttttttgaaaaatatttttaggagaagaaaaaaattatatattaaaatatttttttattaattaatttgtagatattttttcatctgaatcaaaataaatttttattagttaatttttaaatagatggaaaattaatgcaaacatatgtttaacatgtttaagttctgcataaaacaaattaaaatgtagtaagtgaataaaacagttgagatttgagaaggatagatagtaatataataattattttttgttatctgtctacataaccaataacgctgagtggcccgtggccgagaagcagagttttgttcattgatccaaagctattcagccactgtcactgactgatatgtttgtctgtgaattatttaattgattaagagcgttgaaaaatagcagagtttttgtcttctagtcctcgtggcatcacctaatctaatcagaatcacacaacaccacacctcacagagttttcaaattgcttttttgtcgcttctccatatataggatcctactagaagggttttttggacagacgtgggtcatgcatttgctcctatacattaatttgtacacatattatatgcatatcatgccacatttaccactgttgaggtacaataaccaagaatttttgcaagttctaatcaattttggatagataaacacaagtcaaaaaggagtttttatataaataaaatgaggagtatatgctcattgactaaaaaggtcggaggagagggaaatggaaaaaaagggaagagtatagagtttatttataatctgcttgcttgtttaaaatcttctaaattcttttaaattggggtaactttaaaatgttgattaaaaagggggatttttagtgattacaccataattcctcatcttatactcattctagcaaaattcaaaaacaacaaagaggttttacatgaaaagtaaaaacgttcctctcatttttatttcttattagaaaaaagacaaatgttaatcactatatcctaaaaacattagtcaataaacttaaaagtaaaaatatttttgttgaaagataaaaaaaattacattatacatgatttttttcgttctcgtataatttatgtaataaattttttaatttcttaactaatgtttgaagacactgattaataatatctttaaaaaaattataaaaaggtctccctagctccaaattcattataacatgattagaaatcttctaaaagtagaatttatatttagtgtgtaatattaatcaattcaaattagcatatataatacataaattagaatcatgtttaggaaagataagaaatcaaagtatctaagttctattctcttattattaataatagttgaacaattccattatgttatccttgctagttgctagcacttggcaggaaaaggcaacacccatgtatatgctcagttgactcttttccttgatcgatcatatttgaatgtcacgcgcgatgtgtgtgcgtggattggtgacaaacccaagtgtgcaactgaattgaaaaaggcaacgttagtttgaaaatttaggacctcagaataattgtttggtcaagattcacttaaaaatccgagcttggttttccaaaagagcatgcatcttctatcattcatctgtgtttgaggataggataggatggtgggtggtgtatctgttgcggtggagtcgcacagttggccacgtttgtacgtggatgctctgggcaccagccctagtagtaccagtatcagtggtttgtgtctcaagaggaagcacttgttgaggttgaggctcaccacttccttcgttcagagtcacagtgttaatacaattttcaagaagcatcgcaggcacaaggacaagtctaagagactcactattgtcaatgagctcggtggtcaatatgaggacacttttcatgatgtcaaaaaggtactactacttaacatactcactcccttcataaattcttagctagtccgaaactataatgtgttgtgaatatttgaatgacatgtgatcaagtattattaattcttctaataaattgtaaagttttaacatttctgttaatatatagacattaatagtcagatgatgatccgagattatttactaatttctccagggtcattgtgaatgaatatttaattaattattttgctatgagtatataatatattcatgaacggatgtagtttgtaagttggggcaccttaaattttatcattaaaatattaatatattcttagtatttatttgtggtgtttgttaattatttttaatatttgttatatagttttcagtgtttgttaattatttttatttgtaatttatgcattagtacttgtttataagatgattaaagttattgtttttcattgaaatgagaagtagagtttaaccatatgtattttgtagaaatattttagtctatcttgtaacagtttcatattcaaagatttcaaactcaatacttatatctaaattaactctcatgttgtcatcatggtcttttaaaatctcatcccaagtttcagtaagtttttttcattgttctattcaatccagaatagtaatttggtctcactatttgtttgttccttggtttataattgtttgttcctttaaattttctttacaaaaaaaatttgcggaggcgctacccccaaacctcgccactaaatatgcagacataaataaattctcctgaatctgctactagtgtctctcttaattatttttcttgatccgtcgctgagtatactactattccttgcttgcaatttgactggcttcatcttttatttggatacagcaaatactcaattatttcacatacaaggctgtgaggactgttcttcaacagttgtatgagatgaacccacctcagtataggtggttctataagtaagtgaaatctatgttgttgtagctacaatgctaatttccactcaaacttctatgctcttctaattactatttattttagtttcaaaaatgatgtttccattcagtcacatgttaagtaagcttctaaattgttgactgaatgaacttgtgaaaaagagaagattgcatacattcaactgtaagtatctcttttttttattaattattgtaaaattagaactctttgtgtgcgtttactactccaaaacttgccactgccagcaatggaagtgctctggttcggtttgattattatacttgaactggtatctcgtagagagattcttgatcccagttgaaaagttgctctgattgcaccttatgaaaagttgaattaggattctctgcagttggggaatttccacattcacgcattcaactaatcagttgaatgaaaatcggacagactcgtattttatctcgatgaatctagcttaaaatatgtatccgaaatgtgaatgtgtgaatacaggaaatctatttgcataagaagtcttgaatcttgatcgataaagcggtcaagtagtaaatgcacatcgatacctttggcaatttctagttttctacaacatttatttggaccttaatagattattacaagcaaataataaagttaatcaactttttgtagacatagtataaggttaattttttagctaattgttagttgttttccatgataacagtttcgttgcaacaaacgacccgacagataggaaacattttatacgatccctcgcaaaggtatgtgctctgctcagttatatcatttgttgataattttcagagagtagggaagttgagtcttttgtcttttgattactctcttgaaaatttactacaattttgtgaactattacatgtttaattttttgaaattaaaaagtactataaacaacatttcaagtgcagctcaagaattgctattttaagctgttttttctgttcgttttcttcctatgccaaatgttaaactgccacaatgttttccaatactgatgctggttaaaagaaaaatcatcctcgtaagcatgctatggtctttttgcagtgctgaaaacactttcacaataaactactaccgaattactcggtgtatagcttaataaacgactgatcagtttgtgtttccttccattcaatacctccaattttcatgtctaatgcctttgcacaggatatatgttcatataattttctataaaaacatattgttttgataattacgtttcacaatgtgttacctgataacattggaaatgatgtcattatgttttttggctcgattgctaggagcaacatcaacttgctgaaagagtgatgataacacggcttcacctttatggcaaatggatcaaggtaattgaactcaaaattatcgatgtcaatctttccgtttgatctccaaggcatgtgataatcttctgtagaggggtgatgcactccaaattataacctttcttcacctcttattgccatgcagaaatgtaatcacgctgagatatatcaagaaatatctgatgaaaacttggagttgatgagggaacggctcatggaaactgtaatatggccttcagatgacacaaacaccgaaaaaatcggctgataagtttggactttcgatctcttcttttcccttctgtcttttaatcttacctctccctagtctaggtataattttttgttccaatggcaatctgtttctctctaaattggttatctgtatctttttctcttactagatttgctagtgatacgttctgtaaattgtgtatatctctatacctttccatataagatccattatttagatagtttgaaatgaaggatttacaatagggattcaaaattttaggcatttgtttgagtgtaaccaatcgctagaatctattagccatgttagctgccgcagtttatggaaaagtaaagaaattattatttcttccacagggttggtttactcaataccttgcacgatgtatgattcaacctcaagcagaattacaattatcacgacagaaaaaagtagaagtgcagtttaattgaaagtaattttcaaaagttaaaaacatgcttattttcaattattaattttcctcatcaataaaatgcttattttttaattttagtaagtaaaataaagttcgcaaaatgttttgcatataaagaaacaaaattagactatcattcaaaaaaactgaagacattattgtattttacttactactcatttaactcaaagaaattactcaattaaagattttttaaggaaaaaaatcaaacagaagttctaatttaattcttttacttgtatgctaccactgtaaaagacaacatatgcaaacagcatgaatacaaagtcgcttaatgtatatattcctcctccccgccccccgttcttccaaattcattcttttttactagaattatgtcatcaaagttaaattaaattaaagaaaaaaattgagcaatagatcttatcttattatgttttttggggaatcatatcttattcttttgaataataacaagttgattgttttcacctttcaaaattttaaaatttaaatacctcttatttcaaaaatcaaatagaatataattggactacctttaaattaaaataatattatcttgatggctatgtatataacattaattaaaggcaaaaaaacaacattttttaaattatatacctaaaaaaacatggtttgtaaattattgcgttgttacgtataaagtacaagtgctaagtttggttcgcagttctgtcaacaaaaaaaagtatggttcgcaaagaattttcattaaaacatcacaataatttacaaaatacacctcaatcattaccccttgacatgttgcttacacatagaatccaaccatttgtcaatatcccagcatcagaatgaaattgaaactaagttctaaaattggcatttactactcggtacaatactaaagcctgtaaatctacttcgatcttccgacttacaaaaggtaatacacaatgtgagcgaaagagaaagagacttcggggcaacctggtcaggagtgcttcacacactgctctgactggttcaaaaaaatacaagtaattttagacacctgcaaagcgaaacaagaaaaaaaccatgtatctcaatttgacacagtagaacatgatacatattgttaaaaaacttcaagagaaacatattattgataaactagtaccagaacaaaaaataaagctaaaaacaggggcgagcaagtatgaaaaataatgaggaaaaaataaatcttcatccccaactaaaagactacttcgcagttgagcctaaataaatatgaacaaatctcaaagatagaaatagaatcatcatccttatgaagtgcctatataggaatatttaactacaaccaactttatatcatattaaccaattaaagttaagcaggaattaacaactaaataacagtcaacaattccaattttcaatagcatatttagtaaagttttccagtggcctgcataaatagaatagaaatgaacctctaggaaagacagcaaggaagtcattgaaatacatccactgaagcataccatacttgatgctgaagcacaaggccgatacaccttacatataaggtgggaattgggagaaaataaaatctatcgagatttctctttccctgcagcccaagggctttgaatggagtaactgattacaattaactatcaccaaaagtaataatctgcccaagtgcttgtcttgcacgaagctgcatcaaaaaaaaaaaaatctacaaaataactaagagaagtatttcctccagactcaaatataagcaaatctaaactcaggtatggtggtccaaaatataagtaaatctaaactcaggtatagcggtccaaaatataagccaatcttaattgattccaccctatttaatgaaatcattcccaaaatgccttttatttaattcaaattttattttcaatggctccttttattctcatgatatcaatcacatggcttttaaaatggagagagtattcccatttgaaacatgttcccagagaattgaagtcttccatcaattagcacgaacgatgatttaggaaatgaagttcattttataaatgagatataagaaaattaaacgaagttaactaacattcttaattagcgagaattagttattctttacttatgtttgactccaaagagagtatagaacaagaccagtttgaaatgaagattaaaagaccttcacatccatgcaaggatcgttgaccatcttcttgatttgagaaacaatgcctacattaagcagttttacaatcctaccaaatgccccaggacttgcaggaaaagtgagatttaatacgacccaaacagcagatgtgcgtaatcgactgtcattgctctgcagaaactggttgaagaaagagtgagacacattttctgcttttgtagagagtagctgcatgatagcttctttatgagactcatttccacttgcaatattgctgagtaagtacatcccctacacaaaataaaaagataatcagcttgaagattaagatttcaatacaattgcagttttcttttttcatatgctcattgtgttaatttgttatttctatcctgtcagggaaaaatactttgttcaccctttacatttccctttgagatctccaaaatttattaatttcctctatttttctctcccaaatagcattaacagaacgcatagttatcaatcccggatagcggagcggagcggccgccctcaaaactgggatagcgggatagcggtagcaggatgaccgctattctcatgttttcatatatgtattaaaatatttataatataaatatgtaagagaaatataactaaaaattcatgcactaattgtcattaacaataaaaactagtcaaagaaacacaatgtcaattaaaatttgccaaatgtaactaaagttctagaaattcaaattcaaaataaacaaacacaagcttcttaaatcttaatttaaatcatcatcctcttcctcttcaacattgatgtcattgtcttcttcatcactcccactagcactagaaatgtaatcttcctcctcacccaaaaaaaaagaaaagagaaataaaaaggaaaaggaaaaaaaaaaaaaaaaaaaagaaacagaatggcaaaatcacacacccataaaaaaagaaaagagaaatgaaaaggaaaaggaaaaaaaaaaaaaggaaacagaaaaggaaaaggaaaaagaatggcaaaaatcagccaaaaaaaaaaaaaaagaaacagaaaacgaaaagcaaaaagaaaaggaaaaaagaaaacaaaataaaagaaatgaaacagaagttacagaacgagaacgagaacgagagaataagagaaaagggagaagaaagaaagaaaaaaggagaaaacctgtagatggaatcgcgtcggagggagaagcggcgccggaggccaagccggagggagaagtcgccggagggagaaggttcaaagagctcgcagtgggagggagagagaacgcgggagggagagcgaacgggagggagagagaacgcgcacgtgagagaaaagaaaacgataaaaggtaagcggtttaggcccaaagcccaattcgcggccgcgtctccgcaatcgcggacgcgacgccgcttgtcctatcgcggccgcaatgaccgctatccttaaacgctccgcttcagagggtgttgtagcggcacccagccgctccgctccgatgcgccgcgatagcggccgctccggccgctattgataactgtgacagaacgttagaaccatgctctcaaaatgaagtaatctaaaggtatagatattaatctcaaaaatgccttcattgaaccatacaagtaaggaaaaatgatgaaggtggatctcctgttggctgttgcccaccataaacattttatgcaactgatttacagtgttagaaatatgacaaggacatagaggctctgataccatgcccccaccatgcattgtccatgcttcaagcccatagggcttttgcatgaggaagcatgcatataaaaatcattctagtgtctttatctaataacttaaaaaatttgggatagttgattcttgataattgcagtgttatcaatgggggatggcagaatgtggtagaaagccaaaaatccgccatacaaacacacaattgcggcctatagcactgccacagtgggcctcccttcaaaaattgcctattatgacagttggtaaaaaattcaccacgctgttctgccatatgggtaaaacagcttttcaatacagcactaactatgctctgacagaacactagcataaaatcatgagacaacataataaaaacatttgatgaaacctttcccttctccccaacccaagtgcttgcacctcctattgtataacaacccaaaatagagggaggaatgagatataaaaaggaggaccataacataatcataatatgtatcattaagttggaacattgataccaatgtacattgtaatgcctgtattccaccaatgactgtttcaaaagttttacaatctgctaaggttagaaatatcccttcaagtcgtttgggatgtaaagcacagttttgcaagtgactgttgaacttatcaatagcatgtacctcaaatgctaacttctgcaaatcttctttttctgcaactaaacttgaaaaggcaaaggaagcattgtctccaacttgaccagaatcatcaaggaactcaagtaaaatatgtaccaatttggctttgattcctatgtcttgcagatagcaagaagatgaattctttacactaatcaggcacaagcaggctagtaacctagtccaagaatacctgtccttggttagttcaattaccgaactcaaagctcttccattttgaaggtccacaaatttagagacaacttctggattgtttttaagaattgcagtaagggattctaaactagaatctcgctggcttagagaaccatcaagaaggctaataagtgtttctaaactaaagtaccagcacagcataacatattttgttcatctcttttctcagaagaatgaataacaatgcttgcacctagtccagtaagattttcattcccacttttcaatagtgaaagaagaaattgcatgtcttgttctttaaaaaagtcatactttggagctagttttgatcgataaatcattcataaagagcatgcagcggcatccacaacctgaaatcaaggggaggcaggtctattagatgacattgggaaaaaaatacagtcatatcacatacttatcacaatgataattaatgtataagggttaaggactggtatgtttgttctacctactacatgccacaaatgaataaaaggcataaagaagtcttgaaaaatattcaacatttaaagatcaaatagaaacaataacaaatgcacttcctgtaacctctgtccattcatcctagcactaaaatatgaaagcaaatagcttaaaacggaatagatataagatatacaaagtgacaatacttggtaaatcatgtccacaccccactgactgcattgaactagaatgaatgcctacacaccgttacagccaattcataaagattatagaagcattagatcataatacatttattttcccctcacaactgctgtttatcataaattaattggctttttgatatttcatgaagaggttgtgtctacaaatcaaggggactcttcaacacatctggtaattagaagccaacatacatttcttcaaatcaaggatgattttaccatgggtgaaaactaaaggaagaagtgcaaatcaatgtatatttgtttgtatttgtaggcaggtaaagagataggcatgcaagaagagcgggtaaaacttctgttatccttaccaaaaaaatttcttaaagagaaattcaaaatgaattgtcaacagcaaaaatgcccactgcaagcagccaaacaaaatcataattttatttggtacatgtacggaaagaaatacaaaggaactaaactagagacagaatcagtgcctaacgcaacgagaaaaagacaggtggcagcttccactcatgcgtcgcacacctattatttgtaccccaccaagccaacaaatcggtaacacaattaatgtctcgagacaccacattgagtgagacattccagcccctcccaatgaaatcctgaatccgacaaattacatccccatgcacatgccaatctattcactcttccatagattcttcagctgcattcctgcagtctgttttgcacaccacactgtgatagccaagattccaacagacttccagaccatgctctatagccaaaagttctgaccttagagtctccttgttccaaaagaaaaataaaaatgcttcatgtaacggtagtaaaacataagttaccgggagattaaccattggactcctctttatttccaattgtaccatccaagttttggcccttccaatttctctacctatagatgaatttcgcaaacactctaccgctccatttttctatccctttctatctctaatcagtgtaccgcgttcatcactaagaaagaaatatatatagttttagctgtaataaacctagcaagaaaaggagagaaatagaatacatcaacaactcgcaacttaacaatctagcatgcgtacactctacaaactgttgttgattatgagacaagcacatagctattttcacgcgagctattcaattcctaatttccaatttatcaacatgagcaacaatgcaatataagcagtgcttcctgatttcttcttacaattgcaatttcatcttagcaccaatgtcagagaaaccaaacacgcaaaagaaatttcaaaaagaaaaaaacgctgtaattaatcgaattgaccttgtcgtcagcggcagagaggagcctgattaaatgagggaatgctccggcgtcgaggacagcgcggacaccggcgtcgacgccgtatgcaaagctgccgagtgcggcggcggtggcggggacggcgccgagcttgatataggagagcttcttggtgcggttgccgatgatctggttcttgacctcacgaatggctttgagcttgatttcgcagtcggacgaggcgagacggtggaggatcagatcggaggagggacgccttgccggcatggtggcggcggaggaagctcatgcacggcggaggagaaggcgcaacaaccttctaattccacaattacgatgccgacgagaaggcgaatttatttatttttaattgtttcttttacgagaggagaaaaaacaggggtaagagtacgagtaagtgcgtcctttataaaaaaagaaaaaagaaaaaaagaagaagaagaaagtgcgaagttttaaatttatgaacggaacggataatagagacttagagagattggactagtgttgttcaagctggaccccattgtagtatttgaaaactggcgccctctctttcactttccacttctatactcttttttataggtttttaattttcgctaaattcttcttttagttaattctgaggcgttgacagtaacgtgtttcgggtgcggtttactttcaataatcaaaaataaatataaaataaaaagatgcgatttgatttagatatatcataaaatctgaattaagtaaaacaaatcttttatagtttaatttgacaattttttatatttttaagttattatcacaatttaaattttattgatcaaacttacataattattattatgttttattattttaaaatatttttttattaattttgaaaaacatattttagttaaaaataactcttttcataacataataataaattttacatcagttgatatttaatactgattttaaataatattagaatttctttttttaacatatgaaaataatatatgtatcttgattacaaaacaaaaagaaatatcataaattatttaattcttattattaattattatgatatatatatatattataaacttattatagaaaaaaaatacactataaatcacatactataataattaaaattgaaaaactgtctacataatattaaacatccattcaatgaaataatataattgtaatgtgttatttggttagattttaatgacaagatcaaaaaatcaaaccaagccactaaaagtatacggtttttatttattttttttgtaattttcagtttaagcatttttgttttttttttttatcaatttcgcgtgtttatagatattttgtaacgcacatgaaagaatttagtgctggtgtatatatttaatgttatcctatgattggagtccactattgaattttgaatgtgaaaagaagttgtttcttcttcgaaaaggacaaaagaaaatataatgaaaaagttaaaggaaatgggccacgacagcttcgatgatccttctagtttactcttaatggagcatatttggattttgtttggatctctccaagtgttgtgtgaatgccttgacttccacgcatccgttggaatgttttccaaggccagaatctgtcattcctgattgcctaaagtatggagtacatatcttaagaagatatctttaacaaatttctttaaaatattaattaaataatattaaatatatttagaaaatattgttaattatttttgaataaatattgaataacttttatatttgtttgatgtatcaaaacattgaatacatgaacactgtttgcataaaacaattttgaaaaaaaaaatactatccaatgtctcaaatatttgaactaaaaaaattaaatatatttaattatttttaaaattacttccaaagaaacataaaatattttagacttaaaacagagtaagaaaacttcgaagtatttcatcattttttcttttgagctttatttataaagcgtttatttctccaacatatactttgttgattcacattcagattcaaaccaatgaatctgtccacatatcacaagcttactaattgattcgggaagaattttcttatggtctctttcaatttttatcgttatttaagttcgaacacctaagtgttgttttatttaatgaaatataactacacaaactttaattttgcctccaccaatgagaatagtacttttgaaagataaaaaaggttatctcctactacacaatttacactcacaattaaaaaataccgaagttatcttgattaaattctaaaaaaacatatttggtattaaatgtctagctactatatccaacgcattattatcaatcgatcacatgaaccgtaaacatattttattttcctttatatcattatagaaagttgttgatcccattcaatggagaaagataaaaaagaaacccagataagtggagacagaattaatattaggaacttcaagatccaagatcgaactccatgtggcaactggcaacaatatttagtcaaaataattcatcataccagttcccactaattttctgcgcctacttcaaagcattatttttagcccatgtgaacatgattcttatccctcaaattttcaacactttcgtttacttataggctaactgcaaatatgtgatccacttaatttagatctacttgtgttcatatagtgtgtcaaattcattaatatatctatctcattttatttttatttatcactttttaaaaaaatatattaattatttgttttataataacactttgttgtgatgcaggatagagctggaatcattgtgaaggtttcacatctaaggtgatttctcccacatggactctaataatcaagtcagaaatacttggaggaaaataaatgaaaaggagtgaatactcttatttgtgcaaggatatatttatatatagacatctttagcgcaagtgtagtcacatgcctaaatattttttaaatttattatttagtcaacttataattgtgctcatttatttcacatgccatctaaaatagtatggttgaaataattctcataacaattatcttcaagttagtgttactttgatgcaagtaacactaatgacttaaggtttaaggtggacacattcttcataacactcttaaaaaataaatagactagtaaaagtataactacaattatataaggaatttaataatttaagaaataatggtgttttaattagatagaattattttattataaaattaatataataaattaatttcttaatatatgtacattatcttaaacaataaaataagaaaataatgtaaactattgtttatttaacaattttgtattacttagctcaaaattgataagtggtgattttgaaagagtttaataagcatgcataatagttttcatttttgatatatagttattataaagaaaaataaactaatgtatattattagtttttttccttttacatattactctatatcagtaatatttataatattaaccaaaacagcacacataagtaagtgttaatgatttatatcttttaattaaatgattaatatttatttgaattcttattgatctttgattaaaaataaattatattaagagaaaaatatataatttgtgtatgtgttcaatatctcccacacaaatttgtcacactttcagacgaatgaagttcatatagcatgaaaaaaattattttccatgcaatccaaagtaggaaccttcaaataggagggtggatgaccccttactgcacgtccgtgtcttcccgtgccagttcctccactctacgtctctaccaaccagtccaatttcctttcctttctctccgttggacactgcctcttctctctctctctctcaattggcttttcttcccttttcatttattggggcagcctctctgcaatccacagataacttagattacttcgacatgctcatgtcatcattcccagcttttcatctgagtggtgagaaactaaattgccctttattgcttcctacgcttttctatgttgaaccatatttttttatattctagctatgactgattgcaaatttggaattgcttgctttggaagttctttcatttctattttgttgttcgtttttttgtaataactgcaagttttgtgggtgtgatttgtgaagggagatgagaagaactggccgagcttttaaaaaaagaaaactggtcttgttttttctctgaatttgggtgtcatggagttcccttcccctactatgcgagtttggacccttttcttgttcctgctacttctgaagagtgatgttgtgcaatcggcttctgattccttgattggtatgggaagctatgacattaccggtcctgcagctgatgttaacatgatggggtatgccaacactgagcaaattgcatctggggttcacttcaggctgcgggctcgggctttcattgttgctcagccaaagggtaaccgggtagtgtttgtgaacctcgacgcttgcatggcttcacagctcgtagtcatcaaagtaattgagaggctgaaagcaaggtatcaataatgacttctttgctctcaagaaataactattatgataataacttgtagaaattatggaagattaattatatgggagattttcttatatttctgtgagtggcagctggaccacccgaccgaataagctgccgaggcatagttgaccaaataactgcctatgcctttcaggctagaagcttgagggactatggaccattcggccgagtaagtaggtcacagatggctgacctacactagtaagtccgagcatttactatggaggggtcctaaggctttcggagtcaacggacctctcagatcttaaggccgaatataataaaggtctagatcctcctcacgcgtgactaaggcaccattcactccaccctccagaaaaaaaaagcaggaaccgtaggaggacacacttgttatataggcatgactaacccaggtcacactagggtatgattggtagagtctcaccagggtttcttgagttcatattgagctttaggattctccggcgattgtgttctctagcgtgaaaagcggctgatgtttccatttaatttgtttgatccctaagttttgtgcctgattttgtactttattttgtttgacagatatggtgacctatatactgaaaagaatgtggctattagtggaattcacactcatgctggtcctgggggttatctccagtatgttgtgtatattgtgacatctcttggatttgttcgccagtcatttgatgtcattgttgatggcattgagaaaaccattgttcaggcccatgaaaatctccgcccaggatcaatatttgtcaataagggtaagggaaagacttgtcattccttctttgtcctttctcccttgggtacttatatttgtatacagatgtgagcacaggtggataatttaaatgttatgtgtaaattattataattatggtagttttgcatactgttgaagcatgtcagaaaaagatgaaaaactgcaagaagcaagttgcaccaactgtctagaaataaatgaatgaggcaagcctgagctttttcttataggatgtagggttttcccatctttacttttcctgacatcattaactgtattaagaatttgtttagtagtattattttgaagctatcaatgtgatttctagtaagtgcactagttggtagtcatatggtttaactattatgtcatttctccctctctttgttgattatatcgcatggtttgagataaattatcttcaacttgcaggagagctcttagatgctggtgtaaatcgcagtcctagtgcttatctcaacaatcctgctgcagagagaagcaaatttaagtatgatgttgataaagaaatgactctgttaaagtttgttgatgatgaatggggtcctttgggaagtttcaattggtttgctactcatggtacttcaatgagccgaacaaactcattaattagcggggataataagggtgcagctgcacgatttatggaagactggtttgagcgaaaagggtctgtaagaatagattcggttggatttgaaaatgatggaatcccccgaagaatttcaaacataattcccagccttcatgataatcgtaagatgtttgcttttggctacaatgcatccattgataaactaagtagcttcttttccattacagtatgttcattacatagcttcagaatttataggtttatatgccacgtgatgtgggtccactgttctagaatgtttttgccttgcagggtaaaggcttcaaatgtggtttgaccaaaggatttccccccttttgtgttagaaattagaatgtataaaaatttctaatcatattttagaatatattagattatccttacagagaaatagttgctgtagaaaatcaacaagccttaaaacagtccaaagagaaagagcaatcaccaaacaacaagaggaaaatttgtactttggcaacgtgctggattgcctcttgtagttagttacatgtattctgagctctgatccggtgcttctgagttttacaagtcttctcatataagtcctaatattggtggagttaatggagttgtctacgaacaagacaagatgtaaataccctaaatgactgattgagaaaactaatgaaacatacatgaatgatatcttgctttatatatgtggcataaatagtttatcaattaggtgaatatatgatgattataataataattaataaatgaatacgtttctaaccccacttaaatttattggtccagaccatgaattactggaacttgctgcctcattccaatctcctcctggtaaacctgcaaccaaaacttcaagcgttgctagacgtgtgagaggtgtccttaggcaggttgacaagcctagatttgtttctgcattttgtcaaacaaattgcggtgatgttagtccaaatgtactcggagctttttgtatagacactggactaccttgtgacttcaatcatagtacatgtggaggaaagaatgaattatgctatggccgaggacctgggtaatttttattgcatgctcaatgtttctttgtttttctacaattttcctaatcctttatggttgctaaagtgtctcctataaactgatgttgcagttatccagatgaatttgaaagcacacgtattataggggagagacaatttaaaaaagcagtggagctattcaacggagcatctgaacagattaaagggaaggttgattttcgacatgctttcatagatttctcccagcttgaggtaaatccttctaaagtaggagcttctgaggttgtaaagacatgccctgctgcaatgggatttgcatttgctgctggaacaacagatggacctggagcttttgactttaagcaaggtgatgatcaggtaaccactgataagaccttatgcttacctattatcctggccttgtattcttaaatatctttgaaactctatgattattatttctaattgtatgtcagggaaatcctttctggaagctggtccgtaacttacttaaaacgccaggcaaggaacaaatagactgtcaccgcccaaagcccattttgcttgatactggcgaaatgaagttaccatatgattgggcagtaagttactcatttgatgttctttgatgatggtagtttcatgtttctcttcacccatttctgccataaagatatgctaccatcacaaggcatcttttttcaaaggaaatatttcttcatttggccctgattggaaatgctctcactgctgaaacaaagagtctgatttttgataacttttactaatttgaacctttatttgctcatgttcaattgcagccttcaatacttcctatccagatcctccgagttgggcagcttgttattctcagtgtaccaggaggtatgagctcttatttttaatttcttaaaatgatgttattgttggaatttctatcctttgcattttgaaacatttaagtttcaacatcaacaaccttggtcgaatgagaatatattgagtcaaagaagaaaaaaaaatgttgaaccgttattgggatcatgatattttgatgatgtctattccagcaatactgggttcaatccaaaggatggctgcatcttagttatgcgagtctctcactatttatttttgtgtgtctaaatgttttaagatccgatataatccaaaatccaaatgtgttgcttaatatgttgtgctattatattatatatggttttttttttccttgcagatctatatttatatttttataccagtatttgtgaattgtgagacaatctaatctggcctatgtatttctttgggtgcttcatgcttcctgtaattgttttacttctgacagaatttacaacaatggctgggaggcgtcttcgtgatgcagtgaagacagtgctaagtggtagcaaaggctttggtagcaacattcatgttgttattgcggggttgactaatagttattcacagtatgtgaccacatacgaagagtaccaggtgcagagatatgaggtcagttacaactcttgtggaaagagacatgaagcatgcagcaaacctttttagattgctatagcaagagtaaatgcaacattagtggaaatttacatttttagggatgcaacttatcatcaaataacataacttcatattggcaagagatgtaaccattatgtgctgctttatttaacttcaattttcatgttaccagggtgcgtccacgctgtacggtccacacacactgagtgcttacattcaggagtttacgaagcttgcgcgtgctctcatcagtggccagcctgtagaaccaggtccacaaccccctgacctccttgataagcaaataagcttattaacaccggttgtgatggatgcaacccctattggtgtaaagtttggggattgtagctctgatgttcccaagaactcaacctttaagagaggtgacatggtgtctgttactttctggtctgcgtgccctcgcaatgaccttatgactgaaggtacattttccctggtggaatttctccaaggaaaggatacttgggttcctgcttttgatgatgatgatttctgcctgcgcttcaagtggtctaggcctttcaaactcagttctcaaagtaaagctaccatagaatggagaatcccacaggatgtaactcctggtgtatacagaatcaaacattttggggctgccaagggcttgttaggttcaattcatcactttacaggttcatctagtgcatttgtagttgcatagtaaaggggggcatactgattgattatacatgtttaatggttcgaacactgtttctactatattgtggtttattgtactaaactgtggcacaatacactaaattaaatcaaggatgattccaccggatatcatttgttattcactattctttttctcctctcctagaaattctctgcaactagccaatttccttatattttcatttgggtgaacataataattgatcagagtagttagtcatttgtggcttacaattgctcttataacattgttaatcactcccatctttaattggtgatacatgaaagttttttataaggagttcttaaactcatcttttttagtagttattatataatttcggaccgtcatgatcttgggcaaacttcacgcgacacatataattgaattttattatttttttggtgtaaactaaaaaaactcaattatacaccatatggaaattgcttaagatcgctaccacatgatggtcttgaactaaacaagttttcatattataaatcggttaattttgtgaaaaatgatgcatttttgtgttttttttaaaggcttttagtatcattttttttaacagcataatatttagaattatccttattaaaggtagagtttaatttctatactttattagcttaaagttttttatattgaaatcaattaaaaaccatgacgagtagatataatttgaaggtaattattataaatgtaaactaactttttatatatcacagtttattctttatatatttgaattatattttagtggaataaaggaaataaacaaaatttaaaagtaaactcgatttgtttatacaatgatacgacgacgtttaacaagaacggttttctagtctctgccacactaggaagacgaagcagcagcatcagtgttgaatctcgttttcccagcagaagaagaaagcaagggcacgcacatcttctcagctgtgagtgagaatttggagagtagaagaagacgcagctgattgtggagatgtcagtgcaagattacctggacaagcacatgctttcccgaaaacttgaagatgccgtcaatgccgccgttagggccaaaacctccgatcccgttctcttcatcgtatctctctacctctcatcatctcttttcatttttttcccgtttctctcatcggaatttctcagcatgcgttttttcggtgaccgcagtcgaatcacatgagaaaagcagtgcaatcggtcataacgaaaatcaaggcgaggcagatcctcgatagcagaggaattccaaccgtcgaagtcgatttgcacactaacaaaggcgtgttccgcgcttccgttcccagcggcaactccaccagcatgtaagccttttattattattatttatttatcaatcgctctcgttcaattatcgatttggtttgttattgattcgattcaggtatgaagctgttgagttacgcgacggcgacaaaggagtgtatctcggaaatggcgtggctaaagctgttaaaaatatcaatgacaaaatatctgaggcgttgattggtatggatcctacgcttcagtcgcagattgatcaggccatgattgacctcgacaaaactgagaagaaggtaatttaacgtctcgctctctctgctatgaattcaatcaattggctgttgatttaccgtattacatattgttgtgttctatgctttgattattttacatttcaaaatgaatttggttagtgattaggaaaaatgctatgaaaaggtttaatagtcttaatagtatggttttactgtctttttcattagtccaggatacataacttttagtttttcttagttatgtgatggatacaattgggatagtgcttgctaggttgctactcggaaacaactctaagtggtgaaggtcgtagttttccttctgcatctccatatattttcacttttctattttctctctcttcattttccatttcttttacaaagtgctcccttaggctagtaggagaatttgtttggctgttggaaatatgataaattcatacaagatattttggaagcattatttgcacttcacttagtatgtgcatacttagtttccttttcagttttgaatggttgcttgatgaaggcagtgtgtgtcattgattcttatatcatacacttgttgcgatcagatactagtgcatgcttgttgaataattcatcttagcaatataggtctcccaatttttgtaagattatatatatatatatatatattatctgttctgtttctgattttctctgcagggggaacttggagccaatgctatattagctgtgtccattgctgcttgtaaagctggtgctgcagaaaaggaggcatgactctttaacaattaatatttttataagtttgtttaacttttaatctggaaaattagtatatatgttcagtcatgatatcatgaaaataaagacaaaaacatacaggttccactttacaagcatattgctgacctgtctggaaaaaccagcccaacacttcctgttcctgcctttactgtcataagtggtggaaaacatgctgggagtaatctggccattcaggtataatttctgttgaagtttaatttcttagacattctcatttgtgttttcataatcttacctccattagggatgtgttcctttcctccaaagaaactaatgaacagtgaaattaaatgattaatgttcaattatttttgttgtaactaacacctgttcaattatttatggcataactttggcaatttattgttgtgtttgattctgttctttattttttgagcaaacataaacagatatagtttctttttaatctgtgtttcttctgcttcatagttatttagactcttttaattatgaaatctttcttacataattcctattaggaaatcatgattctcccaattggagcaagcaaatttgaggaagcattgcgaatgggcactgagacctatcatcacttaaaggtggttttgctttatttcttctttttttatccaatcctattgcttttactttctgtctttaggggctttttttctcctcataatttcactcattgcaatgttcccaaactagaaacatatcaagtttagttgcattgagtttggttacattgtcgtttacctggcttacaatgatttagatcggtagatcctatgttattactactatagtcttcctttgttgttgcttactgttcctacgatggtggtatttggttttaattgatttgacaatccaatctgttgtttcccagcccatatatatgttttttgatcaatgatggattaaaaaatcctaataatcacttgctgatatcgtgtttaagctgatacatttaattattgttgatgacaaaagggcaggctgtcattacagaaaaatatggtgcacataactgtaatgttggtgaagatggtggctttgctcctaatatctccaggcaagctttttattggatttctacagcttttgaaaattctttactgttaaatacaataacaaagcctttttccactttgtggggtcaattacatggaaccactgcaccacaaatttctgtaaaattcttcactgttaaatgaataatataaaaggggtaaaatgtctccattttagaagaaaggaaagaaaaacaaaaaatatctccaaactactggttttactgctgtaatttctcttactgtctgttgtgatttcttggatacattgatatgatatccctgttcctttgaaatctatgataaatatgtgatggaaagaatttcatttgtattttgcctcttaatctaacttgcactttcttttagccaacattttgaactgctgcatgttataattaccatgttttcttctacatggtaaatgcatgttatgaattatgattacatctttttttaaagattaataaaaccagctagtgtcctatgcgcatgaatattttaaaattcaggtgaaatataaaactagaatctaagatgaagttataagcatgatatgaagaattaattccaaagaatatgggttgtaaatgaaaagaagagagagtagattaatagattaagttaactttcaagggaatatattatcaaatttaatataaagggttggttgtattaattttatgtacttgcttttgcttattgttaatgttatttgaagctaattatctaaatttttaagcaactaaagatttaataccaaactactatagtttttaaaatataaaatcacttaatatttatgaaatttgcacttggctaatgttgttacattaagtatttttccactcaaagaaatcttttgttatattaagcattttgattttacttctacctattagctgactgtttaagtatcatcagctttagagaagccctggatcttgtgaaggaggccattagcagaactggttataatgagaaaataaagatagctcttgatgttgctgctacaaatttttgcataggtatttctaagtttctctcgcttgtgtacgtttagattctcaagaagatggaatttggtgattcttgctctactattttgcttatagctattgtaatgagagtctttgttgcagcagtgctatgctaactgttttactgcgtcatttatgaaaaatatgaaccattaattatcctttgctttcatagcaaaataaaactagtctttctaagagatacaaaaatagtactcttatttgataatagtacttcaataatgactataaatacaaatgaccatccttggccatggtaatatgtcatctttatattctatttaggggtgtcatttcagctttgtttctgaatctagggttagatttttaaaagccaataggatgagcatgatgagtgactgttatgaactttaatctgtagagcttgttatcaacttattgtcataatttatcattttaatgttttatttttaatattaataccagataattaatttatatggaaagttgctgcaaaatattataatatttcactgttgattggtttcttctttttctaatgctaagttgctaacagcccctaacgcctttttctgtgatgcaccctgcctcacctcatgctgttaaaacccccttgtactttttgggcaccttttgcctttgaataattttaaccagtttctactgttgtgtatgtgctttttccctgatataggtaaaagatatgatctggacttccaatctcctcaaaagtctggacagaattttaagtcagcagaggatatgatagagttgttcaaggaactatgctctggtaaaccattttatcttagtattttcctgatgggggacattataaattatttagcctatgctttgtctttattttggatttttctttttgaatttgtagaataccctattgtgtcaatagaagatccatttgacagggaagattgggaacatatcaagcatatctcaagtcttgggatttgtcaggtattattttttaatcaattaatattttgtttgagttaatgtgaattcaatctctgtcctggttaacttgtgcagccaaagatggatgctatgaagtataccttatcattttggagattacatgatattttttaatgatagcaatggatatttttaatagaaaataataaccaactgattgttagtgtatcaatgccatattgactcattagcaggctatgtgaacaagggaggaaaaacaatatcatataaaattgttttgtcttttgtcacattattggggttgtgagcgttagaaaggtcatttgcatattaccaccgagatgttaagtttatatattggctactgattggaacttctgtttttacagtttcccttcattttgaatggttctgcaggtagttggggatgatctcttgatgtcaaatgcaaaacgcattgagagagcaataactgagtctgcatgtaatgcccttcttcttaaggtaacttgctgtttcttcaattaactttcaagtgtctgttttgcctaatgacaaaatttaatcttatcatgtttttatttttttatattattgttttttaataataaatagtaaacttagttgttcatggactggaagcaatcttgtttcagatctaagttgaggtgttggatatccacaaatatctttttcatgcaaatacaagatcgtaaattacaaagctagtttatgtaaaagaaaaagaaatctaaacatagcttgcctgtaatttagttttgccactttttatttatttttataaatcatttgggagggtattttaaatatcctcctctgtactttttcttctgttttattgaagaaaatacactgaaaatgtggtgatttaccattgtaatctaggtcaaccaagttggaactgttacggaggtcattgaagtggtgaagctggcaaaggaagcgcattggggggtggtaacgtctcatagatgtggagaaactatagactctttcattgctgatttatctgttggccttgcttctggtgtaattaaagcaggcgctccttgcagaggagagcggctagaaaagtacaaccaggtctctttctgatttttatgctgatggttttactgcatgcattatggtcatgattcttgaatacttcaaaaaaaattatttaccaaacttattttgtcaactcaccaattcctctcccatgggaaggtggtggcagttttctatgataggttgtatatttgtgatatcagtagtgtttaagtgatgattttataacctgtaattttgttcattaaagtttgtaaatatgctaatttgttctgtcttgttttaatagcagtcgtactagtacctgagtctgtagatgttattcctctttaggcttctcaccctatgtggcttgatggcaatatctgtatatgattcttttaataataacatgcatattaaaagcaatagctgtgagtctcatgtagagatgaagttgatatttgtcgtgtatgtattctcgtttataaagtgaaacgaaggaaaagcataacagttaccatctgaattttgatagttacttcggattgaggaggagctcggagatcaagcagtttatgccagtgaagattggaggcaataagaatgatttttttttttttttcatattgttctttgagatatgcttttcttatttaagtttgatacgtgtggttgaagttcatccctgtaccatattcatcaactgctgatgttctattgccattacttcaactttgatcgttttgtgctattgggctctggagaatgtttcaacgagtattcaacgatctgtacaagatagtgcggcctgtttatttgtctatattgttataggggataaaaactagcactaattcaatgctgaagttaaaattgttccgggcaagtgatattgattatagttatccaattctttgcattgcttatgttccagcgcacctccttttacagacctgacatatcattagatagattttatcaattttaccttttttatttatttattctatacttattactttcgtgtgcctttataatttaaattgatatgtgatgagcaatggagaaagggaggctatttggtttcctcgcattaatgttttcattttttttctctcccaatattatctagacattttgtaatattttttcaataaggattaactcggtatttttgttctcttttagcataacagagtgcagaaggccaagagattaataccctgaaatttatggaagtcgataaacttgcaaacgttacgtcccattatcaacttgatctactaagtatcctttgaaataattaccaaactagatcgtggcaacacttttttgtatttggttttcatcacagcaagcgagaatcacaatgctttctttactttttaaattggacttaattgtccgataaagacaaacatcataagtaattaaagtaaaaaaaaaaaaaaaaagatttctccttctaatttcttaacaaaaagacgcaggttaacatttgttttttttcttttattttatacttattactttcttgtgcctttataatttaaattgatatgttatgagcaatagagaaagggaggctatttggtttcctcgcattaatgttttcaatttttttctcccaatattatctatacattttgtaaaaaaaaaaaaaaaaaactccaataataaggattaactcgctactttcgttctcttagcataacacagtgcagaaggccatgagatagtaccctgaaatttatggaagttggtaaacgtgcaaaccttacatcccattatcaacttcatctactaattataccttttttaagtcctttcttcaccgatgaacagcttttgtatcctaaatattaattaccaaactagatgtgccaacactttttcatttttagcattaagttaaatttagtaaatggtaaggactaaaatagattactaagaaaatgtaaggaacaccaaagtaacaaaaaaatttagaattatacataattatatttacagaaacttaaaacatgtttatgttacgaatgttgttgattacacttctctctttcatctcgatctttatggatgtaactagatcaggacatttatgttcatagatgattttgttctagtttctatatgttcatgtgagatcatagagagtaatgattttgttctagttgcgtgttatctacaacctatcttgtggttgttgaagagtaatgacacccattacccaacccatctaacatgcatggcaaagccagattggtaaaatcactgttttcagaatcaaaaccgcacaccaatgtaatctatactatctatactatagtatctatactatagtaataaaagtactcttttttgatgatgtgtcaacttgtggtgcattttcagctttggaccttggttcgccagcttcccgttgcttcgcaggttctcacaagaattttcagcttcggaagctacgtgtcagcgccacatttcgtctctgcttctcccagcttcggcactcagcttctctcagcacaaagcgcaaagcagaacgcgggaaatggtcttttagttcacacgctttctcagtagttggtggtggggttctgccaagcaaaaatgacacaaagaccatctctccttctccagccattcatttctctggttttcgtcatattcaccgttttgcgtttcttttctctgttttttttttcggctgccaccgttttggtctgtgaatcaggagagcgattgatttttcgaagtctattaattgtgtcaaagcaaacaaggtatgtgtttttgctgctttatttcccattgtggctcaaaaaaatgatgaagagtgcttcaaaaaacccagagctattctgttgttaagaaaacatctttttgaagataaaacatcttataaaatccttctcactttttcatgaaagtttatgcattccacctatttgttcaaattcttgtgccaatcattttccaaactaagtttatttaggcttgcagttgggttgttataagagaaccaaatataattttggcttttaatatgtcaaatccagccctcatttctctgttttctcagccttatttcttctcaaaccttgctcagtcttgagaaattatatttcatatttacatttttcattatgcctttgaaacaatttatatttcaagtgttgaattattttatgttgtggaatcgacagattgctcatcaaggttctttctcacaaggtgttagttatacgaattcttaggtaatttctctctcaaaaatgcaatatatctctttcttcctgtgctgagatttctgtttaatctggcatgattgcaatgtagtataagatgcggatgcttctttcacatgaattcctgcttcgtgtcccttttcctccagtttttatttggagcttaatttaattaaaagtttctcaatttcttgcttctaataccattttgattttttatttgaaattttgaagacatattatagcttaaaaggggtccctcttagaattaatgcctgataaccatatctacaccccatttaagtccctgatgaaatattgtatgactgatgggttggtttgtaggctcaatgaccttatctatctcttttctatcttcagtctataagctttttgatttattaggtttattcaatgtgtggcctatcttagaatgccatttcctgggtgggagcactgtctaatttttctgtccttgatgcagtctttaatgcctcaaaattattcaacttctaattccaaatgtaatcaaatgtttcgaaggataagtgagtaaaatattaaattaacagtttcttttcctttttcttttttttaaaaaaaaacaaatatggacctatggagtatgaaattggtgctgctggtaaagcttacactaagtgggcagcaaaaatggctatggaacttggtattttggggtttcatgtgcaagcaagatgacacttctgatcctcttgtaagttcatatgaagtgcatgtatttctatattgtccatagctatttttgccttggtgagagtactgcagaactcaacacggcatgctcataaatgttcttttctttcaagaggctataaaggtgttgtttccacttaatatcaaaaatagattgtaaatttgttggcactgcagaactcaacatgacacttatttaaaccttgaatcgcagggattgataggcgagttcaacacgccaaagaatgaaaatccttactcagttgaatttcaattccagtggctgtatacaaatggattactcgcaatcattttctgttttggactacttgtcattgcccttaaaagcagaagagcaagaacgtggccatatggaacaggttaataatccaaaaaatcttacaagatagagcttgtatgtaacacaatgtttttgtgttaggtttcatttatttacttcacaattcccatttcatccgttgttggatttatgcatacaattactagcatttagccggtcaacgcatagaaaatacaatgctacaaggtgcttggatcactgtctggctgggctctgctttttgacccatgtaccgctatgggacaaataaaaagtaaatcatgtgcctgttgttttctggacatgtagtatattccatattttgtcagtgataaatgataagaatttggaaggttttctattccttttttgaatgtttcttgtaaattcgaatttttagcttgctgtgccttgcctattttttaatcgatgatctggtcctccttgccaatataagtggtgctggtaactcattcagaattatcctttcggatcttcacatgcctgaaatggatggctttgaaatggcaaagagaatcaggaagttccatagccatagttggcccttgattatagctcttataacaagtgcagaataacatgagggagaaatgcctacttgcaagaatgaatggattgatccaaaaacctatcgtacttcatcagatagcagatgaacttagaacagtcgtacaaagagcatgtgaaaaactgagaacagttttaaaagcatgcttcggtttaagaaaatatgatttcattagtaattacaaagaggtcatgttattttagttttgtttcctattttcaagcattgtgggctatgcttttattattttgtgaacaaattcttgaaaataagaaacaaaataaaataaggtgtcttttataattactaatgaaagagtgactcaattttctatagttgctcaaaacggcattgtgaacttgggggatttctaacaatatcaaataataaaaatagccggtttattgatccaaaacaaaacatggaagctactttcatctttccttggctgtcgatgtcatgtatgatgtcttctatttatattttgcagaaataataatttagttttgccaatttaaagctgttgtaacttttggaaattggattgattcataaacttttttatataaagagcaagatataagattttttcatgtaaggaacataacaaagagttataatttaaccttttcattttgagtgtccggggtaatttaacctttcttgacatacatataatatatttaacccagcaaatgcaagtaaatttgtgataaagaaaaaacttttcaatcatagcaaatataagaaatttatacttagttttacataaatggttttccctctttatttttctgttcttttgaaagaggaagagtttattttattaggtatgtgaagtctaaatcattatttgtgttaacaacaaaagaatggtctgtatggaaatatcagtaacacattaagaaaaaagaaaatcaaattaagcatgaatggtggacagactaaaaatgacttattaaacaatactaaaataaagtgattttaatttgcaaaaataatttttgttacaataaaattttaaattatttattcactatatcataacgtaaattaattttaatatcattttttatgatagaaactacaattatcatttacggaaaataattattttctatggcatcatgagtgaaccgttatggaaaaattttctttttaaaataaagtatttaacatagttacatatcaaacaatcaacaatatttattttattaaatatattatttatttttaaattttcactcatataaaataatggataaataacagtaaattaaaatgatgacatttttttaaaataaaaatattttgttttattatttaaatttaatcaatatttgaaaattttaaactctttatttaattcaattatcacgttaatcaacgtaataacatttagttaatatatttattagaaaattatactttgattttttgttataggaccatcaaagttaattaatttaaattactttatcaatgataccataaataaaaatactttttagttatgatagagataaaaaaaaattaatttgtaaacatgatttttggaacaagaaatttttaaattacttagtcgtcatattataatgtaaattagttttaatttaatttctttatgatagaaactataattatcatttacgaaaaataattattctttggatcatcatgagtgaaccattatggaaaaaaattaaaaaatatttaacatagttatatatacaaaaatcaataatatttatttttattaaatatattatttgttagtaaattagattattttataaggtctatgaaggtctgaaccattatttgtgttaacaacaaaagaatggtctttatggaaagaacatgagtaacacattaagaaaacagaaaaccaaataaagcatgaatgtgtgggcagactaaaaatgacttattaaacaacagtaaaataaactggttttaatttgcaaaaatgatttttgttacaataaaattttaaattacttattcactatatcataatgtaaattaatttaaatttcattttttaatgatataaactacaattattatttacgggaaataattatcctatatgccatcttgagtgaaccgttacgggaaaaaagtgtttttaaaaaaagtttttaacgcattcacatataaaaaatcaacactatttatttttattaaatatattattttgttggtgaattttcatcatataaaataatgagtgtatggctgaatgaatataagatggctgaatgaattaagatttctgccagtgcattgaaaagtttcagcttaatattaatgtttgtatttttttcataattgcttactacatatttctgacaacatttattagtaattttaggatgtctctaatgaaatgtattattaccttaaggacacaggtttcacaatagtctgttttgaagaaacaaccgcatgcaagattgtgtttaaccactggagaaagagcgctaaaataggtgttggttgaaaaggttttgcacgagacaacaatttaaaagctgacttcgagtttattatggagtttccatacccaagtagcaacatagtgtattggtggatatgttgatggcaacaaacaacttttaactgtcactttttaaatttacatgttaatagaaactctatgcaaaagttacaagttgtcctagattctagccactgtctcttcaacttatatgctttatattgcactgttatgtcctgcagttgtatggataaatatatatatatatatatatatatatataagttgcttttatatttttctctgtcttttcgattaatgttaacatgtttaatgtgataatgtgcattgtaatgtataactaacccgtgcgtatgtgcacgggtcaaatactagttgcaaaccaagggattgaatagctatcactatcagcaacctcggcgctcctccccttctattgtgtagcatttttcttcattcttaaaatttttgtacgaacactttggaaccgtgaactttatggaagtccatataggtttcaaacattaagtttcattttgaaaaaagtttttcttacaagagaaagattgatacgataaataatgcgatgtaataggatgaaagaaataaaataaaataaaaattattggtcaagtgttaaaaataaaaggttattaaaatatcatcacccttgagctactagttatactttttaaagttatttcttcactacacggtcagtttttataacctttgcaataattaacaaactacactgtgggtttgttatttgttttagatatactttatatttagttcagaattattaataagttgttgatctaaataattttggattcgattttcttaaataaaattaatggatattttacattaatatcaacagtcataaaaaataattatatatttattgacaatttagtatctatattttttaaatgatcaattttgatttacaaatgttgtgataaagtaattcgaatactcaattacagtatcaaattaaaaaaaaaaattgtgattcggacacgggttggacactgctttaggaggaaaaaagaataagactacaattattatttaaaataaaatattaaatattaaatatatgtttgttttaatgtttgagcggtcgttcagacaaaaataataaattgttatttctcacaaattaaaatcacactttgtaatttgtgcgaacggaaagttaataaaatacaaacatgtcctaagaaactagaaatacagatctattgcatgtgccttcttatctatttttcgctttatctctgatgtgagatttggctctcgacttccattgcttcccagtggcttgtgagtttttatttcacacacccctatttccattgctttgtgattttgtgttatttctaatttcgtttggggagttgggcttggtacaaatttctgttgaataatataaatttaatttagtccattaaaatcaagtgttaggtttatttaaatttgtgttactattctaaagaaaattttaaaaaaatgtagagataaataaaaataatatttaataaataattgaaaaaagtgtgtataaataaataatttgaaaaaatgaatagaattctttcttgaagtgtgtgaatttttttcttgatatttttagatttttctcttgaagcatataaaaagcaaggaaattatcatttgtaaactaattcaaaacaaaaacatttctcatataataaaaattaattttctttcatatattgtctccttcatttctctcaaatacttcctataaccttctccttttaacagtttctaacctttcccctcctgcacactgcaatcataatatcatatctataaagtaattgatttctttaacactgttataaatcatcacataagggagaatgaatgaaacagtaggtgaattgcacatattcttctgcgtgtaaattttgactatgattttgaatgtctatgaaaaaaatccttaaaatcccatgaacataaaatgatataaatattcttaaaaaaatattataaaataagggcaatttgataaatgtataaacaaaacgttacttttccacttctctgctcaagtatagaaatttgtttttaaaggtgggtttcacttagatttcttttatcttccactattttgcacaattcaaaagtgacaacaattgtaaaacactaaaacttgaagttgacaatctggtgccctttccatccatccgtccaaattcttacgaaacaaacgtaccattagttagatattatttatgattatgattactctgtttggcggtaagtggaaaagcacttataaactaaaactgaaaagtgctttacatatatactctttttcctaccacaaaggacatgaaagcacaaagtaaagcagtcccaacatcaaagctcgattcctgttaactacacaatatgctacatcaacaccagcaaacacagtcatgttgtgtatttttacaaaatatacatccaataatgtgcaaaataacgtggtcagggaaaggaatgcaactacacaaaacgtaaaagagtaccatattcgttaacccacaaaatatcttcctacaaccgaatttaaaatccataagaacacctaatattaaggtttaatttggttcaagcaaaagcgaagataacccttctcaccaatcgggtaatgaaccacaacaggcagatgcagctggttcgacataaagatagtgactgtattagacaacggcgttgccttggtgaaacagttcaaaaatgtcaatccaaaattcaagctcacagtctgaataatctctatcacagtagcttcctcatcagcctgtatgcattaattgcataaacaaatacacacattctaatctcacagagagtaatataagcccaaattacttattgttacgttaacgctcatgaaagaatttggtgctagtgaacatgttaccttgtggatggaagtattgttcctgcggactataattgaagtcccaatatctcctttgctgctaaaccccacactctcttcgttaaccataatggaaactaaaatacagcaacacatatgaaaaaattaattaattgcaaagtcaattaattaaagaatgaagaagcagcaagaattagaaacatgcatgcaaaataaaatgatgaacgtaaagtaatgcattatgcatgcatgcaaaagagaaaaatatatataggaacgaattaccggtgtccccaaaaatagagaggtcagtgcaaattcttgaaaactcagctgaaggcatcttaacataggcatcgtaaatcagctcctcgggaaaaacgcattcgggcttggtgtctatatccaccagattcatcataaaatgagatatcttggctcgcgctataacacacacaacaacacacgaatctttagaacagccctagcttacgttctatcttttcattcatcaagtaaagggaaatgcataaatcttaaactaacaagagagagaaggaaaacaaacgtactagggctttcgatgatgaagttggcgaagtggatgccatagtcggctttgatggtgatggtgtcatcgtcggcggcggaacgcaggatcttggccatgttgttgaggttgacgccgatggagatggtgcggtcgcagcagtagttcttgaaagcatcggattggaggaagatatccaccacttccatgcgggtgggatctatggcttgcatggagaagccgatctgggagaaattgaagtttgtatcgttcaccttcatctctcttatggcctcaaccatgttctttaggactgaaccttgcatgcgagcttccaccatcttctttcttcctttcttgttaatttctattttcaagcaacaataggacgagtttatttatactttaatttaatgtagtgcaacattctgaggccactccgcgggatttttctgtcacttcaattcccgtcattaccatcaatttttttttacttaattgtatctttgatttcctaaatgtgattttaatcttgtgttccaattgcacaaatatggctttcaattatcttaattgtgcagttttagtccttctaattatatttagttttgtaaaacaaactacatttatttaaatattttacaattttgttaacattgcattggatcatgcatgataacttgcacttttaattttaatgcctcacgactacaatatcataagaaacaaaaaatgtaattaagttggacaataaatcatcaacatgatatcttatatataatatcaagttaacaatatttattgaatagacaatccatttgacaaggatgattggaaacatacaagtgtatatcttaagtcttggaatttgtaatattatttttctaatttttaatcaatgaatattttgtttagttaatgtgaattcaatctctgtccctgttaagttgtgcagccaaattgatgctatgaaatactagcaggacttttcatttttggggattacatgatatttttcaatgataacaatggaaatttttaattaaaaacaatagtaacaaactgatttaaatgtatcaatgcgatattttttttatcttcactctcactttttttttattgaatttcctatattacttgtgtagttatgtcccttcacaccctccattccctctcacccgtttctcttctctcccgttcgcactccctacccccttcccttcaatatttgtcattggtcgtcatttgttatttgataacaaaaaaaatgttaaattagtgtgctataaaatacacgagtcctaaaaatatcaattaagtgtggattgattcgattttaaaaacactaaccaaaaacttattcaaatcaatctattataaatataaatagtaaaaaaaatgaaatagtctgtttcattggcttttgtttcttttggatcgatttttttatttttcttatttgattagatttaaacattcctactagacgtgtcacataggatggtatgtgaacaaacgagacttaaaaaggggacctacttgaatgatgggttacagaggattatctcttgtttcagtaaatttaaggactacagtgaccatgtttatcttattcaagaactaaattgagagtttactcgtaaatttcgaatgattcttaagataattataaaagtaatttttaaaaagctttgaagaaaacaataagcacgggaaaaaatataaactaaacatttgcaaagaatgaaactttcaaagcagtaaagaaattattgaaacttgaaagattatgccaagggctttacccaccctattaaagctcaataacaataaacgtcaattgaaccatcacattagcttggggaaaattcttctgggcctcattatgaccacttaggctcaaataaacaaaggttaaaacaccctttccaaaatgaaaggaggtgttggctaggtgatttttttgggatgcgggaagagatgcccataaacaaataaagcaaacacatttattcaatgctattaaacccaaggaaaacattacataaacactcattatgttatttaacaccgagagaggagaaaaaaatgtgtgtatatatatatatataacaggatttatgatataataaaaagagaaaaataaaaagtctgcaaaaaatatttaaaataatgaaatatttaggtatcgttactctaaactcaattatcttatcacaatccatatattaatgcttttgatggcttcagaacccttcctttcacatgttaagactcatgtaagtgtaaagtacgagatcatgatcacaatctcttaataataaatgctacaaatcaagacattcattttagaaccatcacttatgtctcatcatgcaaaaaacactcttatagattaatattagtacagtccgcatgggtaagttacaaaattaaatatataatataatggtatatatttagttatgattgtgtaaaacttagtaaatgagaaacaaaagtaataagattggaatatgtaatatattttataaaataatgatgtatatttagttcataagttcacaaaatcaaagtactatcatttttgcaaaatttcactaaaaaaagttttaaacaaagtttagagagattgatagagtatgaagcacttaaattacaattaatcaatccacaatagagctagcaaagttagatttggatatgggaactcaaatataattttgtggacaaccttcaaattatgttaatttgcaaaagccttccatccttgatcaatctttgcactctttcttcatttgtacaatatcaaataagattcatctcctctaacgtgagaagttcacattaaatgataaccattaattaaaaatcaatggagttaagaatttcataatttaattattatgcaggagcatatatttatcacaatctcactttaaatgagttattttcaacaaatctatcaagctttttgcataaatgataatacgaccacaataataaatgatacaaatacttaacatcttattacccacctaagcacgttacacctttatttcatttttattttcatcttctggatcaactatcaatctagaatcacaatctaatgggaaaacctcacaaataacatacttaaaatactaaggaaaatagataattaaaacaaaaaaaaaattacatatacacaaaacacaaaacacatccactactatagcttaataagaatcctatatagtttcatttgtttaggacaagtaactaaatatattaattaccattcggtaacacgtttatatgaccattgcagcaaacctcttcagtaacttcgcttttcatcttggtctcgaccgaatcaagtggatctactgtttcaaaattatatatccattatagaagcagaatggccccatcccatctttagatgaacaatcgatgaaaacaataatgaaatttcccataaaattacatctttggttacttttgataattcatgtcacttttttcctagaaaatcacaacaacaacaaaaacaagggtatcattaactgttttgtgagtttgatcttctgtgataacattgaattgcgaaaagaatagtaattttaaaacatctattaattaacttttcaatttcacagtttgactaaaagattctgtttgtcgtgaatcttaaaatgcccaatatttagtagtagctttctattcatccaacgtttgttgtggggcacattgtcaacaaaactcgtaatgattgtttgttatagctgaaacactgggtggccgttgtttgattgcgatgggatatgttggcccatgtgagagaggaaatccttaaactaaaattgtataggccaaatattttaatttatgagattttaaaaattcttcattgtttatttataaatttagtaaaaaaaatcatttatttaaattatttttcatcattattttgactgtcattttgagctaacaacaaatatatatatatatatatatatatatatatatatatatatatcaagctacaatgtgatttttataattcttcaccggttcttaattttgtgaggaaaaaaaacatttatttcaattaattttacaatcattttgcataaatttaatgagtactgaaatgaatgatatatatttgacaaattgtaaaactaactaacaaaaagattttaacatatcaaaaactaaaatgtccggctaactaatatataatgaactaataatttatttaacttttatattcggggaaaagtattagctccagtgtcagataacatattcgagaatgaacctcatcgtaataatcacttcaataaggttatacttccttcgttggttatgaaatctaagactttttttataaaaaaaattataagatctttttctagtttttaaatgtagtaattatttttttatatatctttgcttccttattttttttcaaacattaataaaaaataattaaatagataaaaataagaaaaataattttaaaataatactacaaataattgataaactatttatttctaagaaatatgaattaattaaaaaacgatatagtactagtatatatcacaactttgcatgtaagtcctgctaattaagcaaacattaatttgaagactttcaaacacagcaattaaagtctctatataacctcagtttctagccatcaaataaactctagcctttacaacagagccatttccaagcttaaaaccaggactaactgagaaaccaacaatgtttccaggaggcaccctcccaccagcaaatttcagcacactctccatgtaacgcgggtggaactcagctccaccacttgcctcaaacttacttggcgcaggatcaaacgagaacgcaaccagatgaagcaaccacactccctttgccacccccaaaaactctttgtaaaaccgagtccttggatggttcccttcagagactagactgtgctgctccaaatcaccaaacagtgactcctccatcttggggtgcacaatggaaaggtacttgttggagcagaatttcccaaaattacacgttggtaaaactcctccaaggagctcataagggtccatggacttcatgtggcagtattggctgaagcaatcgtggcgaaactgagcagggttgaggagggaggagagggtgctattatccatgtagaaactttcgtgatcgaatccttggaacattttcttgtagatgtatgattcaagggcgtacttggcatgaagagttgagaccgtggtggaggtggcggttactgaacaaatattattattattattatagtatttgtcggtggtggtggcagaagctgcttccatggaacgaactgcggcagccatgtcccattgtgcgtcgtgcatgagcgacaagagtagagatgtgaaggactttgatgcttcctttacttgcgccattgttgcttccaagagttctggggatggtgctgctacaaaccctgccgctatttcatgacaccaatgtcaaaaggttgcaattggtataattaagatgctcttcttcttttttttctagacgttgaacaagaaagttaacatatataccaattgaattttctggctaaccaaacacattttttttctaatatatatatacacataagaaaaatgttttttttacaataaattgtataacaaattttacaattaagaaaaaaaaaagagaaaaatataaaatataataaataaataaataagtgttattgtataaattataagaataatataaatcacttaagaaactctactaattaaaatgagtagattgctcttcattaattattgaaagtacaccataaaaaaatattacacgattttccctccctctctctctctctctctgtatattagtgtgtatatatatatatatatatatatatatatatatatatatatatatatatgtcaatcttcatttgatacacaactgacttgtattaaattttttattataaacatataaaaaaaactcgactatatatatgtgtcttgtatgaattgacccatctaatcattttccgcctagctatgtcaatttttaagtggatcggaagtaactgagtttttaatttgaaaagtgaactatgacgtattaatttgttttaccttgaatatgagtattgcaagcaagctttgtcttagtgtaaggctgaggcctccgagctttgtctttaagtttctgaagttgcaaatccttggccttcacttccttcttcagctctttcatgagtgtctcgtagggtgcatgccctcctcctctccttctactcttgccttcttcaacacttctcacactcccatggaacctgtccctcaacagaccaagcttcttcagctgtgccaccactgccacgtcagcctccctcaagctctgcgggtcccacgggcagtgtgcttcctgcaagctcacgtacgcactcttcattgccgataccgcttcgaacacctcctccattaacgccctcatcttcttcaacttcttttcctctcttgaaaccttcaaatccatcaccattttttcttcaccgaagtaaccttcttcgctggcatcttcgtcttcgtgtctgtttcctaatgagccgctgtggtactcctcttccctgtcgccggcgtcagacctgtcattggtgaatgggtggaggaagcaggaggtggtgaccctttggattagatcggagaaattcgacacctttctggtcattgcttattgctacgtaagcgtttgtgcgaaagagaaaagaggaaacataagaataagaaaaaagatggtggcagctgaggtggaccacagagtggggtcagtgagttaataatgctaaactaatcaaacaatggatgctccaatctaacaattaagaacctgtcttttcacatgtgatttggtgcttataaatacggactttgtttgcacttatttgttatttttagaaattaagatatttataaatacggactttttaaattttcatatatgtacttatattctgctaagaattaagcatctcatacatagtaaaatatttgtttatttctaatttcgataactttgtatttttttaaaatttcgatatgtataatattttaatttatttttttataattcttgaaatacttacatatatcaaaatataaaaatatataaacttacaaagaataaaaataaataaaatattagttatcttcttattattacccaatgtttttttaagacatttcattttttttaaacatttttcgctaatgttttcttcttattacccatccatgtgaaaaaaagtagtagttatctttcaatgcctactatttttttgggaagtgcatttgaatgatttgaccatgtcatgttgttgctttccacgtgcgttcaaacaatttgcgcctcttgaacacttgattgaatcactaacctaattttaatggatcctaactttgttctaacaattctaagtttgctattaaccgtaagctatcaatcgtcaacggctaaccgtcaaaaatcaacgataacccgtcatcaatcgtcagttattaagtatcaagtataagttctcaactattggatattagatattggtcattaactaaagtggttgcctcaactcctattttgataagttaatccaagcctaaaaggaaatctgaggtggagcctttttaaaattaatataagtaaaaaaaatcaattagggacctcactaatgcataaagaaaaatacatcttagttactgctacactaaattaactaataataacaattgtataaaaaaaatgttaacaacactctctttaatagtttttatctctaacattttctctatttttaactgaaaaatattagaaattataatttttagtaaatctcactgtttatttaatgaagttcaatcttaatattttaatggattaatcttttacttttagactaaggatattcctgagttaaaaaaaaaatattttttataaaataaaatgaaatatacatgggccttgtcattgcccatcttttcccatacgtaacacttttccctttgaaatgcaatagtaatattggactatttgagttaggtacttaagcattacaaattgaacactgattcaagagaatactttcacgaaacttttttgacataaaaactttcaccaaacttaatttacacagtttagtaagaaaatatgtcccgcattcttctaattttttaagaaaactaataatgatatcttttgtgaaactactcctttaggtcagaaaattgatataaagttagactcaagcttagcatcacagattcactagaagtcattgttttcaccccttgttagctatgcctccattctgcttccaaaagttcgataataacgattttcgtatcatacaattgatgaccaacccttaacttgaaaacttcatgaaatcgtccatctagaggcgctacagaggtgaattgaacatggaattgtattgaaagaaaggatttaatcaatgcacagatggcattcacgagcaagataccttataaagaaatttggcacccatttttaataattaccaccctactatgattggtggcctttaaagaaagcaaagcaaattgaattgccaatccaaagttccaaacccataacacccgaaataccaaaaagaaaaaataaatgagaaatttcactagtcccctcaagtccgtgcttgagctcgtgtatgtgagagaagtccattcctttcattgaagccgtgatacctatgtggcatacaattgctcccgtggaaaatgagaacgcaacctagtcactgcatgtttcactctacatacgaaacttttttaagaaaaagtacaagaaaactaaggataattataatacaacaaactcatccactcatccagcatcagttaaatagatgccctgaactttgaggcgtttgttttatgtcattttcttctattaatttctagcaatacgaaattcattttaattaaaagattatgaaaagagattttgaagtatcttttatttgtagcaaagtcggtccagcatttttatcattgtcttataacgaggaaaaataaaataaaacagtatataattaccgagccttttcaagtgcaagcaaccccattttaattggttttacttagtaaactgtagctacccacgtatatttatttattggcatattctagtagtgttaaattggtttaacccaaccaatgaatgtagctgaattgacaaacacaaattgaatttgttaaagaagatctagatttaatttttgaaaaatacaattttaaggaagaggaaaaaactttaaatataaggaagtttaaaactgaaaattaatattataataaccagttcgaagctcatgagaatctcgagatccaatcaaataatcaagtaccctaattaagttaagttggttggaaaagaaatggattaagccaagaaagaagaaaatcttaaaaattgagaatgatatatacctagaatattactcctagaactagatttagaatagaccaagacaaatgcatggggatgagaggtgaggcaagcaagattctgaacggtgctcattgaagcatgaaattacccaccctgccagcctgtccctttcatctccttcgaataaaagaacggttcaaattgtgaaatcccttcccctcggtcttaccccctataattcgttccttccacttgcattgcatttgcaattttccatctctatcctacgaaaatgtcctttgtcgttttttacttttttccccccccaacgacagattttttttataaataacttaaaaaaaatcatcaaccaaggtatgtaatagtatctacactatacggctcataataatagctaacaccatttgcatattaacagagtcacacaccaattctgaaccacacactcacttatttgtttctttcaactgagacactcacaagtaacaagtcacaacacacacacacacacacacacacagtaatggcatctatggcggctataggttctctgaatgttccacgttctgcttcttccccttcatcgtatgtgggaagaaaaagcgttccacgccgcctttcattctctgcatcacaattttgtggagacaagattcccacagattcagtttcattggcaccaaaaagaggtcgcaatccagtgattgttactcctaaagcagtttctgattcccaaaactcacaaacgtgccttgatccggatgccagcagagtacgtttacctcctttcttcatttttttgtctctgtctttgttccattgttacaacattaaattactgagaaatttcaaatccccaatcatatgtttattagggtgtatttgtggatcaaattgtaaacagggttttttttagatcacaatagtttgaatttcgatcgtgtgatatttgaattggatgtggattggttctggttctgattctgattgcaatttaaaatgtttatagagtgtgcttggcattatacttggaggtggtgctgggactcggctttatccactcaccaagaagagggcaaagccagctgttcctcttggagctaactataggctaattgatattcctgttagcaactgcttgaatagcaatgtcaacaagatctatgttctcactcaattcaattctgcgtcgttaaaccgacacctttctcgtgcttatgcaagcaacatgggtggctacaaaaatgagggatttgttgaggttcttgctgctcagcagagtcctgagaatcctaattggttccaggtaatgacagcactgccttgactctaaattttggtaccttgcgatgatgacttttgctgtcccttgatttgatgttttaacaaacttggtgtgatcattgcagggtactgcagatgctgtgaggcagtatttgtggctttttgaagagcacaatgttttggaattcttggttctggctggtgaccatttgtatcggatggattacgagaaatttatccaagcgcatagggaaactgatgctgatatcactgtggctgcattgccaatggatgaagcgcgtgccactgcatttggtctgatgaagattgatgaagaggggcgtataattgaatttgctgaaaagccaaaaggagaacagttgaaagccatgaaggtaagcccgtataagatgtattatatgttgttatttatctggaaattattacctgaacaattgcttaaaaatgccagtcatttttctttactaggttgatactacagttttgggtcttgatgacgagagagcaaaggaaatgccttatattgctagcatgggtatatatgttgttagcaaaaatgtgatgttagacctgctccgtgagaagtttcctggtgcaaatgactttgggagtgaagtgattcctggtgctacttctattggaatgagagtatgtgttccttccggttatttaatattacaaaaactttcctgttattttcttgcatggtaaatttagcatgcaattttttgagaatattgtacggcatgtttgtgtacattcacaggtgcaagcttacttgtatgatggctactgggaagacattggtacaatcgaggctttctataatgcaaatctgggaatcaccaaaaagcctgtgcctgacttcaggtaaattatataggctatttgatatatctatcatattgacaaatgtatttcaatgatagtgttttgtggttctgatgtttatgtgttcatgcgttttggtatattggttacagtttctatgaccgttcatctccaatctacacccaaccacgatatttgcctccctctaagatgcttgatgctgatgtcactgatagtgttattggtgaaggatgtgtgattaaggtaagcatttcagaaccttcacattctactgatctgctctatacatgagatttatacaattcttaacaaagatgtcaaatataatgagaataatttatttataggaaactaaccttgtattccatactttgttccatagaactgcaaaattcaccattctgtggttgggctgcgatcttgcatatcagaaggtgcaattattgaagacacgttattaatgggggcagattattacgaggtaataatgtggctaaataacttgtgctcagttacacctagtttttccaagttttaatagccaacaaagtttcacatgtcaaagtggttgaaacacttagatattcaatttatcgattgtgagtttacaattgcatgtgaataagattaatacgattggctttagtttgactagaagttctaactgcaacattggttttctgattgttgtgttccagacggaggctgataagaggtttctggctgctaaaggcagtgttccaattggtataggcaggaactctcatatcaaaagggcaattatcgacaagaatgctcgaattggggaaaatgtcaaggttataacatcttctattatatacaattttgttccttgttttacattctaagccaatttttcccaagacaacaggtgaggcgtagtagcttaggtgattttggtattgttttgtgaatcaaaattggagtttcacctcaataacctacacagttaaggttgatggttattgaagtcaaattttaattcagtatcaaaaccacttaagaaactatctcttttataagttaacattcattgacaagttgttggttatgtcaataattgataatttaagtaatgattgcatatttaattataaaatttgtgtgattttctttctatttaattaaagatcatgtaagatttgtaattaaatatgcaatctaaatcattaaatttatctgatgattgtggttaaatattctcatttctcacaatgatacaataattaagactttttttaagtggtcatgtgacactaacttttaattttgaccatttatatttagttgtatggttgaaatttatagatctgatttctcagtaaaaaatagttttcatttgatatgtctcctatatgtttgtgtggacatatcaattgagaaaataataaatattgacccttagattttatcatgaatgatcaagattaaaatatataagtcatgcgttttatttaaaaaataaaataaaatcatgtaatattttaagtaataatctatcttcaaaaaacttttaatctcgatcatgagaatgatcactcatatacaattgtatgacttggatttcctcttcattgggataaaaatggctttctcactaaatatatcaatttttttttttcatactgtgttgccatactttgttttcattcatgtgacatgttacgggatattttaaatctaatctatggtttgtttccaattctcagattattaacagtgacaaggtccaagaagctgcaagggaaacagatgggtatttcataaaaagtgggattgtcacagtaatcaaggatgctttaattcctagtggaacagtcatctaaacaccacaccaccaccccaaaaaatttcttgtaccccaaatcctaatggtgactgcgaagctcattaccaccgcaggagagtttatcgagctttgcttccacgtctaagataggcttttgtgtttcatgatatatatttttgggcagtggcttgtaaataatagcggaagagaaggcccgctatgagcaatcacgctgtaaagttcgttaatcaattcaataaaagtttctttatttcgtactaacaatactatactcgcatgctcgtttatagtattatattgcaacttgcaagggtgaccaagtttggttggaaaatttcagctaaaatggttggcagaaacaaaaatgcaaatattgactagagcgactaaaagactatattccgctgttatttgggacgtcctcataatcaaggatggaacttaccttagagcaaggtagcctccatcaaggttttatgatctaaaatgattgaaatattactataatactatttataagtaaacataatatgaattgccatgttaaaagtagaatttaaattatattgtgagaaggaatttaaggaagcgttacaaagatattaaaaaaatttctatcaaggaaacagcatttctgtacggcccaattcggtgatccaatatccccttccaacaatcattcgccattgggtgttactattgacccaacaaaattgttcttggcccctttcagacaagcacaattatcaaactaccctttttctacaccaccttacattcatgttgccaagtattttgttttcattttcatggtcaaacgaaatcatgattctgttgtgaaattttgtatagcagaatcacaattttgttatttttggtattgttgatgcacaacaaaatcttgattttattatgcgaaatttcgcattgtacatttttttctctgaatgtacatttctctttttcaggaaaaaaatcaaaaataaattatgatttcattggacaatgaaatcacgctttcgtagaactgtcatattttaacccctccttgcacaatgaaatcacgattttattgtatattttttctctctctgaaaagcattacattatcatgtttccactgcacaaaagggtgtgtgaattttttgcacattggaatcacgaaaccgttatgcctttatgcaatagaataatgattttattgtgcaaaaaattcgcaccccttttgtgcaacagaaacacaatgctttttagggagggataatattggatttttatgggattgtaagggagggcaataagggaggggaggaatagcgaagatatgaggaaaaaatagtggtaaatatttatacatagatatttttattaaatcctttatataaaatagttaacttcattcaagttaaaactttaaaataaaagatattattataaatttataactcgacacaaggtaatttaaaaaaattaaagctataaaaatgattagaaattaataaaatgcagaatggttaagaaatgaacaatatattgatcttaaaaagaaaaaaaaatgtaaataataattttggtctctggatatatatatattgatgataatttaatcattaaaagaataaaaaattcaatataatctttaaatgtgtaaaaggtgtgacacttacatttttagtataacttaatgataaattaatcattaaattttacaattcaataataaatttattcttgagaaacacaacttattattaaacttagttttttatatcattaacattgaatatttattaaaagataataaacacttagatattaataaattatatttatttactgatatgaaaattgcaagtattaaaatgtagaagcaactgaagactctgtgacggaccatttttgttagcgaccgaaatactaagtattagtaaatcagaaatcagtttctatagcgacttgggttttagaataccgcaatgttcggtctctgaatgccaagaaaattagcgaccgattcgctacctatatagcgattgatttttggatcgctaacgaaggttttttgtgtgtatatatgttaaatgcttgaatgtttaatttattatctcatctgagacttataataaaaatatattttttaatatatatatatatgtctaatattataaaatttacttattgtctattgtgaaacctttgaaggattaataaatttaatagttatttcctttatttattctatatatcatataataattttttatttattaattgtgtatctaaacatgcaatattgtaagttttttttatacggtgaggttgtttaaacttattattaaaataaatgtttattttaatataataagttattttctgtttttattgtatttgtctaaattatttttactttaaaaatagtttttttttttattttacaaaacaaattttatgtattttatgtatttattttaaagttttaacaaaggtgtcttacataattttaaaatttttgacccgtaagaattgataatgtctaggatttacaataattcatgtatcctagtaattcatctcatgctactcaatcatcatctcaacaatagtcagtataagtataatttttaatttatgattaaaaatgttatataatgttaaaaaattataggtacgtttaattaaaatcatgaatacgtacttttttaggttcagtgaccgctctaaacctttgacccatttgacttcgccttctctctgtgtatggactgcaataagatatctgtgttggtctgttgtctgttctgattttgaatgttcattgtgtatgtaaaaattgtacttggtgtacctcactctgtaacataaattgaattgaatagtataaacaatttatgtaactgtcattttttctctcttgtcattcgaacgaggagtacgataaatttggctccgaattattactttattgttaaatacaaagtttatatagtaactttttagaacccaaacagtactatctttatttgttttgttagttgaaactaaaaaactaatcagcaataactaaaacaatattatgtttttctttttttattcttttacaattttacaatgggataccttttttaaaaactaaatacgtgtttggttccactttccagatccatgttcggagcaaaatcacattaaaagtgatgcaaaagtaactattaattatgttagggattaacgttttgcaatttttaatgtgttttcaaaaacaccataagtccaaaatttaatgtgaaattataatttaaataaattaatatattttagtagcttagaattaattttatcaaaattaatcttacttaattttataacaaacagtcccaaattgacgaatacatcgtgacaaaataaacagtgtgttcttaacatatataccatgtagaagttgtagtacgtactccgatatcataagtattaaaatcttagctgtgctacacggatccaaccaaaaaaaaaaatatatatacttccactaaattgacaaatacattgatgacaaaataagagtgctgtttacgtaacatggagaaagtcatagtacgccaatattcttgttttagctatgctactatcactatatgacaaaaacttatcattgtgggtagaaaatatgaaaatgactctgaacatatgaaagcatttgacaattttatattaatacacaaaggaaaaagtaaatcttattatttcgtatttacaaataatactttaattgtcattttagtagggaagaataaagaaaaagaaagagaaaactttaataagcctcatactttcaccacgttactttaaattgctaattagacaattttaaactaattgattcatacattttatgattaacagtaagataaatattaatcagtattaagttaaagaattattttattttgattaaaatacataaaattatattattgataaaattttgtgttcgcttgtaatttctataacaaatactctgtgattttaattctttaactatattttgaagacactgctggttagtaaaagtgttttaagaatttttcattatttgtttatgaaaaaaaaatagtagtagtatgaatgagagagacagaagctgacagtgctactactgctctctggtgcctagtctctcctcctgcttttgactgtcacattctgccatagcttcccagccagccctgctgtgctgtgccgtgccttctgcttggcttggctggctccatcttcgatgttcttgttctgtttccgcatgtgattaagaatttaagacctcaccagaatctaatctaatcttgccgtgtcttctgctcttttttcttcatccctctgatctcatcaccattctttctttcttccgtattgcctctcctctcagttctcaccttgcattgcatctttttagacactccccaccactcacaagtcacaacactacaccaccaaccaaccgtcttaagatttttcactactatacaacaactgggaatctgggatattgtatttaatatgtagtaataaattttgataccaatatcacattcaccttaataaaattggattcagatcacttatatcaaatatgatgtaaatcaataattcgctagtcagaggggttttggagtcatattaaattcatttttttcttaaataaaatcttgaatttaaattttatgaataacaaacatgattaaaaaaaattactgatagtaatcaatcacttcttcaatagaaattaatcattactaaaacttgtagatattctacattaatatcatagtaaaaataatcaaatatgatgtatggaaccttatataaaatatgatgagattaagattcatttaaaatctcattttcaataaaaggtataattattctattagaaaaaaaaaagaacattttgataaacaattaatatcctacttgtggctgttgtaggtgctcgtgtttcagttttcaaatttaaatttgaaaataaaatctatttgggtaaaaaaagagtgaaaatgaatttttaaaaaatcttattttaaccttttaatattatcgcatcttcttcgatactttcgttcacacctcttcacctcctgcaagtattcaatttaacataaaggtgacaaaatagactcaaacaattgactcggccttaatccacatgttgaaaaatataagattcaactctagattttgattatgaattaaatttaactttttttttattaggtttaggtcacaatagtctgaataacataagtttctagtgtgttttgatctcattttagaaatctaatttaaattttgactttttaactcaacttgttataaattatgatccagatcaagtatgtaaacgacttaactcgaagcacactcaatgaattgtagccttgaactttaatcttgagcacaaaataaatttaatttttttagcctaatatgatcatggaaccatttgggcttaacctaaaaaaaacttatgcaaattggtatttcacaaaactttgacattattttgcaaacgttgaatcagggtagactttttggtttgactccatgtagtcacatttacatttcacctaagtcatatctaacttgatctcgattaatgtaatagattgatctttaatggtgtgttgggttgggggaaaaaatgaaaaagaataaatcagaagaataaataagagaaatagataaaaataaatactcttattattattattatttggttttataaagagaacaaaaaatattaataaaataatttgtggtgacaagagtgacaaattatcctctttttttgttttgtctacatgtggtcgtagaaaaagagcaacgcacagaacgagacaattttttgtatatttcttatcacaatagcgaagagatgtttttggatgagacccacaacaattataaaaatttcttcactattttgggtctcgttttttaaaaatttgaattgaatataagttttattttatctgatccagtatagcccacaacttacatcaaaatatgaattttgataaaaatttgaagagatgttttatttgaatttatagttggattaaaactgagcacactatatttttagatgaaaattgaatttgatctttataattaaaaaaaaatgtgaataacatggttaaaaaatatagatagatagatatattattattatggatagttgtttcccgcatggaagtcctgtgtggctatgaaagctgctcacgagatgcatttcagtggtcaagactcgagtgacatattttgattattttcaaatgaaagaacgatttgatgggtacgtaaaaagaaaaatacttttcacacatgactgcacttgcctctatcaatatcgtactttattcaacagaataaactttagatacagaaaaaactcgtcgcatatgagagtaaaataaaagggcaattatatttatatttcttttaacctgtttcaaaaaataaaataacttcaacaaaaaaaaattgtcagagggaggcaaaggtttaaatctttattcatctctttaaaaagaaataaatgtaattttttaagtatttccaaaattgaatttctttcctagaatacattttcttaaaatttgtatttgtaataacaaacaaatatattaattaaattttaaataaattacatttaatttaattttaaaataattacttattttaaaaactttttaaaaaaaatgaatctaggtaaatattccttttacaaaaattccctaaacgtttttttgttgtaacaagagacagaaaagaaaatgggaaaaccaagaagacaaaagtggaaaccctaaacatgcataaacttcctaaattatgcttaaaatatataattatttttttaatttaatcagttaaaaatataatctatttcaaattaatttcaaattatacatattcactaaaaaaatccgtaaaattaagtaagggtcagatattaagtaaatataagatggtatgtataagtatgtgtaggtagtgttgttctgtataatggttgaaaacaatatatttaaaagtaaaagaattatatccaaactcgtacatcaattagagtaagattgtttatgtttaaccaacaatcttaatttttattacatgtttgcttatgtttggagcaatgagattcatgtccaaaaggaaacaagaaaaagaaactttcacttaagtacgccttcaacatggagagacagcatgaacttgtgttagaaaatgagtttcaagtacatactaagagcatgtttggttcttcagggggcaacctcaaacatgcttttagagcacaaaactcagtttgaacacatgattggaaacccctaaaaacaattttttcacttgagtttgactccaatctacgttcatctcaaaagcaagtgatgccatgcttttgcttcttcaatttccgttggggctctttatgaaatttaacttccaattttaaccctctcttctaataagcatcaatataaagctgttacacgaaaaatatccaaccatcaacacaaaattactaaatgcaccccttatttcattacgttttgatagttcttctactgaaaagcactatatttttaataaaaaaaactctcaaaaacacttaaaagtcatactaagtttttgacatacaactatgttacatgtttataagaagagtttattgcatataataatgttatatgatttgaacacaattatctttcagcataaaaatatatttagtataaaaaataaaataaatagttatgaaacattggaaagttttgaagtgaggatttcatgtaaattcattttgttttaaaatatggactcataatataaattgtatttaaacttaaaagactaaaaagaaaagaaacaaaatatacttttatgagttgtgacacgagaaaataatgaacgtgaagggggggcaagagctgcgctgtttggaggtatttaggatgagatatttacggctgacccttcacccaagatagtagagagaatggaatttcaatttcccattttaattttgttttttctctagttgatgtggtattggtttgggtttcttcaagatttatgcaaataaaatttgtttaaacttttaaaaaataacttaaaaataaatctttttttataaatacttttttaagaagtaaatcttaaaataaacaaaaaattacctttttaagcagaaataatttaaacaaatatattaaaaaaaattattttgttaaaataaatatttattttaacaaataagtttaaacaaactggtgataaaattgttgagggatgactttctaatatacttccttggtcactatctttattttccgttgtgtaactttgtgttttatgggttttattcaattgaatacgtagaactagaatacaaaattagaaaatcaattggatatacctattcttgttttcttttgaatttatatagtacttaaaaattctaatttttaaatatgaggtttattgatgaatgatattggaaaaattaggtgttcaccaccattcttttgagatgaaattttcgaatggaatattttcgcacgcaggtcaagcttggatggagtatctataagaactttgaggccaggatacaaaaagattataaagaatagagggagtactccaaactcttgaggtaaaatgatccgtgaaatagtaattttttccttaaacaaattgtaattttttccataaagttgcagcagtgacaaatggaaccttagtgttggaactagaaattctttttctccttcaatagaaatttcagggggacaaatagcagaggataaagatgttattctattcaaaagcttcaaagaataaaaggtaaaggtgataggattagaatcttgacttcacgaagattttctaatgatgtaaaagtgaagagactaggtccaataacggacttgaataagtaaaaaggtccaagacttttttctttctaaaggttataatttatatatatgtacacattctattgaaacctcattctgatcaatataagtaaataaggtacagaaaaaattaggagcattacagtaaatcaggaaaccccagttcaatctgtccgagcacttgcactcaagaaaactcaaaacaaatggagaaagataaagggcattggcccctagagttgcaaagttatggatcttgtcgctgttatgcatgtgcttcgaacatcaaaacctgaaacccgaaaaaatttccaataaaacaaattgaaactatcattggaagatataaattttttcccccaaatagattctatactctagatagtcgattgtgaacggataataattattgtaaatcatatgtactggtcataatagtggcacaaaaatgagggacagtaaattcacgctcacttttgtcttagtgcttattggtctgaccatccaagattttctctgttggaaacaattaaaaggaaaaaggccacgttcactagtgttgtgctttccttcttgaatgatcgcagtgcaaaagttaattggaattttcgtaatgaaagacggtcaagtgtggaaagcaaactatagttagatattgcactctattaccatatgaattgtatgagaattgatcgttattaaacatttcacttaaaattttacatatgatgctaataatttaagattgtaagaattggtattaagatcctacattggagataatgtaagaaattaacttctctcaataaatgtatttgataaacaaacgtaagattaaattcctaatcacatatttgttggtttttattttaaaattataaaatatttgtaaccaacctgatagtggtcaacaataatttaggaaactaaccactacccacatctcctatttttttgcaacgttaacgtcccttcttttaacataccgtaactgaatctttgatggcaaggggtctataaataagtgtgtctacagccttcttgggtccctgaacttattttatatacatcagcatatacaccatctagtgctttagaataagagtttagaagactaaagagagatcttcagtgcaatccaaagactcagtgagcaatggcggaaggtatttatgatcttaatttttccacacttaatctaattgcttatgttgtttatgcatgattagattatttagtttttcttacaatatttaataaataaggttatatgttaattatattataataactagtttgttttttacaagaaaaaaataagaaaaggccgaaccaaaaaaactaactacaattagtataaaatttagagtttaaggtttatggtttaataataagagttaagtactgaatttataattaatttaatttaggtttaattatttatttgatcctctaatttatgtttaaaatttaatttaattttcttattattaaaaaaaataattagatttttttatttttaaaaatttattagctcatgatcgtgaagatcagctcaagttagtcgcattgaatcttcccaccgaaagtgggggaataagtgtcgaatctcacctccccttggtacaactaaattccgacccagtgttccatatatgaaaaaaatatattttataaaaaagtgaataattttttgaaagagaaatgattatcgtttgctactatcagtattttttaacactctctctatagctcattggtcttctctttcctaaacaaatgaacgcaaaagctaaataggcttgtaagttaaggttttattattattaattaatatatgaaggaaggtgtttcttttaaattctgcctcaaacaccgccgacaattttgtaatacaaacatgcgctttatcaattgaactgaatttacttgtatattttaaaatagtgataaaattctataattgtattttatttgcataaatacttaaaagataaaaaataaattaaataagtttattctataagttaaaaatagtttatataaaaagtttatctcaagataaaatgaaaaaaaattcatttaacttttcaaaaagttgatttattgtaagctaattttaacctaaaagagaaacttgtcttctaaaaaataattttttatacataaattaatttaaacttacaagaaaaatactttatttcattttttatttattttttgttacagatatgggtgacaaaatagatttgactattagatagtccattgaacctactttctttgatgggttgagaaaaaggtatcaacccatcaatctgttttggcttgcaaatgtgtttagaaattagtattatgtcttaggacatcattttattttatattctctagtttttataaaaaaaaatagatttttgcgagtcaatcagctaagccacccttaagccgagcaagctgtatttttcaaaccgtatattaaaaataaaccaatccattctagcccatttttggcagattaatgaccaagcaaactaaaatgggccgagttgtcattttatcatccttacttataaatatttattgtttgtaaaaaaattgattggagattaaaaaaaaatgacaagttcttagttttaataaaggctatacgattaacaaaaactaagtatggttgtttttttagaggagtatgattgtgttgctaagtgtgaacaagaaaagaaaagaaaacaaataatagtagaacagttccattccattattattatttatacatatatacatggctaaaaccactttcatgcaagtgggatctttcacatgataatttaatcataaagaatttaaaaataagttaatctagacacatgccaacttttgtttgaaaaacaataataaattccaccaatcgaaaagtgagcttaaaaacaataaactaatttgacgaatcggaaatgcacttgaagacaaagtagaagatcaagaaaaagaaataaatgtagagaagagggagagtttgaggaggaggaccaccaccaccactttgcatttgaaaaacacctgaagaccatggcaccagttgagttgctatagctggattgaaaaaccaacccacagccgtcctcgcagtgcggaaacatctccagaaaccacaaatatcataaatgtaaaaagcatagtatagtattaataatatattattactattattatattgttattaataacgatatgattattttattgaagagtggaacaaatttgagggagaaaggtgtatggtgtatgcagaggtttggttttaaagtggtagctaggtatagagatttagagatacacaagacatggacatagtatgatagtataaggaagaattcccagacacctcctccttttgggtccctcactttgtgtccttatctccaacctttttgtccttgttccctttccggtctggtctggtcctccttccccacttttatagcctccacacttcactcacacactcatgtcttctacttcttcttcttcttcttcttcatcatcatcaacttcttcttcaaccccatatgacgctgttgcccctgatatccctggccctagtacgaggagaaccacccgtagtggtcaatttgaagcttcttcctcctcctctcagcgtcaacgtgctatgaatgaggtcttgcctgagccttttcttgaagctttggccacccaacttgcccttgatgctgccaactacaatggtcgtctttctgctgcttctgcccttgccattttatttcaggtaggtacttttctttcttcttctttgaaatacaagtattattgaagtctcacaagtgggaatgtaaaggttgaagaccaccttaatatatatcccccttaattaatttctttagccccatttaacttttttgcttgctatgagagaagttgttaagaaagataagtttttgatgattgctcatattggttggttgtgtttgccttacttaatctgatgatggattcttagtttgcttaaaatgaatatttgtagaatcttcagcatgcgtaacagatagctttttcagttccgaaactggacaaaatattggtcaagtcagacgtgaacctagcattgcaacctgcagatgctgattctttttattttattttaataataatatcgacattatggatttaacttaattaataatattatatgtatatatcatatccgtttcttttattttttcggattttttttttccttttctgtgtattgtttaaactttagagaggcatacattattcaactcagtgtataaggggagatgagtgccgatttaggttttagttgaagatgctttcaaccaaccgagaagaaactgttccgcgaaagcagctactttacgtgggtctttttcaaactaaatgtgtgtccctttcaaaaaagggtgttttttttccttcttgccaatatctgttctctcttcctcttcaaaaatgtctagttttggacctccttttcacaacctatgaaaaggcttacattggcttcgatttgctgtttccctttctgggcatgaatcctttttgactgagcttttccctgctatctaggctagaagatccattgcatgcctttctatctcaaaatatgtggatactagcttttttactttgttttaaaagaagttgctttctgaaataataacattaggagggaggcatatatagttatttatgtctcattcctagcgtccttgtaagtgtaccatttccatatatagttggagcattgataatgtacaattttttttatccagcttgtttcagtttggttgcatatataattaatatataatgtttcggaaggacaccatttctttttcttaatcttaataatatataatattattgagattgagatagttgatagaaggttaactgtagtatgaaagttaattagctttctctaatcattcgtttgtgttcaaagaataagcttgcctggttagactagtcagttaatgcacttccaagcaattgaaatctggaaaatagatttgaagttacattaattcgtaacaaaaataataataataataataaattttcattacactctcacaaataaagaagagattcatagttacattatttatttaagagtgtcctcctactctggtatttattttccaattgataaataaaaagttccttctactctattagtaacaatataggagtatattttttctgataggaaataccaattgcatttggttgctgcataaactttgcaccttctctaatctcaatcagggtttgaaacatttgaaataaccggtgattagtcgtcggtttaatatcctataatctaaactggcatgtatacatgcggtcaaaaagcagcatttgtgtaatgccaaaaagcacatggagccctactcatgtcgtggcgacactccattccttttgtttctatctgagaagttcacacttattataattttagttttctttcccaataaattaaatactaatatcatatgatgtgtactatatacgttatgataatgataattgcacaccacacacaacatagttgggactcgggagttggggcatgcatattttttaattgtacttaaaaactataacagctcgataaaggtggatctttttggataaaattatgtaccaacgcctcttataaacattataattattaatgtataaagtactcatataaacctatgaaaaattcttttgtttgttaaaaatctcacctgtacctttgttattaaatatgcaaaccatatttaaaacttattttttcacatttaatcacactaattaaggaaaattcctccttcattttgttagtctaagtttcccttcaggggcgcttggactggtccttgtgtgcgtggatagaactagagattcgctgtttgaaacaagacaggccccttggccacacctttcttggaaatgaaactgaaatgtttgtggggaagcacgcttttcatacccatgtttacattatacacacacacacacatgcctacacgaacagtaactaagatattgactagtttcgttattttgccgtatccctgctaagtaatggaccacatttatacaagccatgatctgatctcatctgtgtcttcttttcactcattgctagatctctccactctcaattcaaattgtagtatattctaatccttctacgcatttattctattaaattttcacttctagggcaaattgatagatagctcatattctagctggactagtcagacctagctcacccttttgacccatttgacaattacttgactacctctatgaaatagtatatccatagaatatctttctctgtgtgcttattctagtatgtaaaagttgcacttcgttatatggacttgtcattgttacaaataatttgtctgtcacaatcacactagcccaataagatcgtgcaagattatagctatagctcatggtggattgtttaatttaattccgtgtgtaggagcttatgcatatttcatacgtaaggcatgccatatagcagtgttgtcattattattatctaagattctaaagtatccaactgaaaataagtacactgacataataataaataaaaattaaatgagaagccatttactactaggtactgtaagcttagcttcatttgaaggctaataatcttaggtcccgagtacctctctgctagctttagctaatagtagctacctgcttctgccatcttcaatagtttctctctccacccttttaatccattctacctacttatagttaagaagaaaaaaacccacaaaaatcaaatatacatattcttttgtttttatgcaacaggattttataaacaaaagaatttctctgctttctatttttggataaataattctagggaattgcttaatttatcaatcaagctcgcgtgcattagaaagctattttaacttacagctaggtttgttaaaaaattgtgcatgcaggtatgttccacgtggcgagaggtgtcgcggtcggatctgctgtggcagcggctcacgagacgcatatggcgacgcacctatcgactgagggccacgtggcagctggagtacatgtattggcatcggacggccaggaacttctcgacagggatacacaggtttttcgacccaccggtgtttgacccttcggatcaccacctcctccagaacctgctctgtcgctgcctctccctctccgacacccacctggcgtgcggcttcgtcgacggcaccgtgcgcctcttcgacctcgaaacccgggcccacgtcaccaccttcttgtccctacacggccacctcttcgggcctttctcacgctccgtctcgggcattgttatcttcaactccaacatcgccttcgccaggctggacggggatatctacgtggataacgtgaacgggcctgggcctgggcccagccaccctcgccgggccgtggagggtgacgttgtcaacaacggggtgctggtcgggttcgcgggaacgggccggtggtgggtgggcctgttcgctgggatagcgggccgggcttttcagatatgggacgcgcggagcgaggagcgcgtgttcgttggtggttctttgacggatccagaaacggttatggggtggcatatgctgacggagttagtggaagccgtggggcgcgtgcgcgtgacggagcgtgagtatgttgtggcgtgcacggggtcgaggttggtgtgtttcagttttcggaacccggaggtgttgttgcgtgacgtggggtccacgacggggttcgtggtgagttcgctggatgcgagtcaggatgcttatgtggtggtggagaggaacggcgtgggaacggttcggcgagtcagcactttggagcggttgagtcggtttcggttgaaccggttattatgggttcacgggttgtgggcttgcattaaccttggctacgcgttaacctattcgcctgcgccttcgccttcgttgagggtttgggacattgagcaagcgataggacggttgtgtgtgacccttggggtgagagggggagaggtcaatagcttggtggccaatgacagacacgtggctatctcttccattgacaataacattaacttattggattttggtgtacaggatccttagttagacctaggtttaggaattattattgttattattattagtattaggagtactatgctcacattcattctaacttcccattcctttttgtacctatctctctctctctcacaaaaatcacatccattgttattgttattagttattactattatcatttaatctttccttctctcccttggtcactatctatttgttctacgtagaagacaggccgaggcaggcacctagtagatgttgagagtttgataagtccaaaaacgtggcaatctagcatgcatgcgttcacttggatcttccaatagtcaattataaatgttgttgggtgttcagcttgttacccatattttataatttttaattattgtatgttattgggcactgaacttggaggaataaataataattttacagttatttaataataaaacacatttatatttcattaagttccgtttttaaaataaaactaattttaacatggttcccaggagtctattactatattacccgtgttcatcgcatttgagcaaatttgataatgacttttgacctataaaattaactaaatgaagtttatttaatagaacctgatcaaatgaaagaaattaatggctctgtcactcaaaatcaaactacattgtttttaatttcctttttttctcttccattctaagctgaatcaaattaaaacacctttactgaactgtctaatactattctttatacctattattaatcaccatatcaatcgagtaaagctatcttatcaatcatttgagtatgtggcaaagatgtttggattttagttggtttcgatatgatggttatgaatgaagaaaatacaagcaactcatgacaattttcatggtgtgattaacatggtggctcaaggaacttgtaaatgagagtatatcaaacgtagttttgcttaattaatagttaaagtgatttatgagaaattatgaaggttgatttactagcaagctttgaacaatattatcataacttgaggtgagtatgacaattttacatgatgtttcaaagtcaggtaaaaggaggataaaaaagaggagagaatgcaatctgatttttgggtgctaaacgacattggtattttttttcaggagactccatccttttaaaggtccaaacctgtgattaaatttgctgagacatctagtgtacattggttgtagatgagttttgttttgttttcttctatattggtatgtataagaactaaatgttttccatataattaagaaccgaatgaaaaaaaaaaatgtataaagacagaaaaggttttaagttttcttccctgtcagaaatctcaaaatttgtatttatacctaataaaaaagaacctaataaacatctaaatttaaagttgatcacacgtgtgatttttttaaaataccccatcatttactatttatcacatcatcatcgcgtttgcaagggagtacgtacaccattatggtgccaaacttgagtcgttggttataagcatgcttctattaattcatataaatactgttcactacgtaagtgtaaatgcaagagacgccgcaagtgcaagtaagcaggaaaataattttgaagttttagttatacagaataactaaaaatgtaaaggccgtacatgcatgaacagttacaaaattaaaagcttatgataaaaatgaatgacaagttctttattagggcatttaaaagagggaatgaatgaaggacaaagtgaggtagagacatgcatggtggtagcctctactactgctctctagtccctagtctctcctgcttctatgcttgacaatgcttttcttctgctggtctgtctttctgtctgctgctgatatatcgtagctgctgctgctgcatgctactgctgcaatgcataccttagccaccctagctatatatatagacctgcttctgatatactaatatatattgctggctgcaccttcgatgtttctctctccctcatatttaattttaggctttaaatacgcgcatggcatagattgatcgagaatggaatgtaacttctgaccatgtctttccaacttcattatctcaatatgaaattatgtccttttgactcttctaggagcacttgaacaatggagggatcactttacgacttgatggtacaattcaaatatgaacttttttttcttgttggaatttaggagatagtagttttttaataaattgaagtagctagcaagtattattcattcatatagtataatacaatttttttttttgcagaatatatgcggaactgtgtgaaagagatgattagctgcaattacttttccttattttctttagctagaacctgtttttactttatttttcttcagttttttcaatttgaatagggaattatcaaaagactagtagaaaaataagtgaaaatacgccttaataatggagttttgagcaatagaattatagaagggacctcaaagattaatgtaaacatgagatgtagaaatattgatgcataaaatgacttcaagaaaacaaggggacttcacaaccccactaattgattcttccttattatgtactgtttagtgcataacctaaaagttctgattggtgcgaattaaatggagggaaagattcaaaacaaaacaaaaagaaagataagaaataggttaaatagtgattttcgttcctgaatgtgtctagcgctaataaattcgtttctgaaagataaaaatttaaattattgtcttcaaaagtgtaaaaagtgcgacaaattcatcatttcgttaacttctttccgttgtcgttaataaaagtgcctacctggcacaaaaggacaaaaatatcacaaaaatgattgtcaagatggctgctaactagattttgaacaaaatatcagtaagttaccgttggacaaaaatgtcagttattttctattggacttaaatgttagtaagttactattggaccaaaatgttagtcattttcaattggaccaaaatgtcaatacttttccattggaccaagatgttagtatttttttttggcgaaaaaagtagtacgtttccattggactaaaatgtcattaagggtaaatcttttcctcttttttatcgttacaaacatattaataacaatacaataatcacttaaaaaataggaaagcaaatataagttaaaagaagcataataatagtcataatattgattaataaccataatttgttggtcacaatagaaattatccaaaagaaatattttatctgtgtaccaaaataaacattataacaatgtattaatcattacaaatttattcaaattataataattagtcacaatatattataattaaaagacaagtatatcccatatttcacttcttcgaatcttggtggcggggcagtcttggtagattgtgactaattattataatttggataaatttgtaatgattaatacattgttataatatttattttggaaagacaagcatatcaatagattgtgagtaattattataatttaaataaatttgtaatgattaatatgttgttacaatgtttattttggtacactggtataatgtttattttagataatttctattgtgacaaataaattatgattattaataaatattatagtgactattatgttttttttaacttatgcttgctttcctatttttaagtgattattatattgttattattatgcttgtaacgataaaaaaaaaagagggaagatttacccttaatgacattttggtcaaatggaaacgtactgaccttttttcgccaaaaaaaattactgatattttggtcaaatgaaaaattattgacatttggtctaatggtaacttaatgacatttaggtccaacagaaaattactgacattttagtccaattgtaacttactaacatttttgttcaaaatctagttagcagccacattgacaatcatttttgtgacatttttgtgcatctgtgtcacgtaggcactttcattaatgataatagaaagaagttaacggaatgatgaatttgtcgaattttttacactttcggggataaaaatttgaaattttcatcttttataaacgaatttgtcagcactctagacatggacaaaaatgattatttatcctaagaaatatatttttttttattaaaggagaaataagttgaaagagaaataaaaaaaaccagactctcactattttatttctccttaaaaatgagcaaaataaatagtaatattttccttttattttgtcactattgttctcaaaccaaatattcttatttctattatacttcttatctatttttattcattctattttttactttgttcttttctttttcttttttctttcttatgaaagaatcaagtgatgcgggtgataacatgatataaataaaaatagagtaatattattttttcctgcacttcacaacccctcaatcatgtaaacatgagatccatgattatttttttcctatttcttctcttatcatattgtatttacttatcatagcctatttcttctatttttctgtctttttaggtatctaaaaagacatggggatttgagaaattatattatgaataatgatatataaatatctcaccaatacttttttatttttcttttcttatcatataaaaaatcttaccatacctatatattttactctattaaacattttaggtattacataagagtttaaggtgtctattcaacttttttcttatcttattgtctgttgggctgccgcatataatgataccgacgagtgaaactcgaatctgaaaatgaatttctttgtgtgtgtttgaattaacctttaattctttcaaaatcaatttttaaatcgagtgaaaagccaaaccaacaaataattgcttcaactttttaaatttttcatcatagtttctgggaattaaaattgattttaagaggtatccaaactattcatttagatttcagttgaaaagtcttaaattatattttgatagaaacttctatttatttttaacttaaaccaagatttggacatttccaaactgcaatcacaacatgctttgtacaatagtgacaaaaaagttaggttctcatgcacatcaagacttatgatcaaaatcatatagcataagattgtacttcaaggaagaaaataaaggagaccggttttttttacagttatatgatttttttaggattaattgtatattttatcattcaattattattatcattttacaaatctaatcactcaattttattttacaaattttatcacttaaattttaaattttcacattttaccacccaagtattttttttttatttttaccacttgattctttttttttttgcatttgattattatattgataacaaaacgacatctttttgtaaaaaataactttttttagtgacacatgactatcagtaaaatgcataaaaatttaaatcttaaaatgataaaattcatgaaaaaatactttaaagtaaaatttgtaaaataatgaaaattgtggtaaaacatgctattaatcctttttttatgtataaattgttccagtaaaccaaaaattaagaatcaaggttaaagataatttataaactacctttcccataacctataggcttgaggttgagacataagtaaatgagactggtggatcaactcgaaattcacaacttcaaaaagacccaaattacaaagagacccaatttagctagtatgccaaataaatagcccaatcgtattcaacaaattcttgatttaacccaaaaactgaatcgagtgacaatttttgggttatacaaattaatctaaactgcatggtaaagtattacacttaaatatctaggacttgaagctaatcggacacagctgcagatatataactagaatcttccaatacgaatgttaaaattacaaacacgcacagccataggtgctgagcctgagatttgttacagaaatttctttccatgcaaaaatttgtgtcgacatagcatatctgttacaagcatcttatagcataacttgtctaaaaaaattgcagctgtcttttgtatgcttgcagaaccgctatcgccgaaattttaaccagtggcatgcctagtaaaagtttgactgcaaacgtgtgcacaagcttctactgtatacagtcattcacctaaaatattccaaaaagatcaaatgtcagcaccccggtaagtatgccttagccttcaggctacacatcgacgtcaatccagctgaaggatcctttaaaattataaaataagaatgcatttttttttttttatattctgtggaaagaaactaaggatgcatttaaataaagaatttcatttaagcacttatttaatatactcctaccaaacaaaaatatgttcataaaattaacagaattactgagataagttaaaaaaaacttattttaacaagtttatctgtaaatcttattaaaataaattgaaaaaaaaaacttataaaagttgtgaactactttctcacaagtctattttttttttccaggcaccccccagataccattataattctgaagattgcttgtgccgctatatgtagtatgcttgtaagtgctagcttctacaaaagtatttgctagcttgctaaaagatacaactatttcattactgaaatcatctcattcttaatcatgaataatagaatccaagccctaatgtctctcgcatctcaaatcaaactgccagttaagcaacttcaagtaatcaacgaacatatacatgcaaaatgtcatagataaatatgcagaaccaattttcgtataaaagaagaaaatgcaggtcacagcatagtttttttacttgtaggaccctgatggaagaacataaacacaatgataatagaggagcaggataaaaaacacaccaagcagagatgaaaagaaagcagcaactagacaagccaatttgaaaatctgttaccaatatattctcctctagcattccatgggcgatcttcaaaggacttcccaataatattgccttttttatttagaattccctcttgacagcagtactgtggaaaataatcattgaatgttttgcttccaagttcatcgactccattaaagagaaagcttctcaacatatcctagtataaaacaggaagtgaggatgtgtagtactaggttgtagaggaattaaataaatcgaccacaaatttggcctaccttggcaagtgtgtcaccaatcagcttcttcaaaacaccttgtcccggatcctaatttcaagtatgtccatgaaccaggtccattaaaaggtaaaactgaattagaaatagattatggagaagtctttttcatttttccttcttattttctttacctaaaagtgtttttggataagtttatccaaacatgtcctatatattctatatagttcgaagttcaaaatttattccaaacttatttgacaattttattgttgagatttgaatgctagaaaatagctttctacattactctagaaacaataagttaggtagcttttttgaagatatcaaattcagcataaccatctttgttaatattatcatctaaattatcttcaaccgatgctaactaaatgagtgaagatccttggtgaattagaaaatcctaaaccaattatacctgggacaaatataagtttgcttatggctagatcagcaatcatatttatgattggctgtcagaaaatttagcaactgtgaactaccttttcagctctccatgtcagatatctatgttgtgcttcgagattgtgggaaatctgagattcatctgtctctttaactgctttgcatatcaattccaaccatacctgccagggtaacagtcatcaagagaaaaaaattacacgtgtacaaggtcagttttattaaagttcactaaatatattatactccctccattcctatatataagaccattttcagaaaattcttgtacctttttataagaccattttctacttgtctcttgtattaattattttttcctaaaatatccttaattaactacaaattttttagcaaaaaaaaatatgctggaaattaacaagataaactctttctcttattatgattggagaagatgagtagccacaagttacataatcattactctatctccaaaaattaattaatgagggaggaaaaaattaagtggaaagggagagatgattaatttaaaaaatattaagggtaattttgaaaatagtataaattattgacaaatttaatgtcacaaactacattaatcaattttattaaagagagtgaattagttgaaaggtcttatatataggaacggagggagtatttagcaaaatatgaatagtcattcaagaagttgaccataatgctggggttattaccttgtaatattccctaaatgcagaatacaaaatatcatatttttgtgggtttgaggtaaactttgtccagatgacaattggcgaaaaaaaatttatggactcacttgtgagcttccctccccatggaaaaagctgcataaagtcagtgttaagtcaacacactaggtcatttaagaaagaattttcttatctatatatatatatataatttttgctggccaaaaaaaaaaaaatttaagaaagaatttctataatttacagaaaaacagagatgcatccatgatgaggacttttttaatgaatcaatactaaatggaaaagtaaaaaatgtagaattcgtattaaaacttaaaagtatatccagttttagaacaatgcatcactcatgtggctaatcaggtcaataagtagctgttattaacaaaactttgcacattgttatgcagtcgagtgattaactgtttctaaactgaaaatacttctaccaataattcttataattttcgctaaaatatttgcagttacctcagcatatttaaggccaagaggaattaagcttttaaagtacttctccttgtactcatactgattgatgatatcatgcaaggggttaaggtccctgacataattaattcaaggttagtgctctgcattacatacagtaatttgttcttaaaaaatgtttgaagctatcaatagcacagtgggggaaaactttttcgcattaccaatgatgtcagtgaacaaatattagatttctaaaacgattaaggtgtaaacaatattggggagaaatgagaactacagactgtcacatagatttgctttaggctttatttctaggtaaagcatggtctctttcattatgttattttggccaagtataaactcccaagtaccattatataaagtacatgcactgacaatatgactaaaaacaattaaattgagggataagtaatgcaacataagaaggctaacagtagattatcaaaaaggatgacactataatattcttccacatctgagtaggtggaaaactttagtagacatgcagcacacattaaatccttgagtttgtatttactgatgaaggcatttttttttctcatttattataacagcttcaccaaatagttctttctaagattggatgaagaggagtcaataccaatcttcttccaaaagcctacaaattcaaattaaagcatacatcaacttcagatctaattttttattgtaaagctataatacataagaaaatgaaaagcgaaggccaacaaggacatttttggtacatataatgtaatttcaagtagtcaaccaaagatgctttcaatgctaaaatctcctttacatagaatatgacatatgatatcttaagatgacaaatatagcaaatttactgaactatggtttcaagatcacattttaaagagaatcaaatagctgattagggctatacttcatctttttcaaggttcataggaaaaaaaaatagcaaaaccaaagggctggagtaaaacaactactatttctcttgcttaaactaacattgagatctaggacatctgctcctaaaatgataacttcactcttcccctcaagctccgtttggttcatcgtgtggacaattcctccacaatcaatcttcttttctggaaatgcatgcttttattcaatgagaaatataccataaaagatacatgaacctatttaacaaaagaatgaaacatcctcttcaagtgattatgcaagtaaatttacacctaatgaaatatggtattttcttttaccaagtacaataaaatacctgttactgagactagttgatacttgataacctactttgatgagtattagtaggcaatgaaacatatgcatttaccacacccaaatgaagacataaaagttctctgttgtgtgtacctcttgaaagtatatattcacatagatcaaaggctggcttatttttttaatttaaaactgaatgattcctactttgatttgcaaagcaacccaagataggttttcataattaatggtaaattctttttggatgggaaaatattgcattcccatgcataaatttccataagctgaaatgcagtttaggaataagtttaaaaattgcaaacatagcccatattgctagacttttccacaactaaaagtaaaatatgagaagaacatcctttgtacatttatataagtggattgcaacagtggaagaagatgctaacttacaacacaacaatgtttgttttagcagaggtgaaaaagttagcacaaaatatggggacatcatattctgcttttggaaagacagtaaaatccaaaacctgcataagaagttgaagacaaaaaagagaggcagtaagcatgttgtaaaataacctttccacagacaggacacagaagacagcagaacatttcagcaatgacatgtcaatttttttcttgtgttgttgaaaacttgaaatagaattgcaaaatataaaacattaggaaaatggaaactgagaaatcacataagctaatcctaagagaatttctaagatactctaaaatattccaagatataatattgatgttatgagatattccgacaagtgttatacctcatggggatcagagattgcatattgaaacagatacaacaggatgcttactaattctgttaacatgcattgttatagatgaaggatcctttattggtaaaggaaaaagaaaactgaaattggcagaaataaatacagacaaagtcaaattttgaaattgttattgctgtaataaattacaaggtactacacaaaggcatattgtgttaagacagtagtagataccaaccatatatcaatttgataattgataggcataaaaaaaaaccacctgcattgtttcagtctcaatgatcaaacttcgtagaagcctaatttttgcagcttcaaatgatagcgtactaagacttcctttaacatccttggaattcatgaaactgaacttttcctagcaagacaacatacaaaaatgtagattgaagatctatgcacacaaataatggtggagagcaaattaagcgaacaaagcagaggagtcgggaacaactagggacagaaattcacaactaagaatcttcaaagcaattatgtgttcaataaaactaaatttaaaataatactataacaaaatataaacgaaatacaaagttgaataactcaataacagcaagaaaataaaagttaacggcttattaattgaagagctagttctatcctgagaagctgaaacttggtgattggaacagtacaccacatcctcaacagggcaacacaaaaatataaaaggacaatatatgacacttagtcataataaaactctttttcatctcatgttttttcttccataataaatggaagatgtttattaaacattgaccaaaccaaagtgattgtttacttcatttatatttattaaacactgtcatccaaagtatggtaataatctcttggttttgagcactaaccagagaacttgttctatagagaagttcattcaatttctttttctcttcttcctcagggtcggccaaagggtaagtctactaaagttatagttttacgcctaccaataaaaaattattagttattagtttttataaagttgtgtcttggtgacttattggtcatgagttcgaatctggaaacaacctctttgcatatgcaagggtaaagctgtgtacaatatcccaccacctatctgcgcatagcgtggagtctccagacaatagggtacgtagtttttttttttaattagtttttataaagcaaaaaggtcacatatgttggcaaaaaggcctaacatataactctttcatctaaaaaagaaaaaaagtattttatcaaaatttgcttcgattatgtacagatgcatcagtaaggtaaggttgcatttggtatatggacaaaacataatgaaatattgcatttcgctcagttctccttgatttcacacattctatagaaccccaatgtgcatttgtttcaacttttaagtcctgttgtatttttaaatgcaacataaaaggaaaattcacatattatgttttgtccgtttcagctgacacatataccaaacactgcctaaatttggtttgaagaattctgcaaattaagttttaaaaaactacaaagcggaaatttcacattggcttgggattcaataccagaatggaactaactaatcctaatcaaccattcaaagtccaacacatacaggaaaatggccataattttttagaaaaaaaaaaaaggaataagagaaacctgtaaaggcgaagggatcaagtgagtgtggcgtttggtttcatccaaagcaaactcaacaaacttttgataagatactgaacaacttggtatgcaattactcctcctcatcctcaaggcacgagtagaagtggctatcgctgttaacggaggaagaagcgtacgttgcaaagaaaagcatgatgaagaggaggaaccgctaattctaaatcccatttatgttaagcagcttcttctgcactgaatcacaactactagttctaaattctaatgttctttctatccaagccagccacacgtgctcagcaactttctctgtttctacttttagcgcaacccatcttaggatgctttggatttgtggactgtgtggtccaacattcacgtattgtaatagcctgtgggcctcatcatttggcccaaatgaagatgtccaaagtccaaattaccctcctgtctcactgtcgtctctcatacactattcaatagcatttgacttttcaaattcaattaccaagtgaataaaactaaactaattgccaatgattattaacttaacagtaaaatatcattcttcttctcaccatgacattaatgtaaagtatttattattaataattaattttcgttaaaaaatataattgatcacgtttaataaaacatctctcaaccatattaacttaattgtaaaatatcattttatcaagaatttgttaatactgaagaatttttatttgaaagaatgtggttgggacactttaaattaaaagtcacttaaagcatctttagtgtaagatcttaagcaaagatcttaagcttaagatctgatcttcattagatctcccaataaaggaattgaagagatctccaccatgaaagatgagttcttgtggaagatctcttaagatctgcacattgttcaaaaaaataatttttcttcatttttctctctccttaagatctcaaaatgagatctaccattaaataaaaaaatggaagagattttaagagatctttaatcctatttggtattatgtggtctaccaaaaagtagtctaagatcttaatttaagatctaccattaaagatgctctaaccttaaaagagatgagaggaggagacaaaaataattaatatgattggtggaagtgtctgcaagtataaatcactttgttttttttttcttcttatcacatcattcaaactaagtacatgtttggatcctaatcactcattcacctttcacaaaaatttcacatgaaattgtatcaaagctaatttgattggtttcacggttttaaatgtaatttttcaagtctccaatgtcaaaagttaacaattataactttcacaatctaaacataattcctttcctcttaaccaaattccaaacacgcactactagttgtttcttggatgtacatccaaattgtgtggataaaaatccaaacgaacaagtaactaatctcaatcttcctactacatctggtggtttcaattagttaataatggccaatgagtgtggtgagtgagcgtactgtgtgtgcggagctagaatcagaggaagaaaaatactaacatttttatttgattctaacattagtttactctttatcattatatgattataaattatcaagtttgttggctggcttgaacagagaaaacactcacaatcaaaggggtataaattggaaacacagatatagcaaacacaagaatcaaaacaagtcaaaattttgagggagggagagaaagagagaaattaccaagaattttagttgttgagttaacaattaacttaagtgtaattaggggaaacataagtataaaagttttggttaaaattcactaaaaagtaaacaagtttgaagcaaaattaactaaaaagtaaaaaattaagaataaaaagtaaaattattttagcatgttacgtcaatttaacggtaaaaaaataaaatttgtaatattttaaaaataaaagataaaatatgttaaattaatttattaaaataaagttggccaaaaaataaaaaaactaacaataaaaattacaattcgtcaaataaattataactcttagacctaacaacaagtaagaaactctcatcttaccttaataggtttcggactaatgtgacaaagtcccaaaatcacatgctcaagttcttgctttgcaaattgcactcttcttttgcctattgactcaaattagttatacctatttttacattattcaataacatttcattgaatactttcaacaaaaaacttataattgaattaaaaagataatcaaaccgaaattatttgatctttttgatgcacatcaaaattaacctaattcaaattttaaaaataaatgaaaataagaactattctttgtattgttgtccaacttttacaaaatttgacataaataattcaagtaaatctcctcttagctggtaatttcctagcatatatcagccccccttaccaacacaatttttattcatataataatgtcctggcactgccccttctgttggtgcagtttttattcacacaaacacagctttttgtccactttccatcagcttgaatgattagggcttaaagttaaaactaccataaactagtacatacagtagtatgtaataagctgcaatgcgcgcaaaacaactctgcctctctttttggacagcttgggacaatgtaacactaatgaattaataatttgatggttaacaaagtttaattttggatccactaatagtaacttcttcccttgtgcttgtatgacttgttggcatcctctgagccacatagtatttgattttatgcttaacatcactgttttaaagatgccttgttttgtcagagcacactactcacgtacccaagatttgtgatagatagcaggctaggaatttagtgtccagattgaggaagtttcttccctccccttgatcaaagggaatgaataatgagaaattaataaatcagtcctcaatcccatgcaaaagcaaagacacaagaagaaaaacacaacccatttagctaaattttcaaaataaagatcagattccacagttacccactcctagctaagagagtagttaggagatagcgttgatttagaaccctggctgtcattgcattgtttgctttccccctcgtctttctgtttaccttttacttgcttgtttgtttgttctgtggatgttgtttaaagcttttatcactacatacttctgctaattgcgagatcacaaatcattattatgctataatatattttctctaacactaattaattataacctagtataatattgatacaccattaataaccacacaatactttattcttttagacaaaagaaaaaaaaagaagagagtaatacacaaggagtgatacccaattggacgtactttaattttgagcaaaataggcatgatatccagtggcgatctttgtttttgtctttttaccaaattagtgtattttgtttttaaaattattgctaaacaagtgtagtttttaaaaatttacccacataacataagtaagtcgcacttcatgaatatggtttccttttaaactttttatgcaattttttttacagtttataatagtaatgtctgttaattttggacagtcataaatgtttttggcatttggtaaaaaataaataaataatataagcaagacttacccatattgatttttttttttttgtaaataaactacactagtttagtaattttaaaaataaacaactttagtttgatagaaatcctgctattttcgagcgattttgaaaacttaacgtttatcgtttctatatgtttgtttaattgaaaaatgaaaaaaataattacttgggagagaagtggaattagagtgagattctttttcgtttatcaaacctctaaattataatttaattgaaattaattatcaaattattggttgacgtataatataataggaaattgttgaattttataataattaattactttaatatctctttattaaagtcttataattataggaataatcaaatttagtaagtgaactacaattgaggtatacttcacttttaaccaaagaagcgcccgatcgggaaaaaagaagatgtgaatataccattttgaccttttctttgtattttaagcatcacatgactattctttatagccattaaaatatttttatgatttatgtataaaatattcatcttaactaatgtttgggttagccggtatatatgttacatgatctatctacaacaataatttgtaggatcgatcagaaagtcctaattaaacgataaagaaaacaagaaacgaatacaggagaaaggtaagtgagaagatgagattgtataatcacattaacagtggaccacagttcacagatgattggctctataattgaactctgctctatgttgacgtatggtcatgacaatggtagaatctctgatcatatactagctagttgaccaattggtatgtgggcaaaaccttacaagaacaaagtacaaaggatagttgttggggaagaaaagaaaagaaaaaaaatatcggtgaaaatatttttggttgcaaactttactttacggccatctccttgtagttttgcagttatcgagttgctaagagcaagaatagggaacagtgcttcccctcgagtgtgtccaacgaacaagtccaacctaataaaaacaacctcttatgacacactctctaatattgcagcactgagtgagtggggtccagtctctctccacagaagcctaattaataaatcaaatgtcaatttcaagccccccctaccctaactaaatgaaattatattttatgctttctgtctcaaaggacttggggcttttgcttttctttgtgggagaaaatccaaccccgtgagacattgcctcaccatgtcatctgaaaaccttttttctttcttgctttctttctttgttgctattcaaattccacatcaagtgcaaaaacataaaattactgtagcgtgacttttctattcgtgtgcctcacaatggaaggaaattactttaggcacttctttggtggaacatgatccatcctcctttcctttccatttatttattctaaccattcaccagcaaaaatttctttctgcttctgcttgctccagtgcgttctctttctgtttctgaattgcactgttttggtgttcaaatgccaactcgattggaacgggaaatacaagttcatcttattgtcttcaagttaattaatagagtatctttcttaatttcctgatccaagcaaattattatattatttgcatcgatcaccattatagttgttcaagtcaatgatcattattaaaatgtatattctatcaaataattaattaagtaacgcagttcatcttgccaaatacaaagatatcctcattttgcgttacatattcattaagatttgaattttataataagtttaataaaaaaagaaaggaaattatggcatagctattaagaaaataattcattttaattctatatcatgagaattaaacattagcaagaaataagaacatagcagaccaaccaacatctgtatgtgatatgattaatgaataattttgtcctttaaatatgtatagtcttgcgtttgattcttaacatgtgaatatgaaaaaatataaatataaatatattttttcctaaaatttagtatttattttatttttgtaatttttttattttattattcaaaatgttatttaaaacattttaagaatgaaaaaataaaataaatatattttgtaaagattaaattgaaaaaattataagtatataactaaaaaaatgattaaattgcataaaaaaatgtatttaagttaaaaaaatatattgaaagaaattaattccagatttaagtattttgatccttgagattcggaaaagggatatctgattcattaaaaaaaaaacagaacatactatatttatattttaaaattacatcagtgcatcagttgtatctttgtttttataattaaatgaaacatttggtagaatcagtccaaggtataagtcaaattaaaaagataatttaagcaaatcttgaaaactgttggaatccaaagttttgcttggagcgtaggaaagggaaacaatgttacaaaattatatagatcgaggtctgatcgttgacatggaggtcaactcttgctagatattgtacctagttactagtcatgcatcgcgtgaatgtagagttttcaaccttatcagcgcacttgccagctattcacgtgtatatatatatatatatatatatatatccaactttgcagtggtatatatatgcaaataatagtcaacatattaatgatatttgtatattattttttattatattttcaactaataaagaagaataaatataatttaacattttttaccacataatatattaaatgaaagatagtacaataatataaaggtaaaatagtcgataaattaataatataaaatgattttataattattttataataatttgtcatatataataaatttattaattacttaatttaaaaatcatacataacataacactacgtctagctaagaatatatttttgactaataatattttatgtttagatgagtgtttgtaaaataaattttaattaaaattgattttcaagtaaaataatttatatttagattcttttaaactaaaaacaaatttgctgtaaaaattaatataaatttttcaactcaaaacaaaaactatttcctatcacttttagtgcacgtgaagttccacacctagaaggaaattacaaattattacttctacctcgtttatttatatttgatataattttattagataacatgcattcataattataactacattgtttaagactttctaataactataaattataattttttaagtgtgtatctgtgataacattggatataacgcaatgcagaagcaatttaggtattactttggcttttttgtctcagaatgctaaatttttcatttgatgtggttgcaacgcctaaccaaacataggatacgcgtcatttcatttatttgtatatgacacaatttcattagatatgcatgcataatgtgtaaccaaacacattcttagtcaaaccaggattttaatcaaagtaaaaatagttttatccaacaatatattcaaacatttatatttttactaaattaagtttaacggaattcaagatcaatgctttctactatgaaatggaacacactcaataataagatatgccaacatacttattcaagtgggaggcttctggtttataggtttcccaatttttagacttgtaggctgaactgatagatcaatatttggtgatgaaacaggcatggcatggccccatagaaaggtaggaagcctcaaattcacacttgagtatacttgaatttaacctctttatactactttattttgaaaaatgaaaaaaaatatatggtccaaagtctcgtccagaaaaaaaaacacaaaacgtctgcatagactgggtgacaattaatcatgcaacagcacgacgaagcatatatagaaaaattcaaagttagcgaactcaatttcttctctctctgatccgcaacggtcctcaattgatacaaggtattggaaaagaatgcaaacaacaacaaaaacaacaaacaccaaatctgctcaccccgaaacctatatagaaaagcaacaagaggaaaaaagcaccgcattggttccagttctttggttaatttggaacttccttttggccccttctctcccctcgatactcacaattaaccttctctctctacatgcacaataacaagtccaaccacaacaacaaacaacaatccaacgtagtaacaaatgtaaacggtctctcccttcacaagttcacgtttattcattaattctttccccaaaaagtcaaaatatacttctcttctcacacttaaaaccccaccctcccccacacacttatgctcactttttaaacatttaattaatatttataatttttctttgtttctctttttcatattacatcataatccttataatattttctttttctttttctcacattagctatataataggatattcatgaatatttttctccaaaatcattttgtaaatttttttgtcgataattaatcttttgttaaaaatatatttaattatttttaatgaaatttgatctcttaataaaaatttccctatataattatatttattatatattaaaacttgggactttatctagagaatccaaatacagtttcactgcgagaaacctaatattgttaccccacatttatgctgctccatctttcacatgccacactttcttcttaaaccaaccattccacttccactagctagctagataaatcttctctttctcttttcctcttcctgtgaataatatcgtgcatgtccgcaactatggtgcagcagcagcaccgcggagagcaagagaaacgacatcggttcttcataaacgacaacattgacattctccgggaaatccttaaacgcctcgacggtccctcgctgggcgtggcggcgtgcgtgtgtcgactgtggtgcagcctcacgcgcaacgacgactcgctgtgggagcacctgtgcttccgccacgtatcctcaccgccgccggcgtcggtgagggcggtggtggtagcgctgggcgggtacaagcggctgtacatggtgtgcgtgagaccggtgctgagtcgactcggaaactcggagcgggtgaggaagcgagtgtggactcggcacgaggtgcagctctcgctctccttgttttgcattgacagctacgagaggctcgggagtggaaggatccccagcgacgcgtccgcatcgtccctcatgttcctctgcaacactgtcaacgtctgatctcatcatctctcatttttccaccatttctcattattcctttgatatcttaccaaaaaaaaaaaaaaataataatcaaatcttggtccctgccttgcccaggaaataagaagcacgtactgccccggtattgatttgtctaccatataccaaattaaaatatcaccaatttgtttgtttattctcatctcttaatttcctcatatttttgttatattatattataatagaattttttatcagcaaacattaatgattagtattattagttgttattactcataaatttaaagttgttaactattttttatcttcttcttccatcactatatcaatcttatatcttaatgcacatatcaataaaaagttgtgataagcgtggatcagtgatgaatgggtctttatcttttatttgtgtatatgaagctaggtagttcatttgacaatcaattgattttgttaaccaaggtttaattagttgaactagtactctattttaaactttgctttattacttcctatcatcgtcctccatttttttcttgagtaatgttttatatcatccaacttcatcatcttactagtttttatagtaagtattgaataaaaataaaatatttaatatcttaaaaatataaaaacttaccacaaaagatagtagataaatttgtagaagaatgaagtttgaggatttaaaattatttatttttctttaatttgattttgccagtaaccttttccttttttcttttttttagttgccctccttgcttccttccttcaaattactttttttctttctttacggcgaagttagtaatcaatgcacatggttagcatctttttaatttatgtattttttttaatccttctaaaattgggatagtaccgttgatattctattaactatttataatttattacagtaattgggagctatagcccagtttagaagtgttattcgtaattcacaaaaaaaaaagtgttattcgtacactccaaaggcccagagataattcactttttaactttttcagtaacaacgtgttcccccccccccccctccctccctccctctctcaaaagagtaatgttatttctataacaaaattttaccataattttacgtacactttcactttttttattttatctctttttattacaccattccttctatatatgtttttcttctttttaatttctctcactcgtgtattattgtaaaaatttgttccaaaaaatttatcaaattattaaatatttactgatatgatctattattataaatttataattgttaaaactaaactgacattaaaatagatacaaatattttttttactgaatagatacaaatatatataaagttagctagaaatacacctaatttatatgtcactataaaaacttcaatttttgtcttcgaatctaccagtcatatataccaaatgtattttcaaataaagaacatgatttatttactttgatattagtcttttaagtttttgtacaacttttataaaagttcaacctaatttaaaggcatatttaaaagcttattctatagccaagttttttaaatagaaaaacaaacctaagtgcactaaagcccatggctagcgaatcttcttaactttcacggaaactatcaaagactaagctttaattttgagtaagttaataagcatataattttgagacaatcatagaaaaaatttagtttttgatataagtaaaaacaaagatgataccatcttaaaaaaaaaaaaaaaaaaaaaaaaaacaaagatgatactatttttttttactgatgagacattcaaatatataaacttattgaactgttgagaatatttgtaattagcaaattctacaatacaatactctaaaacggatacaaagcgggcataaagtgtaatattttaatgatatcaatcatggaaaaaatatgatatcacgtcaaatttttactagataatcatattcaataagacgggcaaatcaaggtgaaaaattctttgctgaatagtctatttttgaaatggcggggtagcacaaaattttcaaatgtcaaaatcaaaacttccatctccttcgttgattaatttaattcacctccgtaaaaggttattttacagtatgagtagtgttgaagaatacgaaaaagaaaaaaaacaagtgtccttcttattgattgagacagagcaaacacaatcaacccagtggacaaacaaacatgttactgtgatcattgactcaaagtatgcatccaatccaaccacttcaatttttggcagaaccagatttttcaagattcaactgttgtccgtttgattctgtactcaacatcatttcatttcaagtttcaaccgatacattaatattgttttggtccttcattacattaatattttttttggtcaccacattacattaatttggttgttactttcagagacgaatgtcattgggccttccccgttagcccaaataaatatttcagagaccccatatttttgctggttaagtccaaattatttgacattgacaacttgaaatcgatgtcagaactcagaagtttaagtagaactcaacctaaaaaattgcaagttcaatcgcaccaaactggttaaaaattgtaaacccaagtgaaataaaatggttaaaaatgttgcatccaaaaaagaagaagaaataaagtctttcttttttgtgtgtaagaaagtagtaagtcaagcacacacaaaaaaaggaagtttagattactaaaataaaagtagatagattatacacccaattccaattattacatttatacagtcatttatgactccataaatacgtatttaatgctaaccaattaaaatgtctacaataataccaatcaaatttgaatttaatactctcttcatttttatttataagattgaattgattaaattatctttattaactgtcaaaaataaaaatgttatattaaatcttgcatcattagactagtgggttattttaaatagttttataatatcttatattaattctctttttttataagatgggaaaatattaaataattttgttgtttttaaaaataaaatataaaataatcaatgtggagcattcacaagtgcccaatgcccatcactgataattctccaaatcatcatccaacctcacaccaactacagaacacagtctctaacttccaacttccgcaaaatatataagtttaaactaaatttaagatgcaataaaaaaaatgcgaaacataaaacaaaagaaagtattagtagttttctttttttctttttttcttaaaaagaaataataaataataataaatttgctatgcagtctttagtcattacgcacctacggtgcacgttagcttgttccaaccacctcagtaataacagcgtttacttgctctgaaaattatcatcattttatttataataattcctatttttattttggtctcttctctttctgatcggcgattgtcggaagctcctattcatcgccgccaccttgcgccgaatcggacccacttcggatccgagagccacccgaatcctttcttcacagtttttgtttttccatagcaaaggcttcacctttaccatttaccacacaccactgtgtccatacaaatcgggttctgtgttttcctgtttttagcgaagcgagattcacacacaattttgcttcatctcgtaactacacgtgtcgatctggctcttcttcaacaccccattatcgtctccaatctcagttagtttttttttttttttttaattgttgtgattatttttattgcatatgcctttttttttttccgaattaatttaaattatgagtataaattttgggggttttagtcttaagactttcgatctatgcgcaaaagttttaggttttgtcaaatttgggtgaattgggtgctgattgaaagatgggtcacctctacccgttgattaatgttttattgattttgaaattggaagatttaggaaatagactggaaagtaaagtttaatgctttatgtggaaaattcaaaaattgtgtttcaatcaactaaatgccacgatctgttcgttttattccacatttttggcgtatttgagatggagggttcttggtttctcggtaacaatagggagcataagttctagattgatgttggcaaatgtctgtttaattttgtgaaaatgtttgagttggtgtttttggatctcagatgaaagttttgtgagttttaaaattaaaattacttacttggttttttttgtttcaaaacttttgcagagatggaaacgaggttatgtatgatattggaaaagatgttgggctggtcgtagtttctgtttcaagagttcagttgtgaagtgatcttttgttcctacatggaagcaaacaaggaggaagcacttaaagcgatagagattgctgaaaagcgctttgctctgagagactttgccggtgctaaaaactatgctgtaaaggctaaaactctctgtccaggattggagggtatatctcaaatggtggccacatttgaagtttacattgcttctgaggtcaaacataatggtgagctagattactattcgattcttggattaaaaccttttgcagataaggaggctgtaaaaaaacagtacaagaagttggcggtgttgcttcacccagataagaacaaatgtgtgggagctgatgaggcatttaagcttgtttctgaggcttggacttggctatcagatagtgctatgcgcagttcttatgatctcaagagaaatgtgcagttgggtgggactaaccagacgaatttgtctcctgcccatgctaaaggggccgcaggttataacaaatattccaatttgtcaacccctcgtggtgggcttgacaccttttggacaatctgcacctcttgtaaggttcagtatgagtatctgcgcaagtatgtgaataaaagactctcttgtaagaactgtcgtggcacttttgttgctgttgaaactggggcggccccagcaaatggttcgtttccatattgtccttggtcatatgtagcaggaaatgggtatggaagtcattcatttgatggagttacatatgttccaactagtgcccctatttcaatgggaatggggtcacaggataccattctggacatggatatgagtacgtccccaatgtttcatttcagtggggctctgctggagttgtcaaccaaaatggatcagctaccttacctgctgattctgttcatcaggccaatggaaatgtgaagaggggaagaccaaaagtcaagtcaggagctgataagagacatcacatggtagagactatggtcaatacaaattcagacataatattctcctgtagtgaaccacaggaagataaactaagtagacctgacaagaaacagaaagttgttatgggagccagtttcagaaatggctatgaagaaaagggttcaaaacgtgcttcagagttgatagtggctaacggaaatgatagcatgggacaatgccaaaagccttcctgcacagttgaagttcaaaccaaacaatgttacatggcaccggcctttgacgcgagaaaattgttgattgagaaagccaggaaagaaatcaggaagaaactggaggagatgaagttgtcatctgaagcaacagcagcagcagtagctgcagctctgaatgagagagaaaaatcacaagctgaagttggtcaagtaagaagagagacatgtagaaaagcagctctgaatgtttctggtctacagttagagaatgggaaaactggtccaatgtcaattactgtcccagattctgactttcatgactttgacaaagataggtcagaggaatgcttcaggccaaagcaaatatgggccttgtatgatgaggaagatggaatgccacggttgtattgtatgatccgtgaggttgtgtctgtcaatccatttaagattcacatcagttacttgagttccaaaactgatagtgagtttggctcagtaaactggcttgattcaggttttaccaaatcttgtggaaatttcagggcttttaattcagatgctgttgatcaagttaacatattttctcatgttctaagtaaggagaaggctgctcgaggtggttgcgtccgaatatatcccagaagtggagatatttgggctgtgtatcgaaattggtcgtcggattggaacagatctactccagatgaagtgaggcatcagtatgaaatggttgaggtgctggatgattactcggaggaacttggtgtttgtgttagtcctcttattaagttagctggatttaaaacagtatatcagagtaatacagacaagagtgccataaaatggatacccagaagagagatgttgcgcttttcacatcaagtgccttcttggttgctgaagggggaggctagcaatttgcctgaaaggtgttgggaccttgatccggctgcaactccagatgagcttcttcatgctgctacagaaccaaatgctttgtaggttatgcaatagtgaaaacaattatttgggttgtgctttagcattcttcccagagtattttagatttaactgtacactatgtctctcttggttagagaccaatgagatattaacaacggatgttttagaaggtgaaattttattttgtaacatttgtctggtagactttaagatctagtgatttgcttgtttggtaaagtttcttctctgtaactcttgtgagagaggtcaggacagattgcctgcttgtaactctatttccgaccagtttttactggttggtaaagaattcattcaattaaaggctgaaatcaattttaaatccaacaactttaaagagagaaaagaagaattaagaggattattgtattgtattgtatgcaagtgagcaagtatgcagaaaattgttaatttgatgtcactgatcctccttttccgaaccgaatactaacgggttccaaaacaaattgttgagcttagtactaaaacgttgataacctttttgagtgatgactaccaaagctagtgtttactcttattgaaactacacttataatgctacatctacatgttagataacaaacttttcaatttgtcaacctcgtgattggcttgacataacttgtcagaactgctgtgggaggggcactttcttgctattgaaactatggcagtgccagcaagcagtccatttggtcatacagtcatactcatacgtgcctaaaatgggcgtgaaatccattcatttgatgaagttacacgtatttgttctaactagtgccagtagaatggatatgaaagtatgtattctagttagtgccaactatttcaacggtaatggggttacaggatggacatggacatgacaatgttcaaaagtttcagaggagctatactagaccctacaatcaaaatggacctaccaccttacatgctgatatgacaatgttcaaatttggcaatgactgcggtcaatggtcaatataaaagatgtatcattctgtcattgtgttagcttataggatacattcatcaatcagcttacaaactcagatgtatcattctatcactcagatgatcaaacccgaggcatatattgtttacgtgagttcaagggataagagtattacatgatatatacactatgttcatcaatcaaaccataggatgcctgcaggctgcagcaatgttactttttaaggtaaaagctgcaaccatgcatgagtttattagcataagtctgtgctaacaaaactactggcatattttattttggcaatttgatttattttagaagcatgacagtgacttaatggttattgatgttatatgtgttacagattattttcatgccagatataaagcacaagagttcacgtgaatactcgagaatcaagattttgcttctaaaagactaaaactgagtcatgcatgcattgatgatcatttgttaatgtcataatatatagtcactggcttttgtaaatttctatttgatacaagattgtcattcttagcttatatatgttggatagtccgagaacaatgttgcttcagatgaacagagagtaggggaatatagtttgcgtaattcagtctcattactcttagtaaagtaacacaatattatcaaggtggagcttcaaaagagattgcagaaaacaatagtcaactatttgtcatagtcaagaatttctggggattggttgatcaagcttgcattgagattgcacgtgacatcagcagaaccccaaggcaatttccaattccagctaatcatcagcagaggaactaacacaaagaagtcatgagattttcaaactgttggaatatatatatcatattagataactctaaaaatggattcaacttatgctagagttttgaataattggagtctcaatagcaagacacaagttacgatggcaccagaaagagtttgtgaaaaacctgcaactcaaagaccagtgttgctggcttgctgctaaccattcagaaattgaaaccatctttatggttataccagttttctagtgttaaatgtctaaatgtatgtgtcaatgtgttaaaaactgtattgctctagtgtaattttaattctcgtgtatattattgttagattagtttaccatcaaccataacttggttgttctcttcttgtcttctgatgtgaaatcactttgtagctcccggatttttatgtacaatttgtagtttgattgagaaaaaaaagtgatatagttaggcttttcactttataaaaagccaaagagggagggggatgcctaattcctttttcaatattagtatacagataaagtatacattatacagtccttgctttgtaaaaaacaaaaaggaagatttgtataaaaaccaaattcatcagggacaaaactcttaaaacaagaataagagcatcgtgtaaaactgaaaataagtaaagagagtactaagagattatctacaatgcaagaaaaagaactggaagtaatattgatataacaccttataacacaaagtaagcaaaaccggtgtgaaatagcatccatcgcaccaaatatattgggatcttacgggaagtaattaagataccttgctttagttaaacttggagattaccattgtctgtgacctctctgcttgtaaaaaatagaagcagaggaactttttaagcaattccaaactgccttttatttgcaatgtttgtggacgctctttagtgtcacaaaatggaggatctcacaaaattatggcaaaagacttaatttcttgtccaaccttcctttcaaagatgcaactctatcagatggacttgaagatattatagacaccaggcacagagagttcccaagcattctatgttccttcaagcaaggctttgctaccactgacaagttggcagtgcttgaagctcattggaatgaggacgaggtagccattactcttgtttcaaaaatatccgaggcagggacattcatggatgaagctcaacagaaggaacaagttttgaaggaacggttcattagattgaaggaagaaatgaaagactgtgaggccgccttatcatctctgagagagtaaaagaagaaatgcattgcagaaactatagggtacaaaaaggagcttgaaaatgtgagaaaaatggtggaagatcaaagcaaagttcggtaagaattatttgaggtcgcttataaatggtgggctctgtgtagccaatttgagcacaatcccatcgctgctagaaatccctcgagtcttcaggattttcattgtttattgcttttttaaaggaccaaatttatcatctttcggaggctactatgttattaattgtttactgaaatgaaagtcttgtgcaactactgtgctattcatgatgagtgttttgtttctggtattgtatgctgcaatattttcacgtagcttggttttctacgtttctttttccacatagagcttgaaacacctattgtattatgtcccggaaaaaaaatactcgaagcgaaaggttccgaaattgcattagtcaaggtgcaaatagctaataggagtcaatgaagcaactgagtgaaatagaaataaggcccagtatttgcattcttttaatacttatttggaataacatttttcaacaaaaataataattagttttcgttatttattttcttaagaaaattataatttttaaaaatctaaaaagaaacgtcaggagttagaaaactatgaaatgaatcttgaattccatcacattctaaacatatcatttacaaatgattagcaattttcctcgtgtttaaaacgaatatttaaaaaacaaaaagcgaggtttataaaaactaagaaggctggatttttttaaaaaaataaataaaaaatgaagaatatgttataagtttgatttcaaccgttcaataaataaaaaatgatgatgatcaaattatatttggctttgcaccaaacactattatgtatacaaaattaatagagtctggtagaagaacaagaatatcttaaaagtatggaagataaagtcgaaaggttgagtgtgtcctcctcagtgcgtcacaactcagaacttagttatatggataagaacaagaaaagaaagagtcttcaatattggacttaacttataatcttttgtataattaaactttgcaacataaaacaattagggagtttctttttgtactccttgttattctaagtatactctccatttgtctctgttaaattttattttaataatttatttatacaggtagttaaatttgacaatctgaaaattaaatttgaaaaatgaaaaaaaaaaaaaaaaaacatttaagatgtgataaaatttcaaaatgcaactgcggattttagtgttgtaagttgtaacttacaatgctttaattgatcagaaggaggtaaattgatcataataatatataatctactaatctagggagggagggagttgagagtcccttgtataactctttagtagtgtgagattctagtactttcttagattacctgagtgtatgactagcaaattccatcccctttctctgtgatttgcaatgtatttggtgatcacggtatcctcttaagattccaagttcctattttgagttcattatcaccttccttggaacaaaatgatgctctttgaatgaataaagtagagaatgacgttcgatggttaacttactacaacatgaaatttaggcttctattactacatcttttaaaaaaggaagggtgttcgtaaaaataaattagatacactttttttttctcctaaaccaaacacgtatagaaggagaacattaaaataaaaatcaacaaaataatacgcttagaaaaagtgagtacaacatgaaatttattgggcacttctgattttaacctgttatgttgttaattactcgttattgcccccaaaactaagggagcaatcaggacaagtgaatgagtcattgacaatgacgactagataacaataataaaagtagataatacaactcgtgaaaaaaaaaaaagaccaagactaaagcttttatagcatgaataagacaaaagacccaagacttggcttttttaaaactagtttcagtacccgtgcgcatacgcacgggacggctccgcttcgctccgccgtgctatgctaaaatttaatgtctacttctccacatatagcacattatacagttcatatcagctccgtaaaatatataattcacatgtttcagaaattaaaaataggagttaacatccattcaaattttttataccaacttgaaagttgcacagcaaacctatggtcatcaagcaaaaacaaaaatggagagaaaaagctttatatatatatatatatatatatatactttatattttataatgatggaatctactgtgactgcttttcatttcaatgaatggaatgtggatataatttctccttcctttcaagtttcaaatgtttgtgcttatgtagaaataggaatgtagttgatccgggaagttgacaaatgacaatataaattgtgaaatgctttatctatctttcatttacttttgtagggataaccttgacagctatacaagtgactacactgcacaagtcttggtggggtactgcgtggcatatattttcatgcagactttcatgattccagggactgtgttcatgtcattgcttgctggagcattccttggagtctttaaaggtgtggctctggttgttttcactgccacaacaggagcttcttcatgcaatttcctgtctaaacttattggacaaagttgaaattcttccaaacccaggtttgtttttaacttcccattacattggatttgatttaatctaagcatggaattaaatttctacttttatcctccaggtggctaaaagaagaaagggtttgttgaactacatgctttttctaagactgactccaaccctgtccaacacatttattaattttgcttctccaattgtggatgtgccttatcatattttctgcttggcaactgttattgggctgatacctgctacctatgtcactgtcaaggtatgtagctattgaaaaaacaaatcttatctataaattttatatgtaaaacaaattttacaataaatggagaaaaagagagaggagagagaaaagcgtaagatgtaattactaattaatgatgtgatagtgatagagagagatagaaaaaaaaaatgatatacagattgttgtacaaatagcataactcgttttttttgttttttttgcacttcgtttttgcaaattgagttgttatgctaacagcatatcaatgctcttaattggaaactgaaataaagttcacaatctagtttctactatagctttctgtaaatactccacatgttggataattttctattatcttaatgaatcatacacatttttatttcaatgtcactgtgattgtctgagtttctggttttgttatgcaggctgggttgactctgggagagttgaaattcataatcagattcatatgattaaatctatatataaaaagtgtgaaatagatatttgattaaaaaatatagatcaccttagaatccaacaacaccatctccattaaaaatgcaatttttggtcttgagaaatcagaaaccaaatgtagccaaataaatctaacaattttatacccttaaattagctgctgtagagctggaataacttgttttgcctcaagaaaatcattaggtaagatcatacatttctttttaaaaaattggaagaacgaaaagaagataggtttcttagcaaaattggaataacttgttttgcctcaagaaaatcattagctaagatcataataggcacagtgtacatatcagctaatgccacacccaccagccaccttatattgcccataccttctggatgacacggcaaccatacatttgaaggctaagtgccagatttgttggctagttctcttctctgggatgcaagtccatgctcaaaaaactgcaatataccattaaggcattaccaactatttctcaggctagattaatgaaagaaaataattaatttaaagagtaatggttaccttttgaaccacataattaccaaagacatcagtcatgaaagcaagggcatgtggcatgatttcctggtaaaccatgtttttttcttctgtagtaggtgtttcaagcttttgttgaataagtcgactcccatattgatccgcactgccaatgataataaaataatcaaatttaattcttcagtgtggcagcataaaatggacaatagcaaaaaatatacctaaattcaacatgaccagcaatttcagacagctcaaaacaataaattcatgtaaagaaaaacaataacactaccatcatgtaaagaaacttacttctgcttggctacttgcatgaagtctaactcccatggcatcatacattacctacaaaagttacagaaaatctaatcatcccactcaataatagtaaagattccttaaaacaaattatagtaccaaagataaggaagctcaacacatttgtcaaatgactccttaacagtttattctaacaatttaaggtgtgaaaaatgtcaatcaatgcacacatagattactatgtttaagagagaaaaaaaccatttttttatgagaagggacagatagcatgtcaatctacaaaacattattccaaatgttttaaagaaattagtatagaaagaggatacaatggtacaaacacgttaaaaataaagatataaataaattttatacagagtgaaatgttgtagatcgtttaatttgggacaagaattaaagacttgtatgtattttgatttggagctcatgctttgctttttctttggtttggatcttactgagttttgaatatttttttcaactgttgatagggcaagacaattgaaagggatgaggttggggggtgttcactgggtataactatggcccattaaattatatccttagatggattgaggaagtagtgacattaatttggatcaatgttaaaagcagtggcatctgggcttatgattacctatatcctcatatgcgtatctgcaaatgataatggatttcctagatgtaactgtgatgatgaggccagcttgtggactattgaaagcattctagagtgtataaaaagtatttaacagtacccccccccaaaaaaaaacaaaaaaagttaacacaattattacttaaggaagtacattaaaaacaaagaactaataacagggtatatattcttgaaaagtgaaaaaaatgtggaaataaacttgcttagatacctgcacacccttcaaagaagtcataatctcagttacacgctgttcagtcataactttccaattcacaaaacttttatgtgtctcctcttgagaaatatcaaaataaatgttcataaacttctattcaagacaacaaaccattgaattattatattattcacctccatcaaacacatttcacttttttcttgcttcttggcaatgagctcttgcatgtctctgctatgcaaattaacttattaaaactgaacatataatagtaagcatacaaaattatttatgaaatttaagtttccaagttcaatactttttcatctgggccatttcaatttgagtttcctctgatcatatttttttttctttatcactttctctttgtgtcgttaatcctttattctaattattttcattgttccaatttatgtgagataaaggtcaaaggaactcatgtttgattcagagatcaagaaaagtactatataattaaaggctaaccacaataaaaccatgggagaactcgactacagcaaattatagccaaaacatgaaactacctctcaacatttgaagaaccaatggctgaagaagcaccacctaagctgccacttaggcacactcttggcaactatattgcagcaataagtattacatcctcttgttactgccaacagttttgaaatcaatccaacacttattaaaagtgcaatggaaaaataaatgagaaagcaacaaacaatgaaaaatgtaaatataaattatatattgactaaatataaattctgccaacagtttactgttcaaagaagaaccacctaaacaaagaaatgaaccaccctcacctcaacaaactcccccaaggctgcccgtgcctgacctctcctcttccatgccgcaccagctgatggattaaattctatagcctaagaaatacaatgtggactacttataaatagaggagatacccagtactttcatttttaacacctttaggatctctatgtacctaacacatgtgtttgttcaataaaaagtttttaaatgtacataaaagaaaaccacccgaacaacagaaatgaaagcctacccttgttcaatgaaaccgtcgcctgaggtcgatgaaaccgtcgtcgttttggtcgagctcctcgatcatgccttcaactcctcgtacgtcattttggatctgagcgcggagaccatgtccttcagctccgtcatcgagatttttccctctctcttgtcgaacttgtgagagacaaagagagacaggaagtgtgtgtgtgagagagagaaagagagaaagagagaggttgagttttgaatttcaaatgagcacagccttcctcactccttgtcccaagcttttcccgcttcctcaactttttttcgtataatgaacaggtaatgaagcgtgtaggatgaaaaatttgaattcgaaaattgcgttctccatttctcatggtctgaaaagaatgatgatagcctcaacagctctctaaacttctgaatgtgataatagttggtgaagaaatgacagttgctgagagttgttgaaagctgcagagagaaggtttacaaagattgctcagcgttcatttttctttcttcagctttgtgtttcttcatttcttcattcagctctgtgtgtggacaagcttaacacgtggctgaagctgaggaagcttgttattaacatgacacgtggtgaaaatggctcaaattgcttgagggagtaacacgtcagcttctctagccttcttttattacaatagatagataacacgtatacaagcttgtgatttcgaggatcactacctcctaactctccaagagagttcaacctcacctcctctctcccttttatacattctcgccccccatcagttagttataactaattatcttttagttatactaactgtagttaatcactaaattgctatctaaaccctctgtgatatgtttcaccccacctagcactcctatcagagcatcagatacattggtcttttgcatattcagtattaactacctaaaccaaaaatagaattatgatgctatctctagttttccaattcatatgcatacaattttaaataatatataatctatggaatattttcactactaaattgaagaaagcaccttagcaacaactttgggtgggtattctcctcatagtcttgtatcaacacactgcctgactttatcctcagtgagttttggtgtagcctgaaacagtatacatcaattgctgtcatcagtttcatcagctaggattttagagtcgacaatagactataatggtatgcatcaaacaacaactatagaagtaccactatattttccatgtccaagacttgaaaactcattttttgttaattggtattcaccatcgtgtatagcataggcctcagactcagtattagctgcctgcttattatggtcaatagcaaatcagtttagtcacatacgaataagagcttaagagcttacacattgagaagataaacatatacagaaaatggcaccactgaaatgataattgaattgatataaacctctgaattacaattacatttttatggtgaggggaggagggagaaaactatgatgccgtcaaccaaagtcaccagtgacgtgactcttcaaaagacattagaaaaaacccacaaaaaagccaagaattgatgaccacatgaaccaaacatcccatgtggtctagcaagaaaaaaatttgacttcgttcttgattgtattataacaatagcacttcagtttgaattataccaatacaagtagtcagataacttcatcataatgatcctatagccacatatatcttaaacatgtattcatgcgtttgacagaactaagaactaagaagggaagggcaataataatggaataaaatatgtagacagcaaaatttaaaactatatagataaaatattgaaacttcttatcccaagtactgtcaatgtaaaaccaaaagattagaccaccacaacaggagcataccttcatcatcaccaaataaactgtgtttaagcttctcctcagcagttcgcccaactttaccacttccaacaaactcctcccccagagggctcctcctcagtatccctcctgccttttttcagccacttgaactgtttgctctccttatgaattattaaaaattattgtcaatatttatccaccaaaagccacaattaataaaaaaaattgaaacacatatacaaaaaattcaaaaccttcagacgatgaatattgatattattgtcctccagcaattcataatcatcttcatcaaggacataagccagccaaaaaggaagggcaaaagcaagccatggacattgttgaaatttaaaaaaataaaaggaagggcaaaagcaagccatggacattgttgaaatttaaaaaaataaaagacagattttaacattgcattattgaaatttagcaggtacttctgctccttcattttctttttcttttaaggaaagaaaacaatactttatcttttagaatacacataaaaaaatgataggattctgaaataccaataccatcaactgagcaaaggctaggttgtgcccagtgtctaccattcatcctgaacacccttttaggttgatcctataccatgattaccatctgcacaataatgataagaataaaaaagtttttaaatgtacataaaataaaaccacccgaacagcagaaatgaaagcttacccttgtacaatacatggttggatacatggaggagtggcaaaaaaattgcattaaaaacatgaaaaagacttctcgtgactaatactatgtctgtgtattacgtaatccagtgtgatattttttagacattgacagttacagggcagaaaagtataaatcttttcaaggcaattgtgagaatatttggagctcgtttcactatgagacgtttccacgccttgacataacccttgcacctgcaaacaccataactaagttaagacagaacctgcctgtcacattagttcagttaagaaacactaaggttattgaaagaatgaattagtaagagaaattgtgttaggctacacattagttctgttatttattgattggtttacaatcaattagaccataatctcagcagaccaaaaactattctctatcctaataatcgataattggtcattctaatttaatgaacacaaatatggatggttgactatatattctaacatttatgttagtgttctaatttacatgttaatattctaacaatgatcaattccagagcagcttttctgtataaaattaataattaatttacaatatttttctaagcaatctgacccatcacatttatacactccttggcagtaaattggtctagacattcctccaaggaagcagcatctccatgaatttcaacagtcaagtccatcatattgtcattgatttgaattcttctcacattcggtgcaaatcacctatttttttgaggaggaaaaagaagaacatgagagatggcagtgtcagcaagaatcactatgttgctataataattgccaattgagcaatgagctaaaaattatcttttaaatttgataaaggattacaaaaagtgaatctcttggccaatttgtatgatttaacttacagagactattattttccatcctgactaaaaaaacagagttctaaactattattcttagggccacttaggatggactaacttcttcagctcatgagattggaagaataaatgaaggaagcatcatctaatcatttcatgctaagttgcctacaatatcattttgtcactatgtttcattattatgcacaaaatggcacagactaaaaaggtgtccatactcaaaccagaaaacttcgattatagtctgattagtcatctaaccttagattgaaggaggccaccaaaaatgtgttggataagggttgtttcctgatgcctaggggggacaactttttctccaccaaattcatcaaggcaaacagattgcatagcaatgatagcatcaatggaaaacctgcaacaccattaaaatattggagggagaagaaacctttagtgtcataccaaaacatgacacttgtatatataaaatacaagctattcaaatacctaagatgcttgtataaaattttgtccatctataagaacaaaagaaattaatctgatgaaaaaaataagtaaccaaatattgttaaggcatttgaaagcagagggtgtttcttgatttatctcacggaatatgaaaaattgtaacacaataagtgaattaaaaaggtgaaggaaagtaatagcgaatactgaatagacatgatatatatgcttcggttttctattttcacatattgccacaataacacttttttttccaaatgatttagccatttcatgtaatctcatgaaataaaaaaagccatttatctcacaacagacatagattatatgagggaacaaaacttacgactttttcatacccatttagcattcaagccttataaaaacaaacccatttgcacactgcaggtacacgaccagagagacccagaatcgacccaaatgagcaaaaaaaaaaaagaaaaaaaaaacaaaattaatgtagttaggattaaggtaagaagagaagcatgtaccaatggtggtagcggcgcgagattgaagaactctttaccgagcgcgtggaattcgtatgtacgtgcaaggaaaggttgattctttcgatatgcaaggaacctaaaaagctaataataatgaagcagctaagtcagaaaaaaaaaaaaccacataacaaaaaagtgtgagaaaataaaaaaagaaagaaagaaaatacgcgttttgcgaggacaatactgttgtgtgttgagtctctgagtctagttcctccgtcttctccatcatttccatcgtcttttccccgctcaacaccacacaaaatcaaaattagggtttttcagaaaaaccctttttttttcttctccatcactccggccactgctccttctccagtgtacctgcaggtttcaacatcaatcagtttctaaattgaaaaagaataacaaaaatcccaaaaaatggcagtgaggcagaggacaacagtggtggtgcagtgacgaagaaacaaaagagaagagaaaaaaagagaggagaagatgaaggaagagagtccgacggaggagagggatttggtggagaaggcgatgcggaggtggtggcacaacggcggagtgggattgacggagagatggaacggagaaagaagaaaaagagagagagaatgaaggaaatttttgtgaacgaatatgaaagaagtggagcagttagcagagttggtggggaagtgaagctttggtctgaagttgaggagtggagaatccgaacctgggagaagctatgagtggagaatccgaacctgcgaagcaatgagaagcaacaaaccagctttcaccgaagctgagaagtgataccgaagctgggaaaagtgagaccgaagctgggagaagctgagccgaacctgcgaagcaaggagaagcaagaagcaggtaaggaaaatgttcttttattactgtatagatagatagatgatagaaacaaatagcactgatgattaaattagagaaatctgcttacatagagaataggcacttataagaacattgaaagtgacactgaaaacagtttcaggcagaagattcaacatggaaagcaattatcgagagacagagatagatagagatatgtctaaaaccaaggaagtaatcaaagatatacttcgagagatgcaccaaccatgaaagtctttgtccctgtctcactcttacactctccttatgcatgatgatgaattgaaatgttgctgcttcaacaaaggccaaagggcagattgatcatcaatgccacaaaacatgttgcttaaggttttttctttgaccatgtgaccaatgttttggcactgaatctctggccttgaagtagtttggaaaagatgagacactcctgttggtctagcaaaagatggtaagagggttctgctgttgctctgcagagtagatagaggactgtcaatagctgctgtacctgacatatgctgagctgtaatcgcttgtattgctgctggatcctcagtttctttgttgaggttgatggattcaattggttctttgctcttcagaggcaatatatgcagtagtagtggaagcactgaaaggttggagtatcaagtgtgtaatatcagcctaaaacaaaggcatcaatggacaatatatgataatttattcatactgactgcacaaaaaaaaatatagcagcgtatttcatgtcaactctatcgactattgagattcttcacattacctccattccttccacaagtaatatgtatgcctatgcaataaaacatcaattcagctaagtgacagacaaagaagttagtcatggatgtcaaagaagtcctctggttagaatttacagtgtttgtttttgcctcctttgagttaactttggagtttgtcagcctgcttaaacggcaaatggaaacctcagctttagccccattagcatgcttagtttctggcttcgcgagagttccattagtgcttttcttcatgccatctcctcctgctgatttggctgggaaagaaaggctcttggaaaggtttggcctgtgtgtctgagatgaagttgtggacttcaaattgagtttgtctttggtggcagatttgttgttatttgaagcaacaccacctttgccaccatgttcctaacaacgtttatatgaattagttagggtggaagatcatgtaatgtgtattctaaatgtaaatgattatcaatagtttaattgaagatacaattctgatacatcatataaggtaccttggcaagttttgagattttacttgctgcaggtttgggcccttcaacttttacaacagcttcagatacctcattcttggtctgaatttcagcattacaactgttttcagcttctttgtttatattctccttggttgtttccccaatgatgtgtttctcgtcctccatagcgactccattttcagattccattatgctataaatagtcacaaaaaataaagttgagtttagagatgattagttctacaaggtttctgaatcaagtaagtaaagacaacaaagacgaatagaaaatccaacacagtataaaaggcttctagcccaagtctaactacagttttcctgaaacatgtatggtttaattgtttttatctcagatcagactcttgacaccattaaattgcatgatgcgaatcattgggcatatgccattggatagtgaatgatgaaatcaatgaagaattgtcaaatctcttatcctcttttatgtgacatactcaattaactcaatgtagttttgcgcaaagtggtagcttgtactcttgagaatatatattatgcatatggcattgcaatccaataaaagctcacactcaaatcatagattttactaaaaaaaatccagatcatgcctatgctgtaattttggtatttcttcataaggaagccattctccgaaatgaaagtactattaaggacagatgcaaaagattaagactgatccatcttaatgtgcattctctgcaaaaatttccttccatccccttgaattttctagatacaaattctctattaacagaaattagcacaggacttgaattcattgcaaattttcaatgtttgacacaaatctagactcacatttatcaccacccctttcaagaatcaagcatgtatttactgtgctttaaaaggagctgtcatgaagaaatacaaagtttattcagtcatttgatcaaacacataacttgcaaactacaaatgagatcaacccaactaaaaaaaaacacaacatcattcagaaatgaaatcatttaccttatcaaaacaaaaattagtgtcaacgaaagttaaaggctgcgcaatagagcttaaatattgaacaaaacaaatcagagaatggagaaagagaactcaccgaaaatggtaaatgtcaagtaaaccacgagaatgggtcgctgaagaagcagagaacggagaagaaagcaacgcttcctcctttcgcggttagtttttttggaaaatactaaatcagagattaaattttgtctttggcggcaagatgatatctctaagcaaaataacttattaatgattcagagataaccaaaataacaggattatttattgctatttcttcagtccacaataaaatttctcatatcaaatgataaataaataaacacagcatctatcatagaaatattattaagtagagaggaattaccatggccaggtattagtgtgccagagtctttcactcccgcatctcgtttaatcattgattcagtgagatcaccaaaaacagacccaaggaaatttagacaaatcgatgcaataaaaggaatctagaagaccaaatttccacaaattaacataaatctagaaaaagtagagaaaaagtataagaaataaaaaaaagggactgcaaccaattaacacaaacaataaataaaaacaaaatttttaacattcacgaatccggaaatggtatcaagcttggatagagaatagagagcataagcatttagaaacctcatcgtgtccggcgaggttaatattctgcttcttgcaaaccttcgtgtctaaatcgagcagcgccggggccttcaacgcttcctaaagattgccggaagtcacacgctctctagtcgtgtggtgccgcttgctgggttctgatttctccggcaaaacaaataagagaagaagaaacaaagcaagcgtatacttaagcggaaaaatcagagagagcgtgagagagacagagacgaaatcgacggagagatggaacggagaaggaagcacagaagaaaaagagagagaatgaaaagaaaataaaaagaaatctgaggaaggagagacggagaggcgctgaggaaggaagaaaataaaaaaggaatggtagtgtggaccgtgaggtgaggaaggaagaaaataacgaagctgaggtatggtagtggaccgaagctgggagaagctgagaagtgataccgaagctaggagaggctgagcccgaagctgggagaagaggatccgaagctgcgaagcaaggagaagcaaaaaacaggtaaggaaaatgttcttttattactatatagatgaatgattagttgatcgtgtgggaatagtagtgctagcaatcgtctttgcagcagtggagcgtgagtgaggattctcttattctcttgtttctttggagattcgagcaatggaattcatctctgaaggtggtgtatatattaaaaatatggcagcaagttgtttaatttgcaatttttgcggtttctgtattctaatataataatttcctttgggagtctgcagatcatatatatgtttgtggcgtaacgcaactgtcctagattaatttcaccgtctcttgcttgtaaagtcatcgatctacacttgtttctcaccaatctctgcatataactcaattccttgaatcttctgtaagaggagaggtaagcttacgtatttttgctcatttcctatttgcatggatgacatgttcagtccaaaatccaaatcaattctccttccccccagggctactaaatctgctaattctttggtacctatagataaaataaaaacaagaacaagtggatatgaattttctatacataatacttagtttaagttttaataaaatatgtgtccattaataatgataagtttcatataaaataaaaaagaaaatgataaattaatataatataaaattataaaaatgataaactaatataaatgactgaattatatgttttataaataaaatattaataaatagtgaaacaatttatatttgctgtgtgtttttaaatatatgtttccatttatcttaaaattgttttagtcaaatgtaaaataaacataaaaatataggttcaaccctatttttacatgattttttttattgatttttactagttttggatctatttaaccggatatttattggttctcacaagtttcgcaatgatccatcttttataattaactaattagatactaactcgattctcagtcaaattgactcgtctgattttaaaaataagagcagacttttctaatatctattgattcttataaatacaaataaaataaaattgagagaaccaatatttgttttagcaatactataactggttttttcgaaaagataaaatcaaattagagaaaggtatatataaaaaaatgaccaagacttgctcttttagtataataattagcttaagtatatttttatctctgataaataagctaattttgattttgttctgtataacttttttatttaattcctatttttaatgaaatccatgttattgctctggttagatttaggcccatttaaaagcttatttgaacttatcttatgttaacatcttatgacaggtttataaaatgtttttaaatagcttataagaacaacttattcagagcctatggaaagactcatctttgaatcctgccaatgcaaaaaatataaaacatgcgtattttttattattattttgacttaaatatgtttttatctttaagatataacttttttttttacttttagtctctaatttttatttttatttttacttttcatccttgaaaatttcttttcttggatttggtccttattttgtgttatttttccccccactaatacatcagttttatttgttttagtctttgtaataatttgttttttttttaattagttccttttaaaaaattataatagaaatgtacctacatgaaataggtaactttcttccctatgtcttcttcttgagaatctctttctttcacaatataataatcaataattcgaagggtgggatatcaacaaaagatactccaacccttaagtaaggtctcgattgagagcaataaacaagtgtattaaatgagaatgaataatgtccttatcttgatattcacgtaattatttatacataacttagtaggtcgatccatggactcttacacatggttacctttataggtaatgttcctctaatcatcattaagggattaaattaatccttaattactattatttagaataaactagacattttatttccaaataagtaacaagggagcttaggtgttcgactaggtctgagtacttgactacatacagggacccctttcagacaacattgtaacgagagtaatcgggtgtttggctaagccaaacaccagggtacttatgtagagagattatcatgggtgacaagatgatgagagtactcaggagttcgacatagtcgaccacctaagtacttatgtagagagatcactttgggtgacaaggagattagcgtattttgcctagccgaacacttgaatacttatgtagagagatcaccttgggtgacaaggtgatttagagtactcgggtattcggcctaatcgaacacctgagtacttatgcagagagatcaccttgggtgaaaaggtgataagagtattcgacctaaccaaatacttgagtactttagaagagatatgctttaatgtcctaaaaatattactagggatatttatgagcattcggctcagtcagatacccatacggtataagaaattatactaataaatttcattgaaggactaggatctcatgcaatggtaaagccattgctagaaacgagcggggaactagccgaggaggggggagtaggttgggagggaggaggggaggacggtgtcggtggagtcatggaaggagggggaggtgaggaagccattaacggtggcgaagagggtggcgaaggaggaggagatggtgtagttcacgcgtttggatgtcaacagttcattcgtttggaggtctgacttgaccaattcttatgtgtatcgctgacgtgtccaactaacgaacacgtcatcacgttttagacggagactaacgatatgtatcttccacaaaacttttgaagttttagggactcaatgagaagtaattttttttcaggaatcatttacaaaattcaagtatattttaaggatctccaaaatatttaaatcttttaaatataaaacattaaaactaatcactacaactaactccataacttcttttttgtactataaaagtgatttttagacaatgtaaagttgtaaacaaaataaattatcttaaaatcatttttatctaataagtatatgttcaatatgtatatacataatttatttttataattaattataaacttactacgtaggatgttcatcttttttgttcaggttaaagaaagttgcatttagtggagcaaattgatggaatgcctttacggttttgcatcttctatttcaagagatttagtgtgtggagcaataaatcaattacgttatccttgttgttttaacagtttgattgaagagcttgagaaagaagagcgcaatttgattgtaacgaaaaatgatgtccaaaaatttgttgcacatgccaagaaacaaacgagaacgcctgctgaagttgttaaccagtggctgcaggatgctgagaatgacgtagacaatgtgaatcagttgctgaaagaggcaagaacaaaaaaaagttgttgttttgggcactctccgaattggatttggcgatactgtgtaggaaagaagttagcaaataaaactagggaccttgaaaagctcgttcaaaaaggtggaccatatattcaaattgaacgcactactacacttccttctagcacacttgatattctctcggaaaaatgtatgaattttgacagtagagaatctgcttacgagaaactaatggaagcactgaaagataatgaggttgtcatgattggattatatgggatggcgggttgtggtaaaaccacgttaggaatgaaagttgaaaagatagcaaaagcagagggtctttttgacaaagtgctttttgtgcctgtgtctagtacagtagaggttcgaaggatccaagcaaaaattgctagttcattggggtatgggtttccagaaaatgaaacgggagaaagggagagagcccaacgcttattcatgagattaaccgaagaaaataagcttctaatgattttggatgatgtgtgggagaagcttgattttggtgccatagggattcccttttttgaacaccataaaggtttgaaggttctcattaccactagatcagaagcagtttgtacttcaatggattgccaaagaaagattcacttgccaatcttaactagtgaagaagcgtgggctcttttccaggagaaagcacttataacagaaggcacccctgatactgtaaagcatttggcaagattaatttcaaatgaatgtaaagggctgcctgttgccattgcagctgttgctagcactttgaaaggcaaggctgaagtggaatggagggttgcattgggtagattaaaaagatctaagccgatgaatattgaaaaaggtttgcaagatccctacaaatgcttgcaattgagctacgataatttggatagtgaagaagccaaaacacttttcttgttgtgttctgtattccctgaagattatgaacttccaactgaaattttaacaagatgcgcaatagggttaggtgtagttggggaagttcgctcatatgaagaggcaaagagtgaagtgattgcagccacaattaagctcttgagttcttgtttattgttgcatgcatatcatggatgtgtcaaaatgcacgactttcatcgcgatgtagcccacttgatagcaaagaatgaggataagctcattaagtgcgaattggagaaggatgtaactttggagcaaaattcagtaagatatctatggtgtgtgaaatttccaaatgatttggactgttccaaccttgagtttctttgcatagaaacaaaattggaaatatcagatgaaattttcagaagaatggaaaatctcagagttatgtatcttgaaaatggaggggggcacaaactaccattgtcaacaatgacatttaaaacattgaaaaaacttcgttgtctaatccttagcaattgggaattaagtgacatctcatttataagtgatatgaagaaacttgagtgccttgcattgtctgattgttatttgccttcattccttgaattacaaaatgatggtgtagttgcacaactaaccaacttgaaatcgttaatgttatataaatgtgacatggagacgaataattttgatgtggtcagaagaatcccacggctagaagaattgagcatcattaatagacagcaagaatggaatgtttacaatgaaaacaccattaaattctttaacacctttagtgtcccccaagaactgcaatggtatacaataaaattaggaagccaatgccatgatgatgatgatgatgatgatgatgatgatgatgatgcaaattttatctcccctaaaagaactctaatgcttagctgttttcacatatcaaataaggcgattaacgatttggcaaaaacagcaaaggttatattcatagcaaatactcagggaggtgcaaaaaatataatccctggtatatttcaattggaaaaaggagatattcatgagttgaagaagctcgagatatgtaattctaaggagatagagtgtttggttgacactagcaatcatttgagtgaggtgggaattctcttctccaagttgcttaagctgaaaatatacaagatggatcaattaaaagttttatggcacggttgtatacctcctactggccctcttgagaaattagagaagctatatttaagtaattgtccacagttgacatctttcttcacgcatgctattgctcaaagtcatgttcaatccacaatcttccagaatcttcaggaagtgatagtaagtggatgtagagaattaaagtatgtcttctcagccaatactgttcgaggcctacctcaactgaaagtgttgaagataaaagattgcaatcaactagatcaactagttgaggatattgtcccatcaccacctgttacgaattatccaaattatccacttgcacaccaggatcaaaaacaagaattagataaaatcattcaatatgagcaacatcaacagtttttgaatcctcattttgaagctaatcaattggaaattttcccagaaagcacttcaattccactaggacctcttatgaaccatagctcaggtacacattccatgttgcatttcataagcatgttttcagttttaggcttttagcaaatatacatgtgttgtaatgggctgcatattcaacaaaaattgtggttagacaaaacaaagcattcaacatgaattcaattgtgacatcgtaaaaaaactcataacagtatgttgaactgttgatatgtgcatttctttttacatgaactgttgatatgatttattgcaatcattccaagttttttccttttaaatctcaatcattataagtgattattgatctaagcaatgattaaaggcagataatttttcttaaatattgccaataatcattataatttaattttatcaagtggggtttccgtaaaattttagcaaatgaataatagctctattcctcccttaagaactaaattgttgaacttaagtcaataagtgtgtttcttatattgcacttataattttatataattatttagttaaaatttataaggtatgtgtttgggtttgaagttattgacatgtacaattacaaatcacatttaaattgtgaatctattatcatatatgaaaattttaagcaatctaattgtcagaacattgcatacattatttatcaaatggtcaaagaagatttacattttcattttttaacattttagttccatataaaattattagaagataaggtcagtcataatatgaatcagcataagaatatttgtcctagaatgattttattcttcattattaacttaatttgatgcttgtgtttattgttttagtccaaaaaaaaaaaaaaaacgttttaaaaatcaaagtgtaacttgacgacataacatttatataattgattctaatatgcatggcaatgttttgcttatgagtaactgctttttcaggatcgtttactctatccagccttacaacccttgagctaatatcatgtccgaaattgggctcattgtttacggcatccacggctaaaaccttgacttcattggaagaattaattatagaagattgtgatggtttgaagcatatcctaactcgtgaaagaggtcataaaaatcaaaaggaaaacgtcgttgaggatgatcgtgaatttcagagtgatatttcaatgttcttaggtttgaaacggctatccatcgaagggtgtgatttacaacatatattatctgtctcttttgttggatgccaggcgaaattaaatagagactcataataattttgaacatcttcagcgaaaaaacattcagattggacaacaagtgcgattgaagttaaaaaagttggagttgtgcgacctacctcaaatgacatatatttgggtggcttccaagaattcacttttcctccaatatcttaaaacattagacatagaggaatgtgcaaaattggaagtaatctttccatcgtgtgttttaagatgcctaccaaaactgaagcatctagagataagagaatgcacagaattaaagcagatcatcgaagaggacgtgactgataaaaaattgtctgatcattctacacagccatgcttcccaaaactagtagatttggttgtcaaagaatgccacaagttgaaacgtttcttctctgcgtcttcatctagtgatcttctcaacctggaggttattatcatagatggagccactgaactagaggagattattggatttgaacaaggatattccaggaattcttttagcttccgaaatcttggaacattaaatataacgagatgtgcaagattggaagtaatatttcctctgtgtgttttaagatgcctatcagagttgaagcgtctagagataagacaatgcaaagaattaaagcagatcatcgaagaagataaaaaaatgttaaatcttgtttctctagaaccatgtttcccaaaactagaagtggtggttgttgaacaatgccacaagttgaaacatttattctctgcatctgcatctaatgaccttcccaacctagagcttctgatcatagatggagcgactgaactagaagaacttattggatttaaacgaggaaaaggtggtgagatagaaaaggccaaagttgagcttccaaaactgaaacttttaatatttatgcaactctcaacccttcaccaagggactgaattgctgactgtaaagcatcgcattgtccacaattgtccaaaactctctttgacttcaacgactactcttcgggagctctgtgcagatactccttattcaggtaaatgcattgcatcgctaaatgtgttcaaatacagttatttaatatgaactcttcgtctaatcatgttaatcgttgtcccttatcccattgtagtgcatatgctattgccatggtttgatgtgggcctttcctcaattggcatacaatttgcgtttcctcattccacctaaagaaaatatttatttcattcaaatttcgtgataaaaaagtgtttggtaagatttttgttttttttaaaagaaaaaatatacatttataaagcatgtaaacagacctaacacaagtagtgttaagatctgaaaatccaaaacagcacacagttaacccccaatacagtacctctaatccaaggcttatgtagaacccctacaacaacaaaaaaagatgtaaatgacattttaagcttccttacactccacccctggaaacaaccaaacacgtgtgataaaataccattatttgtttttggcgtgtttgagtaaacttttttagaaacatttttaaaagaagaaaaaaaaaagagataaatttttctataaataaatataaattcttcattaactaatttttaaaaattcactaatataatttttgtaaaaaatgagatgatatctacaaataagttaaaaaactcatttaagtttatggagaaattcattttatttttttaattttttattttaaaaatacttctagaaaaacttacatccaaacatatcatttttctcttgatttaatctctcttacattcgtcacccattacgtatcttctttctaagttctaaccacgtgcccacagcccaccatgtattctacgcaagtcccaaaaaacagcttgccacccaaacaaagtgaacaacggtttgcttcaataggatataatgtatttcttttatcataaatataagaaaaaatacatatttttcttggttttaaatataaaaaaatttaattaattttatttcatttaatgatattatttttaaaataccttttatttaattgaggttttagtttcaattaagaataagttaaaaatattaattaattaagattgatgtaattaaatataattaattaactttttttaaattagtgtgaataattttattttatttttatatttgagaccagaatagtatatgtgtgataatcatgagatgttcatatcgtgtatgtccattgcaaacatcctcgtacaatattggtgccttatgatctcatgcattgagctgcagcaaacattatacccacaccatttttggccttgtctgtcttaaacagtcacgcgtaccactttcattctaccctgcactgtatcacttcaatactaaaaaagttcgctatcttattcctgttaaccaccttgtatcaccttctccacataccttatttctaacttccaccactgttttctacctcctgaccctctctccagtagtcaattgtattgatccccgtctcaactaaaggacaccaaggcaagccttggaatttacaatccatctgaacaaagaatagttaaacactttcataaacctactccattcccaagaataatattttatgatttctaccttttcctccacctcttttgtgtcttctaggaatgtacaagaatttcggcccaaccaaattacccaaattagtgcaaaccacaccttactccacctccttaaagtactctctccatcatacagaagtcatctaaattggaaaaaaaatactcttcaccttattttgcatagtggaacattccttgactgatggatttgtttggtaagattagctcataagctatatatataagtttaataactaggcacaatcagtgaaaaaaattatgttatcaaccaataaaactcattactactatgacttttaaggtatatattattaaaaaaattaataaacttaattaacatacatgttgtttaactcaaatattctctttctctctcctgtatttaatacaaatttaagcaacttatgagtaatagttacttatataaacaacacaaaatcaaatatgtgacatatcaaaataatatttttttataagtaacctattaaacaactcccattgtggatgctcaaagtaagcttgcttaccactcaagcttgtcagaataacttataagttagtcagcgtagcttattagctgctagaatgccttacaaacacacttgtgacaatataatgatctaccatggaaagttgaagttgcatttcatttttgttactgtgtttcattgtcaaatgaagtcctttaatttataatgttttgttacagatttcaaaaacattgggctttcaccgttggactttgtccacttgttttgcaatatgattgaatcagatgaagtttctacaagtagcggcaccagtgagttgccttcatcacaggttagaaccagccaatctgtgcaagttaacctacctaaatacaatcacaatgataatggcatcaaatcggataactcatcaactacttcactaaactttgacagcaatataataatacatgtaattgcttcattacatcttgtctacatttgttatgacttaattaattggaaaaaaatcctcgttttttataatttcattatatttattaaaaaaaattacttgttgagttattctttttgtatattttgtcattgatcagattaatgaaaaatcagagaacgatttcattgggaacattcctggttcagaggtacaggctactgcaacttcaacaaattcagagctgaataaaaggccaaccccaagtcccttggatatttgtcaacgtgaaacacattcacaggtgagtataccataagctataataaatattggaagaagtgaatagcttaagactcaagcatttaattcatcacttcatgtaggagttggtggatgggcaatcaacgagtcgatcatattttacagaccaacaaaggccacttggaaaaactgaaagtaccattggaattcctcaggtaaataatgttataccaactaaataggcacattcttctgaatatttaagaaatggttaatatagactacagaaacccaatgaacaaattattcaaaaaggttatcaatcagagaaaattgtcattgattgtgtcctctaattcaaaaacaaggaccaatgcttgttccctttcaaatggcttgaggctgacatgcttattgtcatttcattttacaagaagaatgaaagtatgctacaaaattgcatatttcttgaatttctgcagaatattaagagaggtgtcaaagaaggaattgcattagaaaatgcaatgacattactaggtcaactcatttagaatcaattagctcgcagtcagggtcattagttacttctcagcataaatcatatgcacgtgcatttttttgtatggtatcaaccgttgaacatagtccaacttgtttctcatttattattttaagcatgagcagaatcccgtgccagaaaacacttctccatttcaaatgaacctagaagatccatcaacatccaaaagtaaaccacctactccacaagtcaatgataacaatcaatttgtacttggaagtatagctgaaacggtacgtgaacataagcaatttgaaagcagagcaactgtgttcgaaacaggcgagtgccctgaattagagagagaaaacaaaaggacatcaaacttacaaacactcgagcagaaattgtcacccatttcttctccaaacatgatagaggtatatgttttttctttaaatctttttaaaaactatatattagtaaactaaatatggagagaaaggaaggaattaaaatagcacaatgaaagttagcttactaatcaacatagcttttggcattgtaaagagtattgatgatatagagacaaccattattggaaaagttccaacatcagcgaaactagcaataccaacttctgttttagaggtgaaaagtccatctctgacttgtatgacaactcatcaacatataatacatttgcatgtaaatgtaataattaataggcttgaaaacatattttctaatataatagtaagactaattcttgtattgcttgttcaatatatcaaataaaagttcctggataaagaatcaaacaattaagtaggttttccagaccaacatgcactaggagaatcaatggtaaccactaaaatcgctcaaattattgtaatactagcacatgatgatgatgtacattataaaacacctgccttttcatagctataactttaaagccactcaaacgttttttttcatttgcatttgtaatgcccagaatattgaggaaataggaaaaaaaagcattcaagaggggcatccgttagagggagctacggtaaaaacgttggcaactggtgtaggaagcattagcttgggtagtggtgttgtaactctcacctactctagtagcagggacatacttgcagaagatttccaaatccaagaaataatgccatgtcaagaaatccaaatccaagaagggttgaacctgatggataaacaagagggaataggcattgtttctaataacagcattgaggtttctccaggttattgctttcttattgtctcttgtccatcctatatttatgtgtcacccactccttaaacttttagcaacttctgcagatatccgtacaagattgggagcatataagcactttgttgatctggatgatacacaagttgctctgctggaggaggcaataaaagcatatcctcatctttggaatacttgtgagatgtgtagtcagcgatttcaagctttgatgttaaaatctttggcagaaattttgttgttcctccggaatgaaactgccgttagtattactcctcagagaaaaaatgagttcgatagattatgcaatgtagctgttcaacttggatttgagaggtcatgggttgatgaaatgcgtcaacgtgttgtggcgagggatcctgagctggacaatgcacgagcaggaatccggaagcttcttaagagacgtaatcatttaactcaggaactacgcgacatacagaatgaacttaagattctcaatgactttgttgatgcccagacaaaatgtttcgactttttatgatttagaagctctagccctacgcgttggttgtgtcccacttgtggggattttctgtttcttcatacaaatacattttgcaattcttctaagaatgagactatcagtttctgagtctactgtgttctttgggacgtgtaatgctagcaatttaagtttattatgcagcattttattatgtggcaaatggatattattattgttttcgacttttgcaaacatggttatatatatatccctttatcttttaaacgtctgctagaaacagttcatatatatatatatatccctttatctttcaaacgtctgctagaaacagttcaattctttctttttcttcaagaaaccttaaaccggggtcagttcttgaattaacttgtgcaaaaaaaaaaaaaaaaacatatattttgttaaattaattctctttgaacccaatggtttttccaacttgtataattgaaactcgagaatcaaaattacacaactgcaatgtggcaagagtacatttaagccaaacctcttgcattccattcacaaaagtcaacttgtataattgatttcgacttatggaatggatttctttgatttggatgcttggagaagggaaaaatgcacggaagaatgtcattactggcagaatctggtaagacttcaattctatttattattttaccacaaacgttggagcaaaaattgtcacccatttcttccccaaacatgacagaggtatatgttttttgttttaatctttcggaaaactatatattagtaaactaaatatggagaagaaggaaggaattaaaatagccacaatgaaagttagcatgctgatcagcataactttgggcactgtaaagagtgttgatgaaatagagagaaccattattggaaatgtcccaacatctgtaaaactagcaataccaacttctattttagaggtgagaagctcatctctaacttatatgacaattctctacataatatacatttgcatacgagtttaataattaccaagcttgaaaatagatttcctaatagtaagactaattcctgccatgcttgttcagtattgcaaataaaagttggtggatgaagaatcaagcaatgaagcaggttttccagaccgacaggcacttggagaaacaatggtaaccactaaaattgcacaaattactgtcatgccagcacctgatgtaccttattaaacaactgccctttttaaagcggctcaaacatttttattcatttgtgatgcacaaaatattaaggaaataggaaaagaaagcattcagaaggggcctccatcagagggagcaacagcaaacactttgtcagctggtgtagaaagcattagcttgggcagtggtgtggcaactcacatctgagtctagcggcagcgacatactcgcacaagattttcaggttgttgaacgatgataagctgaatgaaggcaacacaggaataacactttgtaaaaacatccaaatccaagaagggtcaaacttattggataaaacaaagggaataggaattgtttctaataatagcattttattgctttgttatatgtcacctactccttaaacttttatcagcttctgcaaatactcgtacaagattgggagcacataaacactttgttgatctggatgatgcacaaattgctctgctggcggaggcaatagcagcatatcctcaacttggaatgcttgtgtgaagttcagtgagcattttcacgcatggatgttggaaactttggcagatatgttgttgttccttcgaaatgaaagtgccgttagtgttactcctcagagagaaaacgagttccataaactatgaaatgaagctgctcaacttggatttgagaggtcatgaagttgatgaaatgcgtcaacgtgttgtggcaaggaatcctggctggaccatgcacaagcacgaattggtgagcttcttaagaggcatgatcatttggctcaggaactacgcaacatacaaaatgaacttaaagagtcttgatgattttgttgatgcccaaacaaaaatgtttcgactttttgtgatttggaagttctagccctaccctttggttgagtggattttctgtttctccttagatatacattttggtgttatttgcaattcttctaagaacgagaccgtcagtttctgagtgtacaattctttttgggacgtgtaatgcgagcaatttatgtttgttatgtagcattttctgtggaaattattatcgtttttggacttgtgcaaatcatggttagataaatattttgtccctttatctttatacatttgctgaaaacagttcaattttcatttactttaagaaacattaaaccaggtcagttcttgaattacctttactttgatgtgccaataaacatatatattttgttgaattaattatctttgaacccaattgtttttccagctttaagataatattttaagccaaatgctatcttccagcgctcttaggaggccttcctcaatcaaaagagctgaagatagaaaattgccatcagctataagtctacaacacatcattggataaggaacgtcaaaacaagtccaaaattgagtttcctgtttaggaaaaagttgccaaatatgatcggcatttgctcagaaaattattttgcaacatgctcatccttacaactgcttgttataaacgatgctgggttgtctactctgtctatcaataatttaacggttgatttagaagctacccattcggatcattagttctaaaacgttatgactttatctgttttataagcatgacaataattctatttagtcacttctcttaaaatgtgaaatgtttaatatttgtataagatttcataattaatatgcttttacaggattcaatggcaacgattatgactattaagcaaaatttagtatctgttattattgagaacacctctaaaatcaaagaaattttctatcttgagggatttccaatcaatggccaacaagtgagtacgtggttagaacttagaagtcctcactactaaggttaatcaatttaccagagccttcatgttcaacatcttcataaactacacatatgcaattgtccaaaactaaaggctatctttctccgcatctctgtcttgagaatgctacctctgttaaaggtcctagtggtagaacattgagaggaactggagcaaatcattaaggacgataaagaaaatgaaaatatctcaaattctaaatcccaaacagtttaaattccatcttgtcacactctgcaacaacttggagtatctgttgtttatccccatttccccgtccttccagaattagagcatctgatcctaaatcaaaattctcgtccagtgcatgcaagtgtttgagggtgaagcaggtatgagtagaggttttgcttccaaaactgaaacatgtagtctcaacacaacagccaaacctcgttaatttctgtcaagggatagtttcagaacgtgattaattttcttgtgcacaattgtccaaagttatcactaacttcaacgactactatcgaggacatcggcaaacctctaattctggtaagcatgttatattgtatcatactatcgaggatgctaggaagtttattttttagttgatgatctatgaaacttgtaatttaaatccgtcgaaacatgcaccaagacacatacattaccactaaaaaaggatattcacccatccagaaacatgcaccaacccaaacaaactaatgctttaaaaagagaggagttacattgaattctagatcctttcataaactagctgacacctttcactttagaagtttaaccatcaaattgctagagatttatacatgaaaatagatatgacctccatgttttaaccgttaataaatatatttttattgggtattagttcttttatttttatgatgatttagccttcttaaaattcataactctggaaaaattcagaatcataaagttctactatcattcattccatcacagacagaaataacagtgaagaaaaaacaatggaaaataaaacccaatttttagattctctattaatgttaatagttctaaaatgaagttattactcttgacattgtacaaaacagcgcaacaaaatgatgagaaagtttcaagagggggttcttgggaggggtagccggcttggtaaaccaagtggtgtagagaaactgtttgtgtgcttcaacgtggttgcaaaaagctcctctacaatctaaacatgcaaaatttggtcaaaatcaagattgatcaaccttaccataatctacgataattttagaagctatccaaacacacattaataggtatgtgagttgtgagtgaagaacacagacagaaacaatggaaaataaggcaaaacatttagattctctctattgaataacggttctaagatgaaattattactcttgacaagacatggtacaaaacagcagcaaccaactgatgattaagtttcaactttcaagagggattcttgggaggggtaaccggcttggtaaaccaagtggtgtagagaaactgtttgtgtgctccaacgtggttgcaaacgagccgaaccttctgcctctctctcatccatttcagcactattttcatgtgattcttgcttgtcaaatctttcaatccaacttcctaaaacccgatcaagtttatatctattttcagcaccattgaagagaatgtgagagagaagctaagaaggtactagtacctggacacgttcccaggtgttagcaacagtgatgggaccatgctccttaattatatcgaagagggttcttgtgattgtctgcctctgctccggcggcgttttcaggatcacgggtcccatcttcggcttcggtttcttcgccaaacatcgaatcgccgtcccaaacattctactctgcaaaacacatttctatgaatcaatcaacacattttctaaggaacgaaacagaaatagcatggatttcgaaacgaggcaatgcctgcgaaaccgaatcgaatttcccccaacaaacaatgaagactgagagaagatgatagtggaagaaatttagggtgaactgaactgaaccaacatggtaggacttgagttcagacttcaatagtgggccggctcagctgggcttgggcctacgccactgttgaaacatcgccattttcttattgggcttgggtcatgatattagcagcttgattcctatgtgttttgtttttcaaatggagtgttactacactacaccataagtatgaatatatgttttttaaaaaaataactttcaaaaggatatattttaacaaatttatatttggtaaaattcgttgatatttgcttaacatgtccacgtgcgaacacaaaataaatatgaggcaaattttcatctaacaaaacagggaattaatacatgagtccacgttgtcgtatgtcatttttgggattatgtgtatatttatgcaattgtgtggcttccaatttaaaaccaggtcagagtatatgtagataagtaaattcccaaaattaacattgtgtttgatagaaaggtaagaaaataaatgaaagtgtaaaaataaaaaaataaaaaaataaaacttttaattaaaggcatataatcgatatctatttggcataatcgactgtatgtcaaatccaaaatcaatcactcgttggcccaccatatgagttctacgagggcccttgaaagggttatttgtcaaagtaaaataataataatgactttttagtgtgtttttcatctcattttgagatgcattttcttgtatgtggggctcatgagtctttttttttttttaaatatttactttcatctttaataaaacaaatatgtgatttgtcttttattatttttcacattcacaccttttactttcataggaaacaaacaaagtgttaagtgaccgaagaggatattggtaattagaaattgtcaaatcttctttctccacggtcatgattcccaaaactagcaccaacactaatcatataaccatgccacaatttgtaacctttgatctctcactctgcatataaaacttacgattattaatggagcctccaagttgaagaaattttttgaaaactaacaaggtgatgaaatagaaaaggaagttgagtttccaaaattgaaactcttatatttatacaactagcaagcctttccaagcgactcaatgacatgctataaaacatttcattgtccgcatttgtctcaaactatcattacttcaactgcaacaacctattatgagttccttcgaatcatttcctgattcctttggtggtaaatactatacacactttgctttataaggtacgatatatggaggttcaaccaatataaaattccgcggatgatatcgctaatggattctttttcttttttatttctcctcatttcaaatatattttggtttgttatttgcggtgcttctaaaaatattgattgtctcttgggctatttgcacaagtaaagctatttagttgttggccaagaagaaagctagccggtttaaattgatattttataggcttaaatatgttatcatacctgaaaaatagattgttttcaatttactatttaaaatttatttttgatcatctatgtatttaattttttttttatgtttcaatgtaatactagatgttagtctcattatgttaagtgatgatgtgacagataaaatgtcagtcatcaaacataatcactaacatattagtgtcatatcatttattattatttaaaaaattcaattatccttcttctccttcttccttcacctcccctcaccccaacttcggttgcatcatcgtctccctctctagcaaagtcgtcggcgagggctacctctatgcccagggcacagtcgtcgcagagatccagcccgtcaacattgtcgacgaactctgccgcagcgccactggtacctcaacatggagcccaacgattgccacgacaaccacaacgccatctctgctctactccaagttcttcttctgtttgtcaccaaacccacatgtgtgtgttacaattatgatgttgttgttgtttctcacgaatacaatgtttgttgttggggctttagtttgtgttttgtagttgataaatgatcctaccctttgtgaaaccaaactagggaggggtcaaaagggttgtgattggaatgaagcatcccttgcaacatcttcatggcaatgcagtggtggcgcgaggttggatggcacggggttgttttccgttggagaaggagaagtcccatttgttttaattgaatttttaaaataaattaaataataaataatgacatggtttcaatttggctatgtgttaagtgtaatatgtgttaagtgtaatagcttcatgaaatgacactttatctgttatgttatcatttaacaaaacgagattaaagacatatattccattgaaagataaaaaaattccaggtacatatatgaccaaaaatgaattttaggtagtaattaaaaaaaactattttcaggtataaaaaatatatttaagcctatttcatatatactgcttttcaatggcagttatagtgttggtttggattttcacttagaaactcatagtagatacatgtgatgtcttctatgtcttaatcaatttgtacaatgttaaaaaaacttttccacacacaacaacaattatccatacacttaagagatcttagataaacaagatggtaagatttttatttttaatatacaaagttaaataacaatataaaatttaaatattatcatcatcgtaatctttaaaaataagaaaattcttaaaataagttaaaacaaattaattaaatatttaaatctaaataaaattgcaaagattttaaacataatatttttttttttaaaaaaagatctccttgaattttggggcagcatgcaaaatcgattatatggacaatatctttggttagctaaacattcaccaaagaatcatcgacatttgatctttatctttttaattaagaaaggcatatgtgacatgtatttgttgtcattttctttatctttaattttgcacaaaaaacatttcttcatgcgtcgaaaccacattatgagactcatcaacaacacctcaattctcacagaaacactttcctgcttagcacttcgcaatgaaaattttcaatcttgataataatacaacccatgcacccaacccatgcacacggctatcgtcctcctgtaaagaaaatagttaagttagttaatttaattaataatgtcataaattttaatttcatttcacaaatactcatagaattaaatgatttaaatagtaattatatttaatgacattatatgtaatttaaaaataatttttaatcaaaaataattacataaaaagtccatacatgaatatctcattaatatattttgtaataagttaaagttacaaaaatatatcaagtcccttgttattataaagatttaagactagtttgtctctctatctcttcctcatattcacttccattttaataccctcctcttgtgaaatgatgaactttactatcttaaaatgcatatgatatatctttctatgttttaaaattttaatatcaattgaatagtttaacactttaaaactgagaaatcaatttcaaatatgtatattcagtgcccagaattcagaaatgctcctaaaaatgcatttatataccatcttatacttttgatattaattgaacggtttaatttaacttattatctcattcaatctatcatctttaatatttatagttctaacttgaatttaaatattttactaaaagaatttattaataattaaaataataatatacacagaaaaaattatttatcataaatttaaaataaaatttatatgttaaaaaattaatatattatatattttaattataataaatttatacgctaaaaaaatatttatttattataaattataaattttaattaatatgtaagctaaaatactactagtaattaattaattaacaatcaatacatttgaaaataaatctatatttcttataaccagaaaaaataatatatattgtttagaagtactagtattgtcttactgcatttgtttaatgacacttaactatgtctagagacttatttgcaaaatttatttaggtagttaaacatcaaagtcatgattcagccacaaaattacattattaatcaataatgttacacaaaatttagaggaaataatgtacttattatttattttcgagtagcaagtggcaaggctggcgcgtggcttgtgatgcaacggagtcgcgtggtgcgtggcagatgcgttaacacgaagcatgcaattctgagttgaaaaaaaagccttctccctctcttgtttcctgtcttaacatctcttctcacatcacttactttctctctcctctccatgtcttcttcttcacatcaaacgtagaatatctttttctttttccctttttttaatcttaacccaatttttactgtcgcaaagtggtaagcatatttagtttatactatttttttgatttgttatttctcctttaattcaataaatgagtccttgagatcttgtaattggggcttccattttagcgggttgtccaatcttctccttgtcagatcgaccctttatcgtttacttaactgggaaaagtttcttacggattttttcgagaaaaactgttttttttttggtgggggattttacttatttgtttggtctctgttcaggtgtatttgaggaagtttgatttgggaaatgaacaaaggacagtcaccggagcctcttgatttcttcatctggactgttgaggttaatcatttcattccctttgtcaattgatgtatttattttttaatttttatttacattttctcataataaaaaaccacgccttgtgagttgtgatccctttttacgtgatttgtacttttaacatgtaattaggttttttgcaacagttagtttaactaaatttgttgggtacataacttgaactttgtccacgatagtctgttttgtgatattcgtttgcttctctgataacacaagtaaagactgagattaaacctgttcttatatgttggaaagttgaacatagtattgtctaatcaagtgggaaatttggtggatgatgttgaagtccttctcaacttggaagtaattggctaatcaaacttgtgcgtgaattatttcatttaattgtgaatctcatctcctccctgttgttttcacaagttatctggtttttaaattaagtttccaattcttgccagataactttgttcaattcttcagtttgacactcacagtttctatgatcattttaaagtgagggcttttacattattctctcaaagaaaataatagattacactgaatgcttacttactcctttgtacagcacaaacataagtgtaaatcttcgtttgatgagtttccactgcaaagctatatgcatctttctgtgatcattggattttcaaacactgttgttgcaactatgttttggaaaaatagcatctgaaactagattgccaatatattatttgtcttgattatgcccttagtccctgttcctctgtcagtgatgtggcgagcttatgatttatccttgttgtcagttactctgttaagtaggttattaaggtcatgtatctgaagtgtaaactattacagataaagaggtatcatcttgttattctcctttgatgtgtgtgtcaaggtcacaagattgcggtatgattctactcatgtattgtgtatgtttctacttatgtattgagtgttcaataatgcttattcagcactgttatacaggtctagactctacagtataattgatgcactgttattaattactgatataacgtagtaagctctggaatgcttccacatattttcttttaattcatttatgctgctgtttctgtatgatgaattgtgcaaattacataagacctatgttgacaaggatctaagcttgttgtataaacccttttggatttgcttcttcttcttggtgtatataacatgtgagtgctgttacacagacatatcatatagtgcgtctccatctagggaagggttgtacacaatccagccagcttttggtagtttaattcatgccctactcatgtattaagctaccataggtctggtttctttatgcctggattgttttctacttccttcttgtaatgttttatcctttatatatatatatatatatacatatacatatttttgctgataaaaaaaaaaataaaaaaaatatagtgcatctccatggcagaatcaaaatgtaactgataatttaaactaacagttgcattcttgcttatcttgcgtgttttatcaggatgttggattgtggctggagactataaatcttggtagttacagccaaatttttaaagaaaatggtgttaatggagaatacctggaaggcatgtccatgtttacgactgaacagatcctacgttttataagacgttgccacatgaagtggggagacttcatcacattgtgcaaggaattaagacggattaaaggtctctctctctctctctatccttccccctttaaacagtaaacagaaaaacacttgtcaataaactcatttgaaattttcatctttacctatctgttttgtgctctttccatggttaggtaaggcatgatcattgatgttgtcacaatcagtttcgtactatttgaacaatctataaggaaacatgaatgtactagaagaaagattagagtagacgtttagtattactgtattagagtgagataacttgcctataagttgttggtactgctgtcatttcattacagacaaccattaaagggtctcatcatagcacatatttttctatattgtgcattatcaagacaatttgtgaattacattttctaaaaatcgcttccttatatatatgtttttagacactaaaaattttgtgattttccaatttgatttcccatttttttttcttttcaaattaatgttctcataagacatttttctttacctgatgaaaaaatatcactaggttgtgcagttttcctttcttatttgattcctggagatatcaggagtttctataaatgtaaagaattttctatttggtctctcatttagagggaccagatgaaaattttgtaatgtatttaagaaggttcaaatgggaaaaataaaaaagagttaaattaatatgcattgttaggataaattcatattgtatgcgtatgtaaaatcgttttacatggacaataaatatataaatcaaactcaacaaagaaatcatttggtaacaaacatgccctatggaggactcatttggaaaaataataaaaatgagaatcaaatgtgaaatttgtgaatttttaaaaggaccaaaaacttaatcaaaccctatattattatataggctggagtcatccagaacttgattgtcaagacgtccattcctaaacatgtgatatgtttatatataaggagacatcaaaatatgcatatgctgcttctgtttgttgtgttgtgacttttcttgcaagatgatatttcttgtgacaacaacataaaaaagaagggggggagggaggggggtgtttacccccggtaaagttgaaaaaaatggctttatctgttaatactcctaacttgtgaatgctatattgatgtctgtagtggcttgtctgaaaggggagcagaaggtgcggcggccatggtgggcaccggcttgcctatctacagtgttcttaaaggttgcaaaatccaacagacaatcaagagttgtttccttgaagctggaaccatgataatacaataagttaaacctctgcatgtgtaccagtgtacgtatagcaaatttctttttgcctagaaaacaaaagataggaaagaactttttctagcccccctttttttattttattttattttattttgcttttgattccaaaacctggttgtttcttctcctctggagaactgaactgttatgcagtagaaggtccttgtgcactaatttccggtgctgtgtaattatgtattctcttatatgtgaacgaaaatacgatatatgccgtttctcttcaagttccaatacccgttatctttattcttctaatcatttgttcataaatttgtcatcttgaaaatgaaattttgagctatgatatcaaatgacgagcttattatatgtactgcataaatacatttttttataatttagttttttttttttttttcattttttgtgtgcaatttttttcgtcctattttaaattattttaaataatattttttattgttcaaagaactattttttactgtttaaagttttagatattttaagggcaaaaaaaaaaaaaatacagaaaaactaaaacgtaaaaaaaaaaaaaaaaattcaagattatcaaagtatttacctttcattagtgagtagtgactggccactacggcaggcactgcctcatgctcatacgcttcattatcctcgcttatacatggctgcttgaaccgtaacccagcgtcagacgaaattggcttcctttatttatttcatcccttcgcgtttgttagttctttgggttacaacaaacggtttcgcattgaatgcagagacttttataaaaaacggtcatggctattcaaaaataaataaattacatataataattttttaatagtaattgcttttagggtaatgaataccacaatagcaaatacacaaaattaggacccctttcaacaattgtagttttttttttttttttttttaaaagtcgacaattgtagttctagtcatgacaaatgctaataagtaataatgcgcttctttaacactttttttattagttgaaatttgctataatttataaatttttgtagatttttttttttatttactaagtttcactcataattttataaataaactttaactaataatcaagagtttataagaataagtgagttagaaccgtcatttatattcatattttttatgagtgtaatttatattcatatatgcaatgcaacacccacagaaaatgtaagttttatgcatacaaattgacaagtaatttttgcttatatggttaaaattaagtcatatataaccttttaactagagaatatattttccgtatgaatgatatcaacactataatgtgtgcttatacttattttaaatatgaaactgataagataatcatatattttataaattatttttcatctaacctgtctttttattgtctttgaataattttattctaagagatattttagcatctttataatttcaaatttacatgaacacaagtgcctaaagagaaagaattcccccttaacaaaaaaatgaagacgttatgagtgaaaattttattacacaaaaagtaaaacccgatatttggttccttcattttcttcattttccctctcgtgattcaaatggcgaaaaccccataaaccctaaaatctgccggtactgagtgatcatcatcatcatgttttcttgcggaacgaagaagagcaatgttcgctctcgcagagagcaaggtcgcgattccacggtggtagattctccggtcactcctgctcgaacctctttccacgataacgccgttcccaatcgcccgaccaccggcactcccgctccctgggttcctcgcttatctgttcttgccaggtattcattcattcatttcactttttcaccaaaatctgcatcgattcgctttctgcttctaactgttatccgttttcattgcgtagggttcctcagatcaacagaagtggaaaaggcgacgatacagatcctaccaaacctgttttcgtcggcgagtttccgcaagtggttcgtgatgagcagaacattttgctacacaagcgaattcctggtgagaactgtttgatttgtctctcaattgtgttagttagcacgtgtgttaatcccttcacatttgaagtaaattaagcttgatgtgtttgagattatgatgtaacgcaatgcagctgaagatcacgcgtgtggcgggattgacaagagcacatcccttgcttggattatttgtgggaacagggtctacctgtggagttatttgtcccctgcttcctccatgaaatgtgttgtcctcgagattcctttgaatgatgctgatgttggcagaaatgatgctggtagttggttgcttcgtgttgttaattgtgacgccatgcctgtgggaacgaataaagttgctaaacagtgcaactctgctgctgtggttttgtgcaattgtcggactcaggctgttatgtactggccggacatctattctcagtcacacgctccagtcactagtcttgtgtcttccgatgagctggaggctgttatgactcctgatgggaaagcatccttcgacaggcagcggcgacaaagtaagctgggaagtagtttgagtggattgcacacatttaactctatgattgcttctgctgatcccagttgtaagtttgtatgtgttgcccttgtgtgtagctcgagtggtgaactttggcagtttcaatgcactcctactggcattcatagaaggaaagtatatcaaaatttccggctccaacagggtgaatcaggtcaaattgtgagcaatattgggtaccctaggtctctgacgtggtgttttccacatcattctattcaggaatcaaattcgcaattcttggtattgacagaccatgagatacagtgtttcagagtagagtttggttctgatatacctatttctaggctttggtctcaggcaattgttggaacagatgctgaggttggcattaagaaggatctagctggtcaaaagagaatctggcctcttgatatgcaagtagatgatcatggtaaagtcattaccattcttgttgcaaccttttgcaatgaccggattagcagttcaagctacatgcagtactctctcttgaccatgcaatataaatcagggttgggtttagagacaacaaatgacagggttttggagaaaaaagcccctattgaggtgataatgccaaaagctagagttgaagacgaagacttcttgttttccatgaggcttcggatagggggcaagccttcaggatctgcagtcataatatctggggatggaacagcaactgtctcccattattatagaaactctacacaactctatcagtttgatttaccttatgatgctgggaaagtgctagatgcttctatccttccttctgcagatgattatgaagaaggtgcatgggttgtattaacagagaaagcaggaatatgggcaataccagagaaagctgttatacttggaggagtggaaccacctgagagaagcttatctcgtaaaggcagttcaaatgaaagatctgcacaaaaagatataagaaatcttacatttgcaggtaattttgctcctagaagggctagctctgaagcatggagtgctggagacaaacagaggacggttttgagtgggattgcacgtcgaactgctctagatgaagaatcagaagctttattgaataatctattcaatgattttttatcatctggccaaattgataggtctcttgaaaagcttgaaacatctggttcatttgaaagggatggggaaaccaatgtttttgttcggatgagcaaatcaatcatagacaccttagctaaacattggacaacaaccagaggagcagagattttggccatggctgttgtttcaacccaactcttagaaaagcagcagaaacatcaaaagttccttcactttcttgccttatccaaatgccacgaggagctatgttctaagcagagtatgaaatttttagtctattcaccaaaagattatttgttttgatttgatcttcaaacaatttcttttacaatacttccatatgcaactcacttgtttgattatgtttaacttggtcattagtttttacattatttgggtatgtgatgtctgtataagcttaatttatctaccagcctgtttttataaaataaaatgaatcagatataatcatactttttaggatgatctcatacaaagtatatcacaagcaaaaatggagagtggtttttcactgatagcttattgacttttataaattgggtaaaatgaatatgaatataatctcaattatcatccatctgctcctttgcctcagcatgtatgaaaaaatcaaaggaaggaggtttattctgcgactaaatgaattgaggcttaattatcttatttcttccccatagcctcacatagagttttaaaaataatgtaagcttaattaggtaaggaaggagtgaatgaaatcctaaagcacatggattcttaattcttgatgtcatttgacttgttagggtgggattataagtgaaggcatgtttgatttatgattttgttaatggtcatgttttcccagccaatttttttaattgattaaatagattaaggttgtgaaataaataattatagtttcaggtaaaaatgcaagttaaaacaacacttagggaacagcaaatggacattccattactaaatgatgtttttttcaattcccaggacatgccttacaaattattttggagcatggtgaaaagttatctgcaatgattcagctgagggaactgcaaaatctgattagccaaaatcgatcaactaatgttgactcctcaaattctagtttgaatattcagatgtcaggtgccctttgggacattatacaattagttggtgagagagctcgtcggaatactgtccttttgatggatagagataatgctgaagtgttctacagtaaggtttcagatcttgaagatctcttttactgcttagatgcagagttagaatatgttataagaccagagcatccgttaggaatccagatccagagggcatgtgaactctctactgcatgtgttaccataattaggacatgcttcaactataagaatgagaaccgattatggtatccaccacctgaaggtttaacaccttggtattgtcaacctgttgtacggactggtatttggagtgttgcttctgtcctgcttcacttgttaaatgaaatatctggacttgataaaacagcaaaattagatctgtataatcatttagaagccctagctgaagttctacttgaggcatattctggtgctgttacagctaaaaatgagtgcggagaagaacacaaaggtctgttaaatgaatattgggagaggcgagatagccttcttgaatctctctaccaaaaagttaaagaatttgaagatactcacaaggttattattctatcttgcttaccgtatccttgcaatcctggtgtgggatagatatacattgttcaattggtcttttgtgcaggatttgattgaaggagctggagagcagaatgaagaggacataatgaaggttacttcacatctgttatcaattgctaaacgacatggatgctacaaagttatgtggacaatttgttgtgatgtgaatgactcggaattactgagaaatattatggtatgactatgattttattcttcattgtgcactgatgttgcttttattcccttttttctaggcatttgcaaattgcaatgatgattttcttagcttatcaacccaaatattctgttactgataaggctttaggattgagtagaagtctgctgagaaaaaataattgcactcctaaaacttaagtccataaggaagcaatagtagcagttacatccggacctagagctagagctaggacacaaaatgccccttaaatgaataaagatctattaattaagaaccaacaacaacctcacagtactaccaaatttgtagagctccacatattctttctttcaatttaagcctttatatattattggaaagagcttccaaagaaagattgtgcaaacaaatgttaaccaggtatacgaattttttttgaccatgttcttcaccatcgcacaagcacaatgcaacaccaattatttttatgaactttcagagcacaagacatacccataaaagtgtcttattttggacacggtacctgaaatgagttactagtaatagtctaaataagttatttacaattacatcgctgacacctcccaatgttgaataaaacctcggcctttcacacaaaattggttatcggaaaatgataatttatgatttctatttggtattatttaatcacaaggattctagatgtactatgtgttgccatttttttttttaaaatgtattcttgcttatgtctcaattgtttgtgtgcagcatgaaagcctgggacctaatgggggatttagttactatgtctttaagaaactccatgaaagaagacaattttctcaacttttaaggctaggggaagaatttccagaagagctatccattttcctaagggagcatcccgatcttctttggcttcatgatttgttccttcatcaattttcctctgcttcagaaacacttcatgcattggctctctcacaaaacatgcaatctacttcagttgctgaagaggaaggagaacaggagtatatgaaaatgaaactaaaattgactgacagaaaaaatcttttatttctctctaagattgctgcctttgcaggtatggcaccatgtgtttttccatgtgttatggagactacttcctttctcttcattctatttaatatttctttagatgtcttcctccttctaactagggagaatttgaactcaatggccgggactctactttaagttttctgctatctctgataatatgctggattcttggttatatgatatatcagttaccaactcaacctaatggctgcagctttttgtcgcctttttacttattgttgcgaattggtgaatatctagattcttagaaatctttaatctgtgttagaatatattaaaaatctctaataatatcttgaatatatctttgaatagtttggagtatcttaggattacttcccatttttcattattatctcatgttttatttccatatttacatgtgaccaagcattatatcttgtccacattcggttgtggtattcaagtcattggataaagattggtgtttatattctgatttctttctctctctctctctctctctctctctcttatctatatgtactgtttcaactggacacaggtttagttagttaaatatctaatttttctttgaatgaatagatacctaataaatttcatttgcaataaataaaaagtattacgtttttttgttcaacagctggtaaagatgctggtactcaagtcaaggtggaccgcattgaggctgatttgaagattctaaaattacaggtaaatttgagtttttatttttgaacaattgataatttgaagagggagttgatttattttctcaatcattcatcgtgagtattaggcatccgtgaaactctaggacatcagccagtgtttgaaagctaacttgatatgttaggagcaaacagatgctgttgttactaaaaatatttgaatttttatttggcttatatatgaacttagtccgttcgcatctttttaattttggtccatgtaattttttttttcatttttagtccctgtcaatttgcacttttccaattttagtccctttaagattctgtttttagtccttttaaatttgtgctctaagggaataaaattggaaagcacaaacttacaaagactaaaaatgaacaaaaaaacttacatgaaccaaaattgaaaagtgcaatcttaaggaactaaaaaggaaaaaaaaaaaacttacaaggacaaaattgaaaaagttcgaacttacagggactaaatttgtatataagcttttttaatttctagtcatataatgatataaatacaacaacgacaacaaattttatctcactaggtgaggtcaactatagatcacatctcacatgatgctattctgcttgattagaaaccaaattctctagggttctatttatgatgagatccttttttgtaatttcctccattgtccttcttgaatttcctctaagtgtttctagtgactttctttgaaagtgtccaaattactttaaccaattttctgtgttcttttccttgataggtatcacaccaatatcttttcatctacactcattccatatcctgtcctttcctgtatagtcactaatctatcttgaactcattttggttactcccacctttttctcttatgatcttaccccttttaagacccagtgttatcaatggtggcttctattgaccagctaaaaatctgccgaaaaaatatggttgatggtgttgtggcatatggctgaaccatggcggccaccatagcctgccacaaaaacccaccatgcctctgccatagaatggtggcctgtcagaaatctaacctgtaatctaccatggtgctgccatgaccgctttttaacaacgatgtaaagaccaacattataaagtataattaatagttaattatattgaagcaagataaaaacttctctttgaactgggtagattttgtgatcacaaataactttcaataacatgagacaaatataattgcatgataagtttatactttatataatattataactatgtttaaatttcctctttaaaataagttgttaaatacacgattgaggggtttgatgtgacagttgttgtaggaagttaaattattcatgaaattgaagaggaattataaaaagttttagttttggagggagggaaaataaggagcctgctgaaggatttggcatgctattaaattgtaaagaatacacgtttgacaatcaaattgactgacttgtggcattgagtgttatgtgactgtatgacaataaaattaatagtttaatatttgctttgtttcatgagaacttgtttaaccttgcgctggcaaataagctttgttgcacccttttaggagtcctctttaccctttcttatttagatgctttacctgcaggaggaattaatgaaacgtcatccttccattgaagatagacaacttgttgaagctcagctgcttcatccagaagacttgattaaattgtgcctggaaggtgaagatcgagaactctcattgtcggcctttgatgtgtttgcatggactagttcctcatttcggaagatccacagaaaacttttggaggattgttggaagaaagctgctagtcaggacgattggagtaaattccatgattcgtacagaactgaaggttggagtgaccaggaaatcctgcaaaacttgaaaaatactatacttttccaggctacaagtaggtgttatggacctcaaagcgaaacatttgaagaagggtttgaccaagttttgtccttgagacaagaaaacatggagacttctattttgggggatatgggtagttcagtcgaaacaatcttgatgcaacacaaggattttccagttgcaggcaaacttatgctaatggcaatcatgcttggtagcgagcattgtggtgacatcagacttgaagcagggccttccccaatggaataacttggccaaggatcattccttaaccgtaatccaagttggtgtaggtttagtacatgacatgtggaatatgcagttgtttttgttcgctcctctcttccatgcattgcattcacaatcacaacgtaatcctggatgatattggtaaatggtgttggatagaagatatgcagcaagtacaaatccgcaaatattaaaagagatgcttcctgtatacgattttagcacaccattccggaaaccctgtttggtaaaagaaaaaggttgtgattaatattttttatatatataaaaaatacaaaacaaaagcgtgtcagaatggcgcaattaaaatgccttgcaaataacattgttgatattgaaatcgcaattaattacaccatgtcagtataaataacatcaaatactaatcctgtaaacaaaaaacataaaaaaaaaactaatgtttagtctgcaaatagacgttgataaagttttgttaagagaatatgaaataggatggtgttttatcattacaatgaaaacatattaactgaaaatgaaaacgagtatttcaaaatgtgcaggtgtctatttcaaaattggaaataagtaataacttatcatctaaatgatggattacttataaatcttctattcttagacaacaatgaaatgacctagttttatttatttttttaattttaataaatgcacctcgttcgtgcataaacaatttgtacccctcttatagtaatttttatagaggaacagacgtatattatttcattcataatggagtttggtagaagacataagagctagcatacaaattagatgttcttgcaagacaatgagccacaaaattgttggcctctttacaaaactccctaatgagttgttaaagaaattaaaaagatccctacaattaatgatgaggacaattaagttcaaggaccaacagaaggactagaagaacgtatgatcagagccagaaaggcagaggagatcctacaacaagtggtaacaataatttttgaagttgtacatgggttgaagaacattgaatcaaaattatttcagtgcatgattattattaaagactcatgagatggagggtgttgttgactctttttttagaattaaataaagttatacttcttttatttttcgtttttttatttattttagtagttgatagccttgatgtcttttcatgtgcaccactagaaattaaagccttcataattgacgttaatggtgcgcatttagaataattaaaggttgattgcctatatgtacacaaaattgcaatagaatggacaaacttgaatttccagacaattaattatgtattatgagaatgttatttaggtttcatgctgaacccgtttagactcattaggggttgcccatcacccttgtggcatcttcctttggcttatcttccattgttggagtgacgccttccacctgtcatcaaacgatctgtaattagaactgtgtcacttactgagaattgaagctaaatatgataaacctttgttgttattgttgaaaccatcaaccacaagcctgttgcccaacacaaaaattattgttgttgttgctctcctttaaccattccctggcttggtatgagccgaatgcttcaactactattgggtctggaacaccttgaaaccatgttgtttttgcttgaataaattgcccattgtgatctctaaaacacattccattcccaaactgttgatcttgattgaaaattgttgcatcaatgttacacttcaagtatccaaaagatggtttcttccactcacattgattgtttaaaatctgcattacatgtgactgggattgctgctgtcttgcatgcttccattcttcaagttgttgaaatgcttgttgaatcgtgatctatgttggctggacctgattcctccaaattttatcatttcgttgcttccaaatacgccatagtgcagtagcaaattttttgcatgggtccttttcatgtagaaagttgatgatgtcaaaaatgagagggacaataccttctacagacaaaactttgctctgaataatgggccaaagttttgcttcttgccaagttgcaattgctgaatcacatccaaagaagatatgccgacttgactcaatgttgttttcacaaaattcacatgtgagtggacaaagaactcttttatctctcaatctactttgtgaagggaggcaattcctcagaattctccagattaaatgcttaaatttaggaggaactttcattctccaaagctccatatggcatggtgtatgcagtgcaaacaaaatattcttcatgtggcatgaatttccaaactcgcaggtcttcctctagcacgtgaagaagtggtatgcttctaatttcctacaagtcaacttcattgaagacttccaccatgaagtcttcttgccatgaacatctttgatgatctattagagaaccaacatgcatatcttctaatccttggggttgagccgtagaaacatatgggtagtcatttcttcgaagccatggtagtttccaaatagccatttagtttccatttccaattctccatttgataccctcttttatctcactctgtgaagcaaagatactacgccagacaaaactaggattatgctcaagtttggcatccagaaaaacaatcttgaaagtatttggctttgaaaacttttgtaacaataacatcttggaatgaaataaatttccaaacttgctttcttagcatagataaattgaaagcatggagacttctgaaacccattcccccattttcttttttaatcgttaatatgtcccaactcatccaattgatactcctctgcatattgtttttggtaacccaccaaaactagttcatcattttttgcaattcatcttctagtgaagagggaagaagaaatacactcatgcagtaagataaaattgcttgtgcacaagatttgattagaatttccttactcgtctttgacaatttcttgcttgtccagtgattgatccttttccacattttttcctttagaaaaccaaatacttctttcttcctccgtcccacaattgatggtagacccaggtatttttcagctcctaaactttgttgtacccaagtgattaagatttgttgcttgcatttatctaaggtgtttgagctaaagagaactcctgatttatggaaattgattaattgccctaagtcttctccataagtgtccaagatatgtttcaaagtattaatctcattttcttgagtcttgcaaaacagaaaacaatcataagcaaataaaaggtgtgaaaaggtaggagcaccttgcacaccttaacaccatcaatatctcctgttctctcatattttttaattagactagaaagactctcagtacaaagtatgaagagatagggcgatagagagtcacctgtcttagtcctctcccaatagttattggtccaataggattctcatttaccaagattgaatattgcacagttgtgagacaaagattcatccaaccaatccatttttcatgaaatcccattttgctaatgtcaattttcaaagctacgtccccacttttccttgagtcttacatttcatgtggtggataatttctaaggctagcaggacattgtcaattataaatttgttttatacaaaagcagcttgttcaagagagatgcattttggaaggattgggttcagtttattggctaagatttttgaaattattttgtaaaggacattgcaaagggtgattggtctagaatatttcatggtggtagggtttggacattttgggatgaaaagaatggttgtggagggaatgtaccttgttataaccaagaataggcaactttatgcactttaggtccaaggagatgccaaaatcttttgaagaatgttggcttaaggccatatgttcctggtgatttatcaatttgagcacgatattttaggcgcaattgcttccccctattattcgtatcttctatgcatgccttcaatttagtaagaaaatcattggacaaagagattgtccaactattttcaaccaaatattgaaaatttgggtccatcgaccattgattttcaaatctaaatcttctccaaaaatgttagaatttttgccatgaagcctcagtaggattggagagtgaccagactttgaggatattgtgttgagcagcctaaaattggggaaattatcaatccattgcccagttgcaagtgctatgtccaacttttcttcaatagtatcatgctttcctcttcttctagcccatgtataggtataaccttctatagaaaggtcatggagattgtaatcaatgataatctctttgaatcctctaaaaagtcaattttgatgattattgataccatatttttcatttgaaagtagatcattgaaatctccaaaaatgcaccaatcactcaagtatgtgcaatagcacatagaagattccatgagtcttatcttctatcacgttcatgataaccatagaattcagtcagttgccatttaggataaccaggaacttcacaaaattctattttatcatcaattcaatcaccattcacgttttttttttttatttttcttatcaagaaatagattgttttatttggatgacttagatgtctcatattttttagaaaaaaacgatttgattgatgagattttgtatgataatacttatgagattgatgtaatttaaacatttattcttaaaacgtacttatttgactccataagtgcaattatcatcccataacatgttgccaagaaaacaaaactcttatttcttcaagcaaaattccaagagaaatgaagttagatgagaattggagaatgcagcaatttaaaggatgtttcaaaagaaagcaatgccaaccacttcgatcatatagcaattatttattagagtgtgtaagctagaactgacacttaacttggattgagacgtaacggagaatagtccaaacgcgtataggctagcactattgcaagcttttgattatttttttagaagaatagcaagcttttgatgtccattccagatttgacttatttcatagatcattatctagaatattaaataaactaaaactaaattagtaaagataaggaagcaacaaacgtgttacttgataatctcatatatgtatataatctctacttctttttatccatctttattgttgttattagattaaattgtaatcttggttccactttaattattgatttacaattttggttcttttttttttttttgtttttctattttagaaaatatatgattttggttcaattcttaattttgcatgtgttatttcttttattttgatctatttgagtccaagatttaacatatttatttaagatatcataaaaaaaaatccaattaattaaagtgtaaaaaaatctatataaaattaagaagtgaacaaaattatggattttttaaaatagaaagaacaaaatcacaagaaaagaaataggaaaacacaaattaagtacatttgacataaatttaataataattaaatttataaaataaattttaattatctcatgaaattaaaatttaggggtggacctattcacaatgtcatggaaaagcttttttttttctttcattgcatctctaataaatacttttggagaagttaatgcaaacatgccctaattcataatgcataagaaacggctccctattcccaaaacaaaaatgattttttaacaaacaaaaatgtgaatagcacgaatctatttgacatttgaagacatttaatatatatatatatatatatatataattaataggagatatgataaaaagaaataaacaaaatataaatattaataaaatatttaaaataatataatgttggtatgtcattactgttccaaaaagcatacataataaaaaaagaaaagtaaagaactttcaatctaccttctcattcgggattgggagaaagattagcattgaaaatcataaaaatttgtaggtttccctttatattcaatgaatttcactattaattttgtaatttttaataaattttgtatttatcttagattgagagaaggctgagaaatgagatcgaatagtccaaaacgtatagaggccagcatgcttttttccattgcagatttgacttattacataaatcattatctagaatattaaattaactgaaaactaaagtactaaatataagaaaacaatctacgctcacatacgtgttagaatttaatagtgaaaatctttgttactacatgatgatgacctcatatattttatattataataaattttatgtctttttttttcttcccatattgttattgttgttattattattatatataattttttaaatgccgattggacaagtactacgttcataaaattttatcatttttttatatgtaaaatggtagaacgaggaggtattcttaataatacctgacatgatgctggcattaaaggtttagtcaagaagttatttacggatttaaatcacaaatgaaaatttagtaggttaaagaaaaaattttcaaatgatgtaaagcgatcaaatcaaatttaaatgagttgatattgatcgatttaaaaaaaaaattcaactcaaatcaatcaattaacatgtcaacgagtttaaatattaaaattcttgatccaatccaaaatttgattaatttgattttgagtctgatctaaatacaaaaattattcaacccaaattttttggattgatttgggtcaatttgaatttacgagtgaaccgcacttatttatacccctaataaatatgtaatgataaattagaaatggtgtattaaattttcaaaaaccaaaaccattattcattttccttttcatttacggttcaaaatatcaatttagtaaatcaaattcctagggctttttttttttttaatttaacagtttgtagtacggcgaaatgggttttggaatttattaacattctccaaaaagggtactgttaataatccttttcttaaagcatatttaataaaaaaattaattccatgacatgaagtcctatataatttaatatatccttaactttgaaattccacgcatgtttaatttccgacaaaataaaacctaaaataatttccttaaaagatttgttgtgtataaattttaacactatcaattaattataaatcatctttaatataattttaaaaataattatcataaaaattcaacaaatttattatatataatactactttgtggttttttttgtgaagataatattttgtgattaaataacaatctgaaaaaaatttacacaccattgatgtatatattatttattttactaacaatttattgatttgagtgaaattagatttcgttttttaaagtaaaattttattcttataaatgaaaaaaaacgtaatcagaaaaaaaaaattcacaacaccaacgtcataatgaaaaaagaaatattgtttattctattttgggcatgcaatgtatcgtgaaagaattctagaaaccatgcaaatgacgtgtgaagaagaaatttggtaatagtaaattgcgttataatttccaaatgggtgggggttgccggcatgtggccgataaaagattaaacataaaaatttgcgtataatgggcaagggcaagggcaaaccactttttctccaccctgctacgcgtttatgccttggaatcgtggcagattcccattgatccatgataaaaactcatttaatagcagcgatacccttgagttttattatatttgctacgtgatccaagttggacgctataaattgaccattctttgttggcttgaaatcatcaaaatctaatttgagcaatcactaacctttctctatagtgtctgtctttgacacttgttccgtgttgtaacataaccccatcatgtgtaacataatttcttgtttaaaccacgtgtgtgtttgtgtgtgtaattgcaagatgatatgagtgtctgaaaaccctctagttggatcttgagaacaagaaacgtaggctttgttccggttgaattacagtccaatcaaccattgtgtccaaataacgaattaagtgtcacctttctttttcttcctattctttttatcaataaaccaatcttatctcattaactgtgacatatttaagacatgtcccaagcaacctcgtcctcagctggtggtggtgatggtggtgccaacattgaacttggtgctaccttactcctcaccaccaccggcaacagcaagtacaccagaatatggcgtagaagtttatacataagattcctcatctcagtcaagaagtcaacaacttctaccgacaaccctgagtcgccacgatcactactttcttcagtaccgtacacttcagtacctcctgctagaacctcctcttccaaatcttcagttgcaattgatatagaagaagaagaagaaagagaagagcacattaggagtgatattgctcgaattgtaaaggagaaggacttgaaatccctcaatgagcttggtggcgttgactccgtttccgctgtccttggtcgtcaacatcaatactcaaaggtatatatcaaccttctcccctcctcatattcatgcccttttcttcaacaataaaaacaaagaaaaataatgaaacttgggttatcatgttataggtgtgattcaccaacttagctgatgattaatttctacaaaagaacctgactgatcacttttagtgagatatcttctctcaattatgttttttcatccacaaaactcgaattcgagatcttgtttaaggaatctgagctcagttctattcggaccaacaacttcttgctaaactcctatactacatggaaaaacattaaagagggagtgattcttttgttttttcatccacatggtggttatgatatttggaggatcccttctagtttaaaccatcaaatttctcggtttattgaagtgtgaagaaggatggatctactaactgttgtttgtggtgggttgagatagatgtgttttgttgatgggattttgtttttatgaacagggcaagaccactataccattaccagttcttggaacaaacttgtccaaattttttttcaacagctgcaagttctaccgctgcacaattttggtgctgttcgtctccgctgggttgtcattcgccataggattcaagcaggagggacctaaacatggttggcatgatggtgttgctatagtttttgctgctttactactggttgtagtaaattcagtagcaaacttttggcgtgagaggaaaatgttgaaattggcaaagacaaaggtcgagttgcaattcagggttaagagaggtgaagagatcgtaatggttcccatatctaatattgtggttggtgacagagtatgcctgtggccaggtgatgaggttccagcagacggtttgcttgtaagtgatggcatccttatgctggctgagcctgaggcaacaaaaagcaaacatgatcctaaggggaacccgtttcttatatctggttcaaaggtgattgggggccagggaaggatggtggtaacatcagtcggaaccaacaccaatttggctgaaaggaggggcttgtttgagcaactaatcgagaagccaatttcttacgttgacatagctgctctttttatctctctactggttttacttgtggtcttcgttcgcctaatttgtggaaaagatgggaacaatagtgggttgccagaaatgaaggggaaggtctcaattggcttgttgatgaaggcacttcagagagctttcttgagaccccaaggaacggtttccactttaacacgccttgtcactgttgcaatactatgcgtgcagcatggaatgccacttgtggttacaatttctctcaagtaccagatggataaggtagttccaaaccaagatgctgttctaaatgatttatcagctagtacgacaatggggttggtaactgtcatctgcattgatgtatcaggtgagctcatatctaaaccaatggaggttagcagagtatggatgggggagaaagatgtcagcatggttgagggatcggaaatagataaaactgcgcttgacatgcttaaacaaggagttggtttatcagtccttgcaccagagatttctctttcctctttgtctaattcacttgtttcttgggcaaaaacaacattggaagtgaacttgagatctttcacagaagagaaatttgacattcttaagcacagcaatttgaattctggcaaagaaggcagcggagttttggtaagaaaaattggggacaatgaacaagttctgtacatgcactggagtggagctgcatccacaatattggatatgtgttcactgtactatgatagtataggggaatgccatgccatggaaaaccagaagatcaaatttgggcaggtgatcgaagagatggaggatggtggccttgagccaattgcttttgcttatagacaaacagatggagaagaacttgagaaagaagaactgatcttgttaggactgataggtctcaaatgcactactagtctagaatccataaaatcagctttggaaaatctgaaaaaaaatgatgcaaatatacagatcaaactggtctcggaggatgccatcatggaagtgaaagacatagcttgtggactaggactagaacatgataatgtgcttgaaggaaaagagcttcgggatttgaatggggaagctagattagacaaagtggatcaagcccatgtaatgggaagcttccatcctaaagacaaacttctcatgatacagtgcttgcaagagaaaggtaaggtggttgcattcattggaacaaggttgatgactaatcatacttcatttctaaaggtagctgatgtggggatagtttttgatcctcatgagaacaatagtggatatagatagttgtgacataacaatcaaatttttcagtgtattggaaccaattgtgatggctggcagaagtcaataccacaatattcagaagttcattcaacttcagctgacatgtaccatatcagggtcagtcataaccttgattacaacatgtactggagattccccccttgcagcattccagttgatttgggtgaatgtcttgatgtgcattctgggtggcctaatgatggtattgaagctaaccggtgaggaacggattgctaaacaaccatctgattataggaaccaacatattataaccaaagaaatctggaaaaacattgttattcaggttttatatcagacttctgtgtcaatgatacttgagttcggtggacatgttactggcaaggataaaaaggttagggaaaccatgatcttcaacacattcctattttgccaactctgcaattttctcaacaaccaggttctgaagatggttgttcagagcttctatttcttggtggccttggttggttgttttcttatgcaagtgctggtgattgagtatgctaaaggcctagcagattgcatgcagctgaatgctacgagatggggcatctgcgtcttgattggtgttcttgcatgcgtatttgaatggaccttgaagaatattcttccagttgttctcaatcccagcaccaacattgcttcagaatcaattacttcaccttcattctatctttctccagtatttccaattctgatgttcattctgttccctgtaggactaatttttagtcaaataggcatgaacatgacaattcgttagtgcaggcagatcaacttgacacgcccaacgactttagtcagtgtataaataatgttcctgcatatgtataatgttaatgtatgtattcatttgtggcagttcctttctttgtagtcattgtagaataatcatttgcttgtactaccgaatgtagataagcttcattgattccccatcacttccctacagagaattaatgtgaacgttagcgtttctaatctattattgtatatattttcagtagaacttgtttctgtcaatgtctccataactcaattcccatcctttgcatcacttgtcaagtttgctttataaagtcttgtgataataataacgtagaaagtgaatcacaaattagcttagccgtatgaattttttagctcagttggacttatttttcttcttttatatactctctttaaaacttttttgcatgtctccgaagatggaaaaagtagaaactatatatgcatgtttaatataagtgaaaatttaaaaataaagaaaccaattaagcaaatttcatatgcatgttaaatatcagagaaaatttaaaaatatatatacccaacgagaatgaaatagataaaagcttactttagaaataacgaaaaaagataaaagtttagaacgaaaaaaaaagttattttttttttaaaggcaaaagattaaattaaatagcaaatgaagataaagaaaatgaaaagataaactaaattagtttagactttcttggctaaagtgaagccttagagtacaaattcaaataaacttacatcccccgaaagctttcaagtaagccgaagttacctattagcttcgtttttcatgattccatatatggtaaaaaaaaaagtaattgcagaactcctttcagtatatgagctcgaattgggtgccagatatgctaattaattacttttatatatgatgctggcaagtgtgttttcagatggtgttcgggatgatgttgatttttataagtatgaactgcactcctttagctttgaagtttgatcattagtggataaattatttatattttgagctttgaaaatgtttcaatgaaacttcattcacactttctgtgaaaaatatcatctattaaagaactgtgtttttatatatgaactcttgtcgtggtcaatgctatacatgacgacatattaactatttaaaagataacttaaaattataaatagttacatattataaaatgcgatagtggacatgttaccacatgtagaatttatataataaaattgaatctataacaacaagacactttatgtttatgaaattgtcatgtatgtgacaataaataagattaatgaaattattataaaatcgaggccttaatctaaaattcaatatctttctatttattaatttataatagtaatataattaagaaatattgtatataagtaatatatatatacatatatattttttttttaaaaaatgaataaaatattttatgatcaattttttctattaattatgtcagttgttcatttaaaccatatttatttttcttaattttttgtgattgaatatttaaatagaacattaacctcagttaagctgctttattttgttttctcttaattaccgtaattctcatttaaatacaacttttcttgcttatgatattgagggttaattaaaaaaccaataccgtcctgaattttaatctaaaacttctagtagtatgttcggtttcacattttagatgggttttttcacattttagatataatttttaaaagttaatagttctaaattttgtatttcaaatgtggtttttccattttcaacgactttttaaccatgtacagttattcattcgtgatttttcatactaattttttaaactgtttgcttgaagagaccgtttttgacaccaaattaaagaggtcattatctcttctaaaatcctaagatataatttccacatgaaaccaaatttgtaatgtagcgaagatgagctgccacattgtgttcttgaggtcgaggcactactagccctgtgtttctgtgtggttttactagcaacacaaattttttcattttttcaaaaataaaaaaagaaagaagaaaaaaaatgtaatgagtcactcacgggtttgcactgttactgtagcatcagcccaatccaaactatcttccataccaatttccaagttttaatttaaatttcttgactttgttggacctgaattctgtggcttacattgaccctctcgaaaacatctgaggaaggagatctttgcatccacgtggcagaagaagagccactatagcatgtcgaaatatcagcatgagaatccacatccaaatccacgaccaatgaggtgttgctgagttgtgcatatcctgatccacaatatcatacgatcttctataaacctttgtagtagccttcttcattctccacaacacacaacaaaaccaaagaaaaaaagccttagccaacacaaccatcatggccacctctgctattcagcaatcagcattcgctggtcaaactgctctcaagcaggtcaatgagttcgtccgcaagaccggtggcgccggcaaaggtcgcactaacatgcgccgcaccgtcaagagtgctcctcagagcatttggtaactcaacattacccttcccactccactagttcaacttagtattacatgttttaatataatactcgcttgacaacataaattaatactagtaattccgcaaaacttagatgcaataccttttgtttttggtattctgttctacttcttccgtcccattataattatagtgtacgagaaaaaaaattattctataataattgtcattttaatttttatctatttattattttatcctggtatatctaaaagaatctttagacgactattaatttgaaatggagggaattaaaactggagttttaactcactaattcatgtaacaaaagttcgcattatatgttaagattatcaatgaggtaaaactccaaaaaagcatctatagaactatatctatgttttgtacttaacaattctcagcaggatggggctaactagaaagccagtgattatgtaagcataacagattaataatagttattgtcttgtcttataaagataaaaaaaaaaaaaaaacaacatcagctaactaacacatatgaagctaggttttatcaatttgtctgagaatgtaactgactttggatgaggtgttgtgaaaaacaaaacaggtatggccctgaccgtcccaagtacttgggtccattctcagagcagattccatcatacctgacaggagaattccctggtgactacggatgggacactgctggattatcagctgacccggaaaccttcgccaggaaccgggagctggaggtgattcacagcagatgggcaatgcttggtgcccttggctgcaccttcccagagatccttgagaagaatggtgtcaaattcggcgaggccgtgtggttcaaggccggttcacagatcttctcagagggaggacttgactacttgggcaacccaaaccttatccatgctcagagcatccttgcaatctgggctgttcaggttgtgcttatggggtttgttgaaggttacagagttggtggaggaccacttggtgaaggactagaccctatctaccctggtggtgcatttgaccctcttggtctggctgatgaccctgatgcattcgctgagttgaaggtcaaggaactcaagaacggtcgcttggctatgttctccatgtttggtttctttgttcaggctattgtcactggcaagggccctattcagaacctttacgaccacgttgctgatcctgttgccaacaatgcttgggcttatgccactaactttgtccctggacaatgaggatgccaacattccatgcaatcttctgctcccttttgcagttcccttgtgtttaactccattttcactaatgtaactacacctgtgtagcagaagaatctgtatgagaaccattatatttttatatattagaaatttgggtccccagaaaatatcaactcttacgtttggaattcagaatattgattggtttgtgtttttacatattgttttctatcttcccataacaggaaccacctttccctatatgttaattagttcaaacattgaaaccatgttcaaggaatctatctattagtgatgtacgtgccttgtacaccatccaattcaaaaccatgattaaaaccataaacgaatgaatccatcttccattaccaacaacatccaaagcccagaacaagagaaagagcaggcgggcattcaatgtatccatctaaatgcgtcaataatgtagtcagtcatgagaaaattaaaaaacaaagaagtgatgaaggggaagggagtaatgcaaaagctatgatttgaaaacaagaaaacaacatactcttgcttaccactttctttttactcatttggaaagaatgcaaatagtatacgattttagatttttttaatctcccattttttgtgaaatcaaatcatgaattacttatttttttacaccaatttctttctcaatactaaccttctttttttaattttttttttatcggaaccaatgagaatgtaaagcaacaaattaaaagttctgggttgcagcgatatgttttggtgtacacaaaaataaagtttgaacctaaactgtcttgcaaactacttaaacttaatgaccctttcattataagttgaccctagtgaattatctattgtagtaatctaatttaaatacccttctgttatcatgctaaataaaaaagaaaaataatcagtaaggattatttattcaatgttgattgttttaattttacaaaaaaagaatgttaatttagtaataaattaaatttctgttaaatataaatataattaataattgaataaattaataagttacaatttgtgtgggatttagggattatactcgaggttcgggaagggtgactcaaattgaagtttaccgttttcacttttctgcgtggacgtgagagtgtgaacatagctaaacatctcattcctttgaaaattattatggcttctcttctggattctgcttcttgttcactgtaactgctcatcatcacaaatgtgcattctcttccggttattcttgtttgtgtgccaaagcttgaaatttttttgtccttcattttggatccagagtgcttgtttgcttgagcagagtcttaaaaggcttttttttttttttttgttcagtgttctgttgctggcatttagtgtaacaatctttgtttcgcagtgcaatcaggaatattgaacataactttcattggattttccatttgtcagttttatatgcgtaattgtatatttttgttgttgtgtgtctataatgatggcactgatattcaaacctatgatctcatgcacactattccaatcccttaccactaggccgaccctagtgggttctgcgtaattgtatgtggtaatattactttttgtaataaaaattagtgatgcattacttcccattctaatacatgcatttgagcttttttaattgtattttccaaatctattcttattctgtgttttttggccagtagtaagtaactagctttccagattgggcaagaagggagcgacaagaagaaacacgaaaatgtttttccacatagtgctggagcgaaagatgcagctgcatccacgctactttggttgtaaccttcgtgataatcttatttccaaactaatgaaagatgtggaaggcacttgcaggtgattccccttaagatcctttcaatatttttttttcccactagaaaatgagttgtgctaaaatgggaaagaagatgaaatatgcgagttaatcagttaaccatactatttctcttatacactccctgaacttaacttgagtcctttgacaatgataagcttttcaagatgcttgaagttgtgaaagttagcagacagttacccaatgaataagtgctaactttgtcttgggtttctctcttttgttaaacttaaagaaacaatgaagcatgaaataaaagtacacttgaaacttgaaaggccacctcaagatagaaacatctgcaattgcaataaagtaacaccaaaataatcacaataccccaacctcaagtaacaaggactcaattccctctgagttaagaacccttcatctcatccttgccctctggcatgagcctttgatttttacccactacccagtaatacatgttaataagagtaatttttcttgtgcatttgtttggaccgtacataatttagatcagagaaaagtatttatccttaagtgactgatttggaccttagatggatgtaacatttggattttcaattattatgcagtggtagacatggatttgtggtggcggttacagggatagaaaaaatagggaaaggcttaatttgtgatggaacagggtttgtgacatttccaattaagtaccaatgtgttgtcttcagaccatttccaggcttaattcgtgatagaaaacatagaagctgttgttaccatggtgaacaaggtttatacagttcctttctctttagagtaatcaatctgtgtaactctaacttctggagattttggtttatgactgttgagttctttttgtgtagatgggattttttgctgaagctggacctgtccaaatcattgtttcaaaccacgtaagtttttgtcttttgtaatatttgagaagtggtctctattatctccatgttatatatctaaaagattgttactattgttcttcattttgaatattaattttttttcctttattgttcctgtcattggaatgctaggcaagttttcaattttgaaagccaatattatgtttgttatttattattgttgctattggaatgcaatgcaagttttttactctgtcaaaatattataaatgaggttttgggttacatgattattttgggcttgggagcctccattcctccaaattatcacataggggcttgggagagtgggaatgacaggattttgggctaggataggatgaccacatgtagataaattcatttaaatatatatatttatttattattatgtattgttatatgggatgtatccttatcatatacctgtatttgtacccatacagcatgggttaaggttatgcctatctgatttcttttccaagataaatgacttttattagcgtgaagatcttgaccatgaaatgaattattcagctcgaaacttaattatgtaatggacttctgtaactatttaatgtaacagttttggggccagaataaagatgattgtgcaaatttgagattggccaaatagaaaaaggcggtgcatgattccagttttcataaacacaggaaaaattccttgtattgtttgttttttaaaagatgatcattgtcagccaattattccttgtattggtaatgtttagaattaccgaggattattttctgttccttttctttttaaattaatttaagatagaatatgccattactttgcaatggaaaattttcaacttgtagttgtacttttacctttatatatatttttgtttgttatgaccctttttgccccacttagttgattccgggtgatatggagttccagtctggagacatgccaaattacactacttcagatggatcagtatatctcaattataacttcctcaatggaaaagaagagagcaaattgtttttttttttgtcttgttttttttttattttatgataatttttactactaatcaattggtcttttgcaagttaagattcaaaaagatactgaagtgagactaaagataatcgggactccagtggatgctactgaaattgtacgtacttctatatatattatgtctcttcattttgttgaatgttgttaagctccattagcttaatttatgcttcttctatttttttatataggcaaatgttagttgttagttttgttagaatgttagtgggagggatttgaacccaccacctctcccttctcccttcacctacaagtcaaccttataactcctagctttatgctaaattctgctttgagaaatttgaatgaataggaaagcatttttagctcagtagcaaatatagcttttgtttctccacaaatttctttactattataaattcctcccagaagagccttttagtttttgctaattttaatatttagctcatgatcactggcttcgccctagtatttgtgcatatcatgaaatttgtggaggaatttataatagtaaagaaatttgaggaatgctagtttatgctccgttagctagtaatttactgtgttggtaactcttttatcactatttaaattttatccatttcaaaagttatccacatggaatattagggttactaccaagcaaagttatttgctaccctgagggagttataaatttaccgtgtgcttttgtggtatgcaagaatgattactattccatggtgcagctttacttcatttctaaaatcttgaacgttttgactcacaaaagttgtgagaaaattgtgatcacaaattctccagttactgcatgcaatgagaatgatattatgtttaccacattgttgatgttacatgtttgactgtattgttcctgccatgattattgttgtatgccatgtgtgaacatgtcttaaaagaacacttgtctatggccttgtagcctaatggaagttttagcgagcatatgatactagtttgtatgctaataaagtttaaatactcctgaacatgcttagcctatgttttccttccgtttggttgtattgactatagatatgaactgtgacactgtcatgtttttaaaatgacaaataaagagatacaaattactttttcctttggatattgaatatttatctgattttcagtttcaatgtttttagaactcatttaactgatataatgcataaccttttttttttttttttttgcagttctgcatgaaagatgatttcctgggtgtgatcaacgacccggcaacaatttaaaaacccgttactgtacctttttgttggaaataggagagcatttaatggttggtacttttctaccaacatgcctagttattgtgtttagctgagttcaatgtatctctggagtatctttgtaatcggtttttattataattatcttaaaatcgctttttttaaggtcaatgttagttattactcccttcgtagcctttaaaaaaatttcaaattaattgatgctttcatttttcaaggagatactcaaatatctattccaattttgtcttgtaataaataatactgttttgaaaaatttaataatacatttattgaaatttagagaaaaaacaatgatattttagtaaaattatctcatagtatatattaattttcttgaaatacttactttattgatatgtatgaaaatacttcaaatataagtctttttgagatgaagggagtaatttgttaatttttgttaatgaaagaattcaaatccacgatttttttcctctcctctttctttcttaattaccaaattaatcttataattacttatctgaaaatcacctttcaacaaacttatctaaacaaaaattgattatgattataattgattattgaaatgatttaatttgtgccgctatcccaaacacactcatatagatcattttgttgactgaaaaacttactcaagaaaatttaggtaaaatagtaaaatttgtttctcccttacatagtatattacatggtataaaagctctagatttttttctctaattttatttttattattttatattgtgtgactgagactcttatcttacatgatgctttgcacggatttagtgttctagtttaaagagtaaaaaagttactcctcatttttattatttattttcttacaatttaatgtttattcgaataactaaccgtaaccgttaatatttcactgaattgattaagcatataagcatatataagcatgtattcttaagatatgtgatgaaattttatatccaactttaccatccaactaaactagccatattcttactcattctttaattggtactcaattgtaagagaaacaatcattgcatggcttgtcttctaacacttaacctactcatttcttccaagtttacaagtcaaatcaaaacccatttaaaatcatttaacaaaacacaaatcaattcaaagaccacaacttggtgggcaaaagaacctaaataatacaaattaaataagaaattacgaatttggggcaactttgaaactatttacgaatctggggcaactggtcacgcccagaaccaggcgtgactggtcacgcccagaaccaggcgtgactaggggggtagtcacgcctggttctgggcgtgaccagtcacgcctggttctgggcgtgaccagtgtgtatatataccccccggattgcactgttcactcacttctagcttttggcttctctctaaaagcttctctctgccttctctctaaaaagttctctgacttctctctagaagtgctctaggttctctctaaaagtttggaggcatcagctttcttcggtttccagcaacgaagctctgtgacaagtaagttaattttttttttaattctgaatgatatttaatttattattttgttgatttaagttagttaaatttaatttattattttgttgatttaagttagttaatttatttattattagttatatttagcacatgatttattttatgttgtagcatactgttagatggtaggatatgatttgcactagtttagggttatgatttagtattaagttaagggttacattttatggttaagatattgatttagtgttaggtttagagttagattttaatcccttaaccctaaccctaaccctaaccctaagccctaaaatcataaacataaaccctaaccctaaatagtacctttatttgatcctgaagtagattgtcatcaaattttaataattttaggattagaagattatagaaaatcggtaaccctagggaatagtgtttagaatggtttagaaagcgacttcatttggtgtgcatatgaggaatctccgagtcttcagaattacaatgaaaatgacatgtgggtatgggataatcccaattttgatggtgaattagaaccctttggtcgctgctcgagagtctcagagttggtgggtaaggagtgtatacaacaacgatattactgttgtatacactccatacccaccaactctgagactctcaagcagcgaccaaagggttctaattcatcatcaaaattgggattatcccatacccacatgtcattttcattgcaattctgaagactcggagattcctgaaatgcacaccaaatgaagccgctttctaaaccattctaaacactattccctagggttaccgattttctataatcttctaatcctaaaattattaaaatttgatgacaatctacttcaggatcaaataaaggtactatttagggttagggtttatgtttatgattttagggcttagggttagggttagggtgaataatttaacaatcgtatctgctgattagaattaattgatttgttaactataaaatggtcggtcggtctcgtagatggctgattcatcatcttcggcatcttcgcggtctgcatcggatgacgagggtcagacattggatccgacgacccacgttgtgcctaccccatataaatggggggttttgcggaggcgtatccagagatgtcacgtttcacaagctgtgtggaacggtgacaaagatcgtgtgttgaagactcggcgcggcaagatatcagggggcccaaactgtgatgatattcctgcaatcgtttcagtcatgttaggccaggcaggattcttacatgtcgcacgcatgcgacatatccaggtataaattttgtaattggataagtgtttatgcaaattaattcctataaatgtatttttttttatatgttttgtaaactttatttcagattgatcctccacttatcagtgctttggttgagcggtggagacctgagacacatacctttcacacgccacagggcgagatgaccatcacgttggaagacgtggctggtatattaggattaggcagtgagggtcaggtcgtcaccggagctacgtctaacgactggcccagtatcatcgaggaggtatttggtcatcctcctctggagtctgaggttagaggaggattactgcggctgggctactttgataggatttacgcgcggtgggacgaggtgggaggggaattggtcgaagttatcaggttttcgaaggcgcacatcgcgcgcatcattggaggatggcttctatgcgacagatccggcggcagcaatgtcggttgtcgctatgtccctttgctagcaggggacatgactgatattggtaggtatagctggggatctgcggtcctcgcacatttgttcagacacatgtgcgagtgtacagatccagataggagtgacatcggtgggtgtcacgtgttactgcagatatgggcgtggctcagatttccaccaattgctccagctataccgcagcctactcatcaggagtggcatttcggccacaggtatgcattcttattttcttttattaatgacctttccacccatttcttttattaatgtgatttatttaaaatttaggtttaatactttagagaagtttgttccacacaaccttccatggtatcgggttacgttagattcccttgctcgggatgaggtacgttatgttatttgcttaagttttggataatttgcatattgttcttttgtaattgtgtgtttaactgttttgttcaggtcgtatggcagccgtatgcagggtatcatttccttggagctactgagcatgagcgactgttgtggatggcaactacgccagtgatatgcttccacacagtcgaatactctcatcctgaccgatgcatgcgacagtttggaagggatcagcccatccctggaagtccaaggaagttgacaggcgtgcatgacctatccctgcgagggaaacagatggataattggacccgcaagctccgaccctttattcgtcgttgggatcgtagggaccagcacatagagctgcccccccaactgactgggttcatgtcaccaaaccatgagtacatggcttggtacagggagaacgggaaacgatacatcacgaagatggctgcgaagatgggtcgtggtgtaagtgttttaaatataatttgtaaactaattttcattatgatgtcgttattgtatagactaatcaatttgttgggtaatttgtagcttgatggacttgagatgatgtattgtgccagtggcgggcaggagtggcctgggttcagcatggactacctgcacgtggagcttggtcgcattatgtcgatgtttcgacagagctgtaggttggaggagccaggcccagctgcacccccgtcacagcttccagctgaagatgacccttatgtggatgttcctcgtagccgtcgtgagggacacggactggagcgtcaccgaaaagtaaggcgacaagttcctgagatcatacccgctccgaggcctcgcgctgaaggtacctatagggctccagtgatagcacctacgtacgggagccagactttctattaccagtcttcgcagcaaccggatatgggctatcaggggttcagtacgcagagcgacgtgccaccaccgcaagagtacgggtctcagcatgtctattacgccccaactttggccacggctccgctggactgtgggactagttctggcgttcctgctcgagagtggactgatgaggacattgagaggatgatttattatagtccggatagtcatggagattggtcagcacatggggaatacgacaccccaatccctgaccatcctgacccagaatcacaggatccgatgactgcatgcccaccaatatatgcagcccatcctcagccacccccctccgatgcagggccttcgcagacagccccctccgatgcagggccttcgcagacagccccttctcagtcatcacatcatcagcctgtgcatcctcaggcaggatcttcgcggcgacgtgttagacgggtgaatcccgatcgtgtagcgcgtcatcatcagtggccacctgagtcatagggtttatatgtatttacatttgtgttaatttatttgttgtttcgtgtaatgtatatatttatttttaggtgttatgaactatatttatttttttgttatgcactttatgcaccaatttgttcttggttaacttcaaatgtagtataaggaccgtcattagagattgaacacgccaaacaaatggaggcgtcactgcacacgctcaaatagggcgtgaccggacacgcccaacagatggaggcgtcactgaagacgcccaacttaggcgtcacagaagagggggtcacgcctacacttaggcgtcagtgaaccttatataaggattaccatccaacacaaattttatcgactactccctcaatctaaatacttggctccgtaactgtaagattgttttgctatggcattcttagcagaaacaagcagccaaaccattgataactcaagattagccttcatttatgcaaatggatccatgaaacacaacgaaagcggtgtttcttttgaatgtccctctccaataccaatgcgggttcccgatcagtgttcttttgaaacactgaagcgtaggatgagcgacacccttatgatacgcgacgaccagtttgttgatgaaatctactacagacagccaaagctacatccaggtgaccaatttttttttcattcttttcaacttacaaatgataacgatgtatgcgtaatgttgatgtgcaatgaacaactgtcgagcattgggcctatagaaatattatgcaccataagaagaacgcctgagggtatactcaacctgcttcaatccaccatggtcccaacacacgatgcaatgctatattacaacggcaagtggaacataccacgacaaggcggttttgtgggctatgcattcacgggaacaaatccaatcagatttgacattccttcaggctgcaacattgaaacattgaagtatctaatcaagcaagttgcgcctattggacttccccctaatggaatccacatgtcacagctggtaacaaaaattttttttagacagccacaacatcacgcttattcagacaacacaatccagtatcacatcaaagagttgcactgcgatgaagacatcttgaaggtgttagctgaatccaactactggaaacgtttttgtccgatacaaatattagctatttttagcaaacccgtacccgaattagaataacgcatatgttacaccagacaagtgaaactatgaatttgtgttgttattttcttagttaatgttgttgttttattaattaatgttaaccgtgttttgtaaccactgtgttatgcgaattaatgaaaatgatgaaatggtaaacatagtctgaaacataatgtcatatcctaaaatacaaaacatttcaacccaggtaattttacaaactattttaaattaactactgaaatcatgaaacaccaggacgctgaggacaagctctccgattatgtccaacagccttgcaaattccgcatctgctgcgtctttgactagtttcgacttcatccatctcgttccgaattctggttgcctttggacgaccctttgcacgcaacttttccttgtcgggtatgataaccggaccgtcactcggtggaatagcaccttcattaccaattggttgccacggaaatgagtaggcctgcaccaaattacttatgaggaacacatcgtcaacatactgaaaaggattctgccgaacatgtaaagcagctgctgcggcgtgactgcatgggtatctgaaggccttaaacttgccacattgacaaaaccgctgcccaaggttgactgtatatgacctctcacagccttcctccacctcaaactgtgttcggtcaagattataagtgcgtacgtggtggcctgtagctacggtctggttatgcctcatagcatcaaccacatttctgcaatgtcgcgtcgaaccctcaacttgtgaaatagccgcctgacccctcgttacaaaatattcaaccaatctgctgtacgtgtgtttcaccaaagcagttataggcatgttcctagctcccttcaacacccgattgactgattcagacaagtttgtcgtcatatggccaaatctcctcccctctacatcatatgcacgtgtccactgttccttggggatgctatcaatccattctgcaacctgagggctgctatcacgaaatcgtgctaacgccgcctcaaaatcaaccataaagggattataacctgcaaaacaatcatccgattaacactaatctacttactatacgaaatattttaatatcgtgtcataattgttaaccatacctaaattcatcaggttcttcttcaagcgttgatctctgaacttttgattaaaattactggcaatatgacggaggcaaaacacgtgatgagcatgagggggttgccaaccagcatgattcgccacagcagatagtatgctgcggtgcctatctgaaatgagacaaatgttttgcctctgagtaacgtgaaaacgtatgttagccagaaagtatgaccaagcttccaaggtctccccctcgactatggcaaatgccagtggcaggcattcgttgttgccatcctgggttgtggcaatcaataatttccccgtatactttccatacaaatgagtgccatcaatctgaatgattggtttgcagaaattaaatgcctggcaacactgtccaaacgtccagaacatgcgatgaaacacacgctttccccgtaccagtcgatttgccacaaaataatcattcgtttgaatatcataaaaagcacctggtgaaaaacgaagcatatagccacaccacctgggcaaaaatgcatatgattcttcccaattcccataaaccattgccattgctttctgcttcgcgaaccaggccttacgatatgaaactctgaatccaaatgtatgggtgatcctttcccgaagcaatgaaatcggcacagacggttcctccttgatcattcctaacaattcaaaagtaacattcacattaaatttaaccattattcaacacatacagaggaaattttatacacacgtacctactaaaattgaggcaataacatcagcatcaagctgtctatgaccctgtgaaatatggtcgttaaggcagttgtgattgccgccccatctcgaaacaatccacttctcaccgaacgccggtttagttaccctaaccctccaggggcaaccctctttatgagcaatacacttcatgctaaacttattaggcttgctctcaaccacataagcctcttgatgctccttcatcaggttccgcttacatgccatctgtgcatcctttttggaggaaaattcctgtttcacaaacaacggatcccctaattgccatggaccctgcactgaaccggaaccggaaccgacaaaagattcttcttcacttggatgactccaatcaatgtatgtgtagtgaggaattccatcccaaaaaggagtcacctcagcaccttcaaataccaaatcaattgaataaacataacatgcacactaaaataatataacatacagatatataaatgattttagtcatgttacataccttcaacaggttcttctgattgtctacctcctacgtccggatggtgatggatttcagatgaccccgcagcagtgcctgcttggaattcagtcgcatccacaccggcatcgtcatcattatccgacgcactagcaccctcttcaagaagacgatcttccatgacaatgttctcatcatcgtcatcctcttcgtcatcatccataacccaagttgggtcatgtgaatcttcctcagacacatttatagatggagcagcacatgacgcagccacatttacaactggagcagcatatgacgatctacgcctactaggatttaaaggaactgacctaatgggtaaaacatcatctgccacagtatactccacgtacaactctaaaaaatctttcgttgccaacttaaaaaattccaccattagcaactttacgtcttcgtcgtccacaacttcaaaacccatgtacttttcacgttgccataatcttcccgtaatacgtgtgatacattggttgtcttgcagacgtaatttttgccgtatcttcacatgtacatcatccattgtcgagcttcgcttcaaaagtgtctgccttttttccccttcaaaaacaacaccttctctcccttcaaatatccttccattataatttaacacaacacggacaaattcctcatcacctgaactcatttgtttcactcaacaaaaacaaacactttttcccagagcttcgctgtacacataaatttcaaaacactgtgttagaatatcttcttaaaccctaaaccctaaaccctaaaccccaaaccctaaaccctagctctaaggcgtataaatcctaattcctaaaccctaaaccttaacccataaaccctacaccctaaacattaaaccctaaccactaaaccctaatctgttaaccctaatatgtgaaccctaatctgtcaacactaacccctacactccaaacactaaacagcatgaagatgacctaaacgtgtacactaaaccctaaccagtctaccctaacctaaactaagctatacaccataagaagcattttcgacaacactaaaccctaaacactgacaatttcataatacaatatattaattaatatacacaattaatcaaataacttacttgttcgcagagcttcgctgcaaaatcactaacactactcttctgcaactcgattcaacaatgcgcaacactgagcaaagaggggaaactgcatcgggggggtatatatacacactggtcacgcccagaaccaggcgtgactggtcacgcccagaaccaggcgtgactacccccctagtcacgcctggttctgggcgtgaccagtcacgcctgattctgggcgtgaccagttgccccagattcgtaaatagtttcaaagttgccccaaattcgtaatttcttatttaatttgtattatttaggttcttttgcccaacttggtgcatataaccaattgatactccacaagaccacaaccattaaaattgcaaaaaatatctcatctttaaagataatcccatcatggatatacattgttagctccactgaacccattcacaacccaatattcaaatttttcctttcctaaagactcaatgttaattagaagaatggtgaacaatccagcatttggtcaagaaacaatcaaattcgttccaaacacaaacttgtatgaaggctaccaagttacagttacaggttatagatgaaaaaaatgagacatgaatttagcaacttgccaggttaacatttcacaaaactaagctttatggctttgtatcaacccaaaatccacaaggaaaaatatggaaatttattacaactataactagaatttaaaagtagctagagtgtatcgttaaacaaaacatatgcttacaccgtagattgagttgtctgtctttccttcatggacactacattaggactaatttaatcattgatggcaagctccaaaaatattccttctctattccttttgtctcttgtgcacagcaccacactctccctccagctccaaaacaagaatagtgcattcaacagttaatgcttattaaaaaggaggggtattataccagcaagatcaaacaaagaagtaccatctcctcccagataagcattgcattacctaaccatttattctccacaatactcccttccaaatgctactcagcatcatcaatttggactctacctctcacccttttcctccttcaaaaagtccctttggccacacatccagcgaccctgctttcccctatactaacttttagcaattatctatttggcatgttctccaacagcagtcgattctaatctctgttgctatcatcaggaatcaataaggagccaaatgaataaaataaacgatgaacagctaaaaatgattatctcctatacatgcacttccaaaccactacatgccaaaccccaccaaaatataaagaagacacctgattgaaaattttactcactgccaaatgggtaggcaaggtaatgatcctagtcctaccactgtgaactcctccattgctcttcttcaagaaaggtttagacagttggagaaggtgaaagaaagaagagaggggaaacaacttcttaaactcttgtcctctgagaccacctcctcatcatcacaaaactctcaacaacaaccaaggttggtggctccacataggccaaccctccatgactctctttctcttggcctcaactccacaaacaaacaaggtggtcatcacaacaccatgaacacgaaaccacctccatcctccaatttatggccacagggagcatcaacatcaagaaattttgatacctcagacgttgatacttcccttcatctgtaaatatatgtactactgtttgtcttaatttgcttccccagcttgtaccttgtataatagatgcataataaccctctgttcgatctccatcattttgtatcaataatcaaggaggatttgtatcagtgatgcttttctttttcccccttgaaggtatgtgaatgacatatgacattagtaattgtatatgacctttcctaaacaaaaataactcggcatatttataggccagaatacagtactttgcagtggcttgatcgatgtcaagaaggcagtaatgaacgtaactcaattgtagctggactttatttcacagaatcgtgttctcttcaaatattaaattggtatttgatatcttggatgtttaatactactgtaatttaatttgtattctcttattttagagaagaaaagggtagtaccaaagttacataaactcgtatgtaagttattatcaagtgacaaattgatataaattaaaataatcttatcggcgtataatttaatttaatacttttattacaaaaaagtactacctaaagtaacatacacgcatatatgaactgtgatttagtgatatactgatataatttttcttttttgcataagattgaaaatttgatccattcacattaatccaatattattttgcatttcattgaaaacaaaaataaatatttttaagacagctaaaaggcattaaacatttttattgtatatttattaaagtttaaagcttttaaattgttttaaaaaatcagtaataaattatatgtatttagtttaacttattttaaagaaatagtatttattttcatcgagaaaactaaaataggtgcagtaattatttcctcaaaagtagtcatttccaaacttgcaattagttttttttacttataattgctatactgatcaaaatcattttttttaaataaattttgtagaaatatgaaattatcatgctctactccaatatcaaatcacctacttataattatgtctaaacacgtgcgttgagacatacaaacacgacaattatattgtgctctttatttatttggcagtatcccaaggtggctttagttggacttatatatttcttaatatattcttcagaaattaaaaaggtagaagctatatgacatgccatactgatgatatcttattatatttataattcttaaaaaatatttggcaatattttgaatttaaaaataacaactaaattctgatatttattcataagtatttaaacatttttcaaaatttaagatacatcactaacagtaattttttttcattaagtacaatcaattacaagaattgagtaaatatctacaaataaatcattaattaatccttttatgtgcaccaaagatatttctctaaaactattgaaaactttgcttagtggacaactcttaagaaaattcttagacgttgaggatctagttgaataattacgattgaataaaattgtatgtgatttaaggttgtgcagtaattctctaattctcttaatagatctatgttaacaattcaatatatcattggcgtgtttttctgttatactaaatgtatgtaaaaaaacaatctcaatacatttggattattttacattcttaagtatgataggaagcaagccttttacactaaaatagtttatataagattcgcaattccaattttggttcaactctatgcattatacatttatacatatacaatatttgagtttcactcttttgattttttactgtacactaagtattgttggtgcctcttttttctaattttattatttcttcgaacttttattgaaaaacttatgcctccaattcaataatcatagactccatccaccacccaaccaagttttgtctgcttgacatataaccgacaggacaacgggcctggctgaatgctaacgggcctggactcctgggccattgcgaaagcctcctttctcccaccatggtcatttatcaatgagatgttcttttccaatctttgttttatttattttgaaagaaaattggtctcaactctcaagagacaagaatatgatcgcaatcaaagttttgattaaaaatgtaatttataaatattattattattatgctaaaatatatttttggtattcattgaatatgaaaaatatttaaaatttatttttgtaaaatttataatacgtttttcattttcataaaattaaaatgtattattttttatataatatagattcaaataaattcaaacttaggatgataaatttttacatatatataattaatataacaatttaatatcttttatgttgattatatatataattgatataaaatataatattttttataagtttaaatttatctaaacttacttgagttaaaaaatatattttaattttatgaaaatgaaaaatatattgaattacaataaagaattccgaacacttatatacttagaaggaggataaacaaattataatagtcgtacaaatctatatactataataaaagaataccaagctaagcaaacgtggccttttatttcgttgacacctcatcaaaatcttacgtgtcactctcttaaaaaatagaggctttttgcatttttttttcctcagctaattatttactcttccttcacaaaacagcacgtccaccgccatcagtgaaaagctggtcatttttaaaatttgaattgaaaagctgcagcttcagcctacacaaaaatttcaaatttgaaattcgaattcaaactcagcctctctcaaatctcctcttctacattccttctctgtctctctctcaaaaattttcttccttttctttctttcttcctctccgtccattccagtccatcattgcgccgccatctccgaccgccgtcgcgttgcctttgttttttcttctcttctcttctctattttcttcttctctgtcttatacctcttatatttacaaagtttgcgttttttttcacgtttgggtatgttttctttgcattttttaatttgggtattttgcaaaatgtgttttgcttatgaagtgtttgacaaaatgtctcactcaaatttctattgttttgtttataagctttattgtatattgcaataggtattttaatgttcttcaattggctatgatggttcgattttagtttcggtttctggatctattttaatgttcttttattttgttcgcacgtggataatatttcagtccattactgaggctctggaaacgcaagcactccatcaagtaacttaactaattaacacaatttattttgttaaattatattctaatatcttgagttattatgttaggtatgggcaacataagtctgtgagcaaaagcaaagaacttgcaacattcaggtttttctctcatttatatggatgcccaagcttctatttctgtagcatatcagtttgaattctgaataaataatggctagaatgagtgtggaccctaattttggaattggattttgatcttctttatcaaattgctaagttaacttcaagttaggaattgtttgataatgtactgctgattctttgcgggtttatattgtaacacttgccgtaaagatatgaaacactatagaaactgcagtgcacattatagaaactaccacaatatttttgggaggggtagaaaaatttaatggttgtgtgattattatttggaattgaatctttaattatttccattatttcagatgaaacaaatttaagtggttggctttaaaacaacatgactacattgtattagctgttacctctcaattgccaaaggatccatttaagtatcttgatgttgcttccgtaattaactatgaacctgctcataactccacatgctcatgctatagtggcttagataggatcagttgcatgctttagagtcttagactaacaggatggaattttgtaatctgggtatgattgattttagtgctttttatttgattgagaactttactgtgtaattatgtggattgcagaatctcttcacttaagtttttcatatgtttttcataatggtaataagagaaaaatgatttggtttcacggaattctgttctctcttatattagttattttatttcatctttctctatgatcttccagtattaacaatttaatataataacagtgaatttctactataatggctggtggtaagtcttacatactaaataaataatggctgcttgtgatgtaacacaaaatccataaagaagacaagaagattgtgacagaggactcatgttctgtaacacgcatttgaaagaatctagcaaggaggaagtcaatgaagatagagaaagccgagagcacaaggtgtctctttctattttttttcttcaatatttattttttattttattttgctgttagaatttaaaatcaagacattagagcttatatatgcatgtgaattgtttgtgatattgtgttttttaaaatgatattgttggtgatattgtgttttttaatatcaagctttgcttttatttcatttctgaatgatattgtgtttttaaagtttgattggtctcatttgtagtatgcaagtgatgtgtttgatcaaatgcatgaatgaactttatatttctttataacaagcttcattttattttttaattttgtggtttggtatttgacaaatatgaacatatggacaatccttgctctgtgaatcattattttttaattttgtggtttggtatttccgatttatattcaacaagcttcattttttttgtttatatcacaccttggcagtagataccgtatcacgctcatcagttgcaagccatgttacataagagcttttacattagagcttttagattaagagaaaatacttatatttagttttgaagggctgcttgtgcttttagtgctgagtgttatgccattatctgaagatgcactgttgctgcagtgcttttatctaacgttgtggtgttttgtgataggattatatggttgatgggtgcgagagtatttcagagatttactctatcatctgacattgttaaggtatgtatgagtgaattgtgagttttcatggcttgaatttgaatgaaatgcgtttgtttaatttaacccgcttttgtatctcctttgatttttttgcttcctatatgagatgatagctgtgaaaattcatcaaagtaaacctttttcagctatttttctactacaggttggttgtgtcactacgactgcaagttgcttcttttctttcaatcacaaactgaatcattgatatatctacttttatcatgacaattacagtataatcaaagagattaactatatacaccctgccacattttcattatggttctagagtgaatgttttttattctggctcatgttgatatagctttttaataattatgtgctttgtttagaatatagctatgtgtccctgcagatcattccaggcttacacttgtgcttatgctttctttattccacctcaaaacaggggctggtgttatattgtgcattgaaaaggcattagctcagtctggagtatcaaaagaggatgtgaattacataaatgcattgttttggtcaaaaacccatggtgaatttccttttacatgacattattgctattgttctattactagccaattaaaatttgaaaggtaattataaatatgcaatttcctgattaaaattcctgattaattttggaaccatgacaataaaatatgcaaattcctatttgtttcatcacacgattcactaatgaaaaatatcttatggtttcattttcaggccttcttctctgctaatgctgcagctcaggcttcgaggaagtcctctccaagagtgaccaacgaggctgttcagaaggctgtgggtgcttatttcaacttccctttttgttaacttcgatatgttgtaaaatttattatgctgttactcatggcttctattctttcctcttaggctgctgcattgaagagtcatggctagcatttgctgcccaaaaaattattgaagttaacgcattggctaaggcattgtctggcaacaaggatgaggtaatataatttgattatatctattatctatcaatatacttataataaaagaaggttccttacctgtttctccttgcttctccttgcttcgcaggttcggattctcttctcccagcttcgggctcacttcctccagcttcggtaacctcagacttctatgtgataaatgctttctgcttgtaagatatgtgatttttttttcaaaatagttaatttttcaaattaattatcaatttttttaaaaaaatatatcagtgtaataaagaaaattagtggtgcatactgcagagagtggagctcacattttttaaatgaagtttatctgtgatatcaaccaagaaatgagtggtgcatactgcagagcagcatctctgttttgttaatgctgcttccagttattttttcatggttgtgactgcgaacgcggaacaactcatgttgtggaaaatcatacaatgaattatgaggtgaagaggaatagatatttatcaaggtttgaaatttgttttgctgaatataggcaaaaatgggaatgatagaagaatttgaagcttccttgcaagtgctccgaggctttgagactgatatttctgttgaagttaatgaaattaaggtaataagaatcatcagttttgttccaatgcatgacccacatatttcctatatttttattaccattaaatgtatcctaaacttgactttttacgtgggagtcattctattcagagggttgttgcttcaacaaacataagaactatacttcgatttgcagacctcaaacaaagatgatattggcttcccttaatggtatttcttatctattatctagaatcattagattcaaaaatccatctgccttatggagttggattgcataataatgactattttctaagtacaatcttttttatatagaatcctgtagattggaattggactgcttattttgcaacagctttctggaattaatgatgttcttttttattccaatggtatgctgtgctgatttctttaaatattctaaagtaataatggagcaatattaaggaaccatgaaacaatttgaatagagttacaatctcatgtttgtgtgactttcaataaactctgttcttacaatctcatggtttatgtgcaaacactaaattcttcgtagctgtattcctacatgaaaaatactatagttggttaggcatgtatcacgataatatattaagagaatttttttaaagtgattaaaaatgtgagcttaagaaatataagttcttagttgttccactttttggactttcattcttgtccatataagatatatgataaacaagtgttgtcaacttgacttgctaggtaaataatatatgttttaaagcgtaaattacttttaactttattgaaaggattaagatacaatatctggtgaatgaacttcataatgaacagagggttcatgaagctgctatggccaggaccaatcacaacaagagcagttaaaaaggttaggcatcatctaatatctagctgcaaatttatttaaacacagaaataagaatttgaaccttattaaatattcactcaatgatagattaaaacagacagacacaaataaaggtgtggaatggatggatgtttatataggcaaagaaagggtgtggaattctctcacaaataattgaatttcacacacacacacacacacacacacatattggtagaaaaatgttggggtctatcaatttccaacaacagtagtgtgtggtggatactcacaccactggcatctctcaatgactacagcttgtatccaaacccaatacgtgaccatgtcttttctagatatgaccagaatttaattttctccaagcatgattctgtctttaaactaaacataggaatgattttgaaggaaattgtaatctgttcatctgaaggaatcttatatatttattgctttctttgaccttctcaatctgaacatgattccttttgagtttgtgttcatatatttatctttatttattgctttctttgaccttctcaatctgactatgcataatacactattacacacatgatttatttgtgacagcactcgggttgccttggtagcaaaagagtcattatgaagaaagaagtcaaattacatcctgtgagtttctataaatctcttcttttttttttatcttctatattagtagctatcatattttgatgtagtcggctgttttgatcttttctgttttgatgaggtaaaagatcctatgtgaatgatatagttaatttttttttgttgggttggtctcatttgtagtttgcaagtgatgtgtttgaccaaatgtcttaatgaatttggacaacaaatgatacggaatttgcaggtatggatataaaaaaattgttttatattgtgatttttagattccaattgattcatttcagattacccttaccattggaaatgtcttatctctaaagtggaatttataattgttgtacctttgtttttgttcattatagttatactatgtgcccataagggtatttttactgaattttgttttcctattaattttggagtttcgtttcttctagaaggaaatcttattattgctctttgtaacatcaaatttatttcttatccagcaatcactgctgcaccgatttgagtggccacataaatgatatagtagttacatgggaaaagcttatttcatttttgaataataatgtcgcttattatgaagtcataaaagttgcaaagcaatacaagttacatcaggttatttttttaagcttcattaattaagttattccaaatttagtgttcatatctctggatttgatttaagcccagtggtggagttaccattaagcagtaagcatttcattggtagaaagtatcaacaggtaatgtattatcccttttatatgctgttatttaattttgaaacattttgttggtagagaactgctcatgtgtattcaaaagccaagagggtacaagctttcaaggatgttgtacctcaactctaatgtgagtcttttggatttatcttatgtagctacgcatctgtgctgttttttttcaatgtaattctcatttacatttttcatattgcttaaaagttaggagttcatagcttctagaagtaaatcttttgtaagtgatctaaaggtttcttttatattcattgttcaattattttcaaggacgaggacatgctaaagaatctcgacgaccttatgaatgagagtcatcatagctgcagcattttgtatgaatgcaggtattgactttcagtactcataaaatgtatgcattgtcaaatatttggttttgtctagaaggattattttataaggcatgatttgtcatgtgagcattactgttataacttgaaatatttgtgtgtatgccaaaaatgacgggctatgttctgttgaatttatgttggaattactgcttgctttgtttttattttggtcgcacgtggataatattttcgtccatgattgagactgagcaaggtctccataaaggtaaggatgaaatggtttaattttcttatttcaaagatgaatgagtatgatctcgaatgaaaattttcaatcagaccaacataaatgaacattgaactgtctatgatctcaaacatgctagcaatgaaaagtgaaaaaattcttgaaacttcctaccatacatagattataataatatattatcgatactttttttgcagattgggttccctttgtgacatgggtttgactttcttatgttagcagcagagccatcaaaaaatctccttcagcattggaaggtcaagaccttttcatatattttcagcatgtaagtggtaaaatgtttaacatatttgttgtcagtcttttaatttaatttttgttatttctatggatgacatgaacctcattgcatcttgacttttgaatttgaggagaaaaagcaccagcaaagccaccttatttctatgattttcttactaaaggaaaaatcattattcttagtagtcataaattgagatgttcatgtttatgttacaggctgtgattaaaaagaagtatagacatgatactactaatgttggtaaagaaggtggctttgctcctaatatccaggtccttaactgtcagaagcgccatctgtctgagaattgtgggtgagtcatcaattatgaatgcattgagcaatatgctaattgcaacttttatattgttggaattaacattgtcaaatttgaattccatctcccatggtttggtgatttataatttttttattctattggcttttgggattgtgaatgttcaaacaaatggtatcaaagtgtaacagttgatacttgaatccaataatgctactttggaattcgcattcttttagaagggtgatggattaggttgttagttgaacttgggattatgagagatgcatacaaatatcatgggtacggatggggtgaagaaatgcacattgttgttactgttaacttatttattgcattgacatgtcaatttgacagagtcaaaagtcaggagcaaaggctgtacccattgtttccagataagaaaaagtttgttcgatagaggtgcattatggttcataggtatcattattataagagtaagggtgtggctgtaaacatcatgtctaaaagcaaataaaagcaagtcatattttcaatcattccatgatggatgttgtttagccatattagaattagttaaagtactatggccataatgaactcataaattgtataatatatggaagacctttgtgaatggcatgtgtcatggtattgctgcaggaatattttgcccagtgtggatagatttaatgaagacagtaagcatgaagtatcaagcgtggaaaggacaagcacaacaccattgcttgaagagaacactgttgaataaagttttattacaagtgacaaatactccttatttagtatttatagattatttagggaggatattttcagtgacaaatgaactcactcttgctattcaatgtaacatgattcatatataattatgtgtctttaagtattttagtaatgatttgattaataaatgtgtatatataaaaaaatatgaactctatgccaattagttactataacatagttgatcatccgtatggagtaacatgcacatgatataattgtagttcaattagaaatttgtatttcaagtcttgataagcagttaagttacttaaaagaaaaatttgatattcacaataatcttagatactcaaaactaataatgcttctgattttttcaccagaaaatataacctgaaacataattttattttaaatatattttgagatattcaaccaccagccttcacttggtttaaaatatatattgaaaaaaagtgaccacactaaaattaaatttataagatacaattaaagtaacaagtaaaaatagagagtatatattaacgtgtattctaaaataaaatactcaactaattattagaatacatgatatactaattttagcaaaataaaattttgacaatatataatatttagtggaataaaaataccataacataatataaatgatataatgtaaatgtcttttaatgataccgcaagctattcttttttattttctcaattttttcttcaatttttaaaccgtccaattgttaagttaattaacataataacatttagttaatatatttattagaaaattataatttatttctttattattagacaatcaaagttaattaatttaaattactttatcactaatatcataaataaatatatttttaataataataaagataaaaattataattaacctataaaaatgatttttgttacaataaagttttaaactacttattcactatattataatgtaaattagtattcattttcatttttttataattgaaactacaattatcatttatgaaaaatattatcagtgaaccgttaagtaaaaaaagtttgttttaaaaaagtttttaacatagttacacatcaaagaatcaacaatatttattttggttaaatatattatttatttttaatttttcatcatataaaataatggttaaataacaataaaataaagtggtgatattttaaaaaaaataatattattttagttttattagttaaatttagtcaacattatggaattttaaattttttttatttaattcaatttttacaataaccaacataataacatttagttaatatatttattagaaaatgataatttgattcttttttattataggataatcaaaattaattaatttaaattactttgtcaataatctcataaaaaaaaattaaaattttaaaacttcgaactacctcacttatttcttcaaatttttaatcgtccaattgttatgttaaccaccataataatatttagttaatttatttattagaaaattatagtttatttctttgttataggacaactaaaggtaattaatttaaattattttatcactaatatcataaataaaaatattgtttgttatgatagagatgaaaattaaaatctatattataataaaactcttctttttttgaacacatgtcgcactccccttcactctcagcttcggagtacacgtgtcatgctctcatccattttcagctttggaaaatgccgtgtcatgctcacagcaattctcaacttaggagttagcttcagtcttccatccatacctcagcttgggaaaaatacatgctttagacttccgcttttctccgtgtccttctagctttctttcaaattttgaaatttgaaatgacctccctatgcacacttccgctccatctctctctttttcttctccaccaaattcttcttctctgtttctctctttctcttcctccaatttctcctctcattttctcttttctcttatctttctcttttttgctcaccgcactcctcttatctaaaatcctcagcaaaatatacgaagacagtccattcaccagctccgaggtcgttttcatcctcctcaagtaactctcagcttaaatttgtttttcttcttcttggttttgtttcatacaaccaaagttaattaatttaaattactttaccaataatatcataaataaaattatttttaattatgatagagataacaattataattaatttgtataaattatttttattgcaagaaagtcttaaattacttattcagtatatcataatgtaaattaattttaatttcattttttatgatataaactacaattaccatttacgtgaaataattattttctatgccatcataagttaaaagttacaggtaaatagtttcttttaaacaagaatttaacatagttacatatcatacaatcaacaatatttaactttattaaatatattatttgtttttaaattctcatcttaaaaaataatgggttaataacactcaaataaagtggtgacattttaaaaagtataaatatttaaaattttattatttatatttaatcacgattttggaatttctaattttttttatttaattcaattattacaataaccagtataataacatttagttaatatatttattagaaaataatagattgattctttgttatagtataaccaaagttaattattttttatcaataatatcataaatacaaatacttttagttatgagagatataaaaattaaaattaatttttttaaattatttttgttacaatcaagttttaaattacttactcgctataacataatgtaaattagtttcaattttattttttgtgatagaaactacaattatcatttacagaaaataatgtttctctaggccatcatgggtgaaccgcttcgggaaaaaaaaaaattaaaaaaatatttaacaaagttgcatatcaaacaatcaacaatatttatttttatttaatatattatttaaaaagtttttgttacaatcaagttttaaattaattacttgctatagcataatgtagattagttttaatttaattttttgtgatagaaactataattatcaattatggaaaataatgtttctctaacccatcatgggtatacagctacgaggaatttttttttaaataacgttaaaatgaaatggttatgttttttaaatatacaaatatttatagtgttattatttaaatatagtcaacattcatcgatttatttatcagaaaataataatttgattctttgttataagacaatcaaagttaattaatttaaattactttaccaataatatcataaataaaattatttttaattatgatagagataacaattataattaatttgtaaaaattatttttgttacaagaaaattttaaattacttattcaatatatcataatgtaaattaattttattttcattttttatgatataaactacaattatcatttacgggaagcaaagttaattgtggatggatgggctgtcataagagactattatgatctttcaaggaatcatcacatcactttaaccttttatggccaatctatgtttttttaactgttttcaagagcacttatataatgaaatttcttagcaaattgttaaacacatatgttgtattcactctacaataagtaacacctatgtttcaaacaatgctttgtttatgtatttatgtgtttatattttgtgttcgctctataataactaatctctatatttatcgggttattatattttataaattttcatatattattacttcgcacatgaaatttttatgttaataatttaacactattctttgttgctatttgtagcattagtatgtaattaatttttttgaattggcagtactatgtgatatacacatctaaaacaaaaaataatgaaatttgataaatatctaattaaaaagtgaagagagtttatttcttactttttatgttgtatattttaatttataatatagagtttaatatgataaataaataaattataataattagtattttaatcacaccaacttcatcagattaataatttataatatatttccattatttaggaaggtgtttaggattctaatttagacagagtgagttacttcattcatagtttcaattttaaagagactatcccatttgactaagataatttgtgaacaagttaacataaagtcatcttccagaatgttaattagtttttttttttatagttttgttacttaaatttaatcaaaatttgttaaataaagtgttgacattttaattttttttttttggattttattatttaaatataatcaagatttgaaatattttcaatactttttatttaattcaattattatgataatcatcataatgagaattagttaacatatttattagaaaataatagtttcattctttgttacaagataatcaaaattaattaatttaaattactttatcaataatataaaaattacaaatattttaattatgatatataaaaaataaaattaatttaaaattatttaatgtatttcctcccataaccaacacaataacatttataatatcacaatcaaaataaattattttgaattactttatcaataatatcacaaatattagtattttacttatcatatatataaaaatttaaaccatttaaattaatcgcggagcgtagcggagcaacccgtgcgtatgcatgtaataaagattaatcattgtatattccttttctatctaaaatttaattaagatttgaaatttttaaactctttatttaattcaattattacgataaccaacagagtaacaattagttaatatatttattagaaaaataataagtttgattatttgttataagataatgaaaatgaattaatttaaattactttatcaataatgtcataaataatttttgagctataatacatataaatattaaaattattttgtttctgttgtctttgtaatcgacattatcaggtttagtataatctgttgaaccattacaaatgttgaatggacaatgttatttgtatgacaattctctattttttattgctgttttcaaaagcaattctctaccacaatcatttccacaatgacattttctttacaaatcaaaccctaacgccattgtctttcacattttcttggccaatcaccatctcaattccaatgccttggtaagctttttttaacttacattctatataattttaatattatagtgaattatatgcatatatcaaattataacattccataatgtattttgcagcatctacctagaaacatgtatgatttcttaattaagacaacattcacaaatattgtttttaatgaaaccaagacatgcaaaattgtgttcaaccattcacgcaaatatgttacaatcagctctggatggaaattatttgcaagagacaacagtttcaaaccacatatgtagtttgtaattgagtttcctgatcacagcagcaaccatgtgttctggtatatttgttagagacactttttgtcttaactctatcaaatgtaaactctatgttgaaaaccatgttttgttcttgtaattatgacttcatcttatattttgaatagtttgtattcttattatgcttaaagcacttaacaattatattttgtaagaatttgcattccggacttgtaagaaagcattttgatgcttgctttattagagtaaattattattaactcactatatcaagttgtctactatttatccattcaccttaaatcttgatagtaaaatttggtgtgatacatcagtgcttatttattccattcctcaaacactataatgaaacactttttatttcttagtggagtccttaatttattattagctgatacatttagcaatttatcttttactttcaatttttaagtttgcttatacaataattcttaatcattaaacattaaaaatattttatgtaaatctagcatagcacggcggagcgaagcggagccgtcccgtgcgtatgcgcacgggtcctaatactagttaagtaaaaaagaaacgaggcatgaaaaaagaaaataaaccgaaacgggaaatatattgttgagggaagtgtggaaacgagctgcatcgagaagcttccaaaacgccatttttcgatcgaagcaagcaaaccccttctaaaaccctactaccatattttcttacaaacaaacgcagtttctctctctctctcttagttcaattcaattcaatatgatgcagagactctcttcttctactactactcgctctgccttgctgcgctacggtggcggcgcacttcgccggaacgtgcttgctcccgtttcctcttctcacttagcagctaaggtgctcatttctttctctctcgctttacaaattactcttcatatcataatccctactattctttcgccgctaccaatccatttccttttcagttagataacattaattaattatgtagtgtaacttactgatgttctcgaatgacaatcacagtcacaggtgggtgaaaatgacaccaaagcagctagatggttttctattatgagctctgataaatccacaattgattcctcaaacttgaaaagggatttgttctttggcaaacgatatgaatcaactgctgcagaatcttcttcctcagcggccgccgagagatatgagtaccaagctgaggtattctatttcatgtctagtctagtgtcatgagcataacttaactttcgataatatatatgcatccttggctatggcaggttagtcgcctcatggacctcattgttaacagtttatatagtaacaaggaagtgtttcttagggagcttatcaggtatgctcttttgctcttgagtagtgtttgcatatttcttgtctgatagagcatttttgttttgtgtttcattggtgcaaatatatttatctcaccctttttaagcgctgttgtggttgttgtgtatcatgtatgatttcctgcagacatgctgcaagtaattgaaggaaaagtatttccaaaaagatagttgaaaaatccaaaaatagagaagcctgtgtcttggtattgattgaatgttatgaaattctgcattgtcaagctatttatctatgcattttcatttgcagcaatgcaagtgatgctttggataagctgcggtttctgagtgtaacagagcctggactgttgaaggacgcagttgattttgatatccgaattcaagctgataaggataatgggatcatcagtattacgtaagagaaatagctatgaatatgattaatgtttgtcatttcagttggtgctgcaacttatgttttttatgcagtgatacaggcattggtatgactaggcaagaactagttgattgtcttggaactatcgctcaaagtggaactgcaaagtttttgaaggctctaaaggatagcaaggatgttggtggtgacaacaacttaattggtcaatttggtgtgggattttattctgcttttctggtttctgatcgggtatgcatttttgtaaaagtaaatatgtgatgctcttaaatttttttgtttaatatggtatttatataattttttgttgtttgaaggtggttgtctcaacaaagagtccaaaatctgataagcaatatgtttgggaaggggaggcaaatgctagctcgtatacaatatctgaggagacagatccagagaagctgattcgaagaggaactcgccttacactgtatcttaaggcatgctgataatttccttttttgaccatcaaatttttttagttttctttattcctgagattaattaaaaatgtgatttctttttgcctatcggtatctttcagaaggacgacaaaggttttgctcatccagagcggattgagaagcttgtgaaaaactattcacaatttgtctcatttccaatatacacatggcaggaaaagggatacaccaaagaagtatggctctacaatccagatttttttagtttgatagcagtatcgatgaccgtattattttcattttaagttaagttcgtcccttctagattgtaaaatttgactttttgagcttttattaatttttgggctcattccaggtggaagttgacgacgatacagctgaagacaaaaaggatgatcaagatgataagactgaggtgacaatctgattgttctgcatatatgctgaatcaagtattttgttgaatgtgaaagtgtgattgtgtagcttctgcaaatttactcattgactcatgactgagtctttgacacgttgttatgacagaaaaagaagaaaactaaaactgtagttgagcggtactgggattgggagctgacaaatgacacccaaccaatctgggtgagttttatgatttccaattccatgatttgcaattatattgaaaatttattactcgattgaagattgtggcattactctatttatgcagcttcgtaatcctaaagaagtcactaaggaggagtacaatgaattctacaagaaaacttttaatgaatacctggagccattagcatcatcacactttaccacagaggtaagaatttaattgtctcaagtgccatcttgttgtgtgtagtggatttttttatttgttgagttcagctgaaaaacatagcttgagaacatcaatttttctccaatgtccataggagatattgtgttggttatttttattgacaaatgtgtggatgatgtttgttattgcagggtgaggtagaatttagatctatactttatgttcctgccttcgctccctctggaaaggatgacataatcaatcccaagaccaagaatataagactttttgtgaagagagtgttcatttcagatgattttgatggagaactggtataagcactttgctatctacaaccttgaataactggatggtgttctgataattttatccttcactaatgttttgcttgcttaaacagttcccccgatacttaagctttgtcaaaggtgttgttgactcaaatgaccttcccctcaatgtgtcacgggaaattcttcaagagagccgcatagtaagtagatagggcaacacacatattcttacactttacatctgaatctctcgtttaggatacactcataaaattccttaccagtttcatcttgcttaatttttttactccgtggtgcttgaaggttcggattatgaggaaacgtcttgttcgtaaagcttttgacatgattctgggaatatccatgagtgagaacaaagaggtatataattattttgaaaattgttaactgtatacagtttgctttcattttttctttaagttgtagaggagctaggataaattgaggtggctttatcttatagatatatcaactttttatatatcctatcagttgcttttgatctttcttatataacttctcttaagctctttttaaaaggatgaccttttttcctgttaaattttactgactgacttgttctgtatgcaggactatgagaagttctgggagaacttcggcaaacacttgaaattgggttgcattgaagaccgtgagaatcacaaacgtattgctccattgcttcgtttttcctcatcccaaagtgatgaagaactgatcagcttggatgaatatgttgagaacatgaaacctgatcaaaaggatatttattacattgctgctgacagtgtgactagtgcaaagaacacacctttcttggagaaacttgcagagaaggatcttgaagtataagcttttttttttagttttttaacttttgagtacttagttctatcgattaatatatatatattggtgttttttgtaatgtaattttccaggttctgtttttggtggatccaatagatgaagttgctattcaaaatcttaaatcatacaaggaaaagaattttgttgacattagcaaggaagacttggatctaggttaacttctttcttctttaaactttcaataatttgattgaacataaactcgcattttgttaaccaaatatttgttagtctctcttttgagctaattttaatgttgacaatggtgtgaattcgtagcttggttcttgtttaatgttcaaatttgttacgtatagtttgttctttcttttatcttatttcccctttcccctccccttccccttccacttctttttttttttaaaacctccttgtatctatcattgggttcatctacaaccgaccccaattagcttgggttaaagatgttgttgatgttgatagtttgttctttttgcaggtgataagaatgaggaaaaggaaaaggaaatgaagcaggaatttggccaaacatgtgactggatcaagaaacgattgggagataaagttgcaagtgtgcaaatttcaaaccggcttagctcttcaccttgtgtccttgcgtctggaaaatttggttggtctgcaaacatggaaaggttgtcatcttttttctttgatattaaatcatgtattttgaaagtttgagtagcaatgttcagtattaatcacacttactgcaggctgatgaaggcacaatctatgggtgatgcatccagtttggaattcatgaggagcagaagggtgtttgagatcaaccctgaccattctattatcaggaacttggatgtacgataaatagataatccccacttttctttgtaatgattacaaattgaaattatggtgtcgtaatcttgatggataattttcaggatgcatttaaaacaaatccagacgatgaagatgccctcagagctattgatcttttgtatgatgctgctttggtttccagtggttttacggtaaactcatggctccatattattgaatgttaaatagtttccattgcgaaatcctaaactttgtgtcttttggttgtttgttggtgtgcagcctgataatccagcacaacttggagggaagatatatgacatgatgggtatggctctcactggtaaatggtccacacctggtcagttccagtccacggtaatccggccccataccccagaaactgtagaagctgaggtggttgaaccaactgaggctggtggtcagaagtgagaggacagtcatgtggacatttttgttttcttcccgttactttctgttctttcttttaacattgcttacgggtgaaattgtattcttgaagaacatgggtattgatagtaacatttagtttttttttaaccaaagtaatatttgtagttatcctttccgttgtaattataaaacatccagcataaccaagaagtgtttcttttgcttggggaaaaatagataccataataatttggataaatatgctgtggcagcatgagataagaattatttcaatggaacagttgccacaaaaaagattatgcgttgtactttggtccaataaatctgttctgtttttggtgaatccattaaatcaaatctggacttttgattcctgcccctcccaaaagacatgtaaagacataagtacccttcactaggcaccccttcaccaccattgcaatcggacacaaattggctacaatcactcccaccagtgaaagcaccatcactaacaatgacaacgttagaaaggtagtagcaaagaagggaaagaaatgggttgcaatggagaagttagaagttagtgtttgaaaaccatcgttctcagtgacgtcgttcttggtgatatcacctacaacacttgttgtgttgacaatctcactatcgttcaatcagatcaaaatggcaaaattttgcacaacaaaagattttctataatagtatgacaaaaaaatctttaaaaatcacattacctatttatatcttgctacgatacaaaacttgcttactaataactttacaaaatgttaatttttttgtgtaggaagataaagaaattttaaagagttcatatgtagtaataagtaggagagatagttgtttttcaaataatcataattaataggttagttaaaagtgatggaaagtagataattaattatgttgaacctgtgcaaactcgtgtaagtttgcacaagatagaaaaatctttatatgaatactaatagccacaaaccaggaaagtgttttgcttgcatgacctctcaatttgaccatcacaaactagacacaaacttatccccttaaattcaaatttataacaattgtttgtaattttttgcttcaggtttgaaaagaaaaggatcaatggaattggtccacaaagaggggccatgttcccatcttaatctgagagcttagttagccattgatgtgctgaatctggacaagcagagtagattacatcgagtccaggtttaggcgtgacaatgaggatgggaggaattaccattctatcgtgtttcaattgttaatactttgaagtttgaactatgttgtggtggttgatatagggacaccaaagaaggaccatacacttgcctatgacacagggagtaacatggactcagtgaaaactcaactgcattgattgttacccgcagaaagatgcaaactataatagagtggagtcctcatcttattaggaagttgaatgtcaagctccacagtacactcaactgaaatcggttataggaaatgagccacgttgttcatcactcacacatccatgcgagtacaaccaatactatctggacgattcccagacccacaactacttcagccaagagcggctcaccctgaccgacatcgacatcatcgaggacttctgcttcggttgcgactatctccaaattggcgacctcgatgagtgttacgccaacattatgggcttcggcaatgaccctctctgttgtgggacaaacgtctgcaacttacaacaacaatattttctcttactgtctcccctccacaccaaaaaatggactagaaataaaaattagaatggggtgcaaagattataaacatatctcaactttgatttaataataaaagttgataaagatataggcaaatgaattttcaaatttatgagatcattcataaagtgcattcaagtattccatctctgcagataaaaagagtattacatgatgaattgaaggtcgataaaagtatggaaaactcaaaccacacaatgtacgtaatttttttaggcaaattaaaaatgcattgattaaaagacacaagtgcaaagagtattacatgatgaattgaaagtccatccaagtatggaaattttccaccgtcccatctcaaagaagaaaacatatattatataccaattaccaaacaacacatccacctatagaagaatggtttatacaagtaatccttgcatataaaaagagcatggttgtggcaatctttcatacacttttacttccttacctattagctaacatggcctggaaatcttattttctcttagtcattttcttgtttctcttctccctggagaacaacattgttttaaaaatcacgttacccatttatttcttgctacgatgcaatacttacttaacaggagctatacaaaaaattaagattttttttatgagaagagaaagaaattttaaagagtcatatgtaataataaacatgagagatagttgtttttcaaaaaattatgattaatcggttagttaaaaatgatggaaagtgaataattaatgatgtctaaccagggcaaacttgtgcaagtgtgcataagatttttctatcctatgtaaactcgtgcaaatttgtacaagatagaccctattataaatacaaatagacccaaaccaggaaaggtgttgtgcttgcatgaccctctcaatttgaccattgcaaactaggcattcagtgcataaagaaaaaaaaaatcaatgatcaaaatgaatatgttatgaacaacattcttttttgttgaaaaaattgtgctgctttatgaagaaaaaaaagcataaacgaagaaaaatgaaatgtattgtgttccttgtgagcatgcaaaataatattaatccaaaaaattaacaacatatttaataataatttgataatctttcctcaggggatatcctctccctccgtaagacattgtagtcaagtattcatggcaatgaaaatgagttttcttggcaaagagtgatgacttatgccacgttaccctcaaaacagaaaataattttaaattaccttaaaaaagagtttggtacactaaatggtaataatacattcaagtaatgacaaatccatgggcagagaagcacatttatttaacaattcaatggttgaactttattatacttcatacattattgacaaactatgcaattacttggtgcacaactcatttgctttgagtacttttagtggtataaagaaaagtgcaaataaaacaccaacacttcctttgtaacactattttctacttgttaaaattcatgtaggtcctactagttttggaacgaaacccactaaatgagaagagacttgcatatttgatgggaccaacataaatttcacccaatagaagagagtatgtcaaaagaaaaatgttagtgttactagcatttttcatgatacgctacggtattaatggcaatttgggctgcaacaacacattcatacggcacattgcaacatcggtaagcgaggtgtctttcaaaattgaacacccaacccaattggttgactgagttgcatacatgatggtatgcaggacgccaaatttgatgattgaaactacacttcagattatgataataaacccaacattttttatatcttcatgcaacgtgcactccaatgctatatcatctatagattccctgcaggaaacacaaatgtccaaattcagcaaagtttaagggtgatgatgcaaaagactgtattggtaaaagtcaccccggcagcacagacgcatttgatacacgggaagaaacaattggcgatcaagagaatgagaaattagaaagaacaataattattgggggtgaagtttcaccctaataatagggtaaaaaaaatcatcccccctaaagaaatattacttctataaaactcacttccttaaaaattcctcccaaaaaattctcccactttttaccctcaaacaaaacccaaagttattggaccaaccagttatgaaataaactttggggtcttcctgattcatttttcaggcaatgacaaacaattgtgtacttaacatgacaaaggcatgttagtacaattaaaagttgaaactggtgataaaatcaggtgacatacagactaaaaaatttccatgctcaagagagattcacctatactgattagattgaaaaccagtaaaggaatcatcttaaaatccaaaacataagatttcaatatgaagcaaaaaagaaagaacaacttctttgaaaagaacaaaacagggtgttccccaagagaaggaattctatttgaatgataggcatcctctttggatcaaaggataccttctgcaattggctgcttgatacagtattcaatagattttgaggtacctttgatgactatgaaagtgttttgaaggtactgggttacatttcagacttaagcatacattcagtttatacaggcttctatcttgtgaattttaggcatagtagaatataaggagctataagaaggaaaaagagaattcagtgaaaacaatgcttttaatggatttttttttttttttttttatccaactaactatgaataaaagtaggaagctatgtttttctgaacataatacagtaaatgacttccaaattgacgggtaaaaaatattccttcagaataataatgtacttatgaagaatctatgcttacctgctgaagttctcaaagatttccaagtcaggatccccatgagtagaattgttaagtcttgaatcacaattatctatgctagcatccaatcaacttagtgcctgtagatcaaacattgggtaaggtgtgttgatgaatgatgatataaaaattacaagggataatgaaccaactagtgaaaagcaaaactcaggcattactattgcagaaaacaagaaaatatataaaggcaaagagaacaaatggtctgcctcccaaggactagaagaaaactatactccacccacatgcctcagcaactcctcatttacattgatacaaaacagaatgcctaactcaacccacttacccccctccctttagacctatgcataactgctactttcgcataacaagtttgagaagatgaatacacctgataaattaacagcatatatagatttatagagcctctttgcatgatttttacattatgccttatttctttgccagtctcagcccaacctaactagctgactatatcacttacagactaacactaataggcatctaacattgtcctgcacaatagttgcatgcactcgaataccaaggaaggcttattagattaggcatttcctaccaagcacaataggacagaccaagcatagaaaacatagaaaaggtatcaaagagcaaatagcacaacataccaaagctacttttggcagaaatcatcatgttttccaagttttgagcagcctcagtcatgccttgggtgttgtatgcctggatcatgcaagcgaaagtgatgttatcaggttcacattttctttctctcatagccaagaataactcgcccatcttttttgagtcaccaacctgaccataggcactaattatgcaattaaagaagggagtatccaatactacatcagaattttcaacatgcctcatgattgagtcaactttgtcaatgcgcccaactttgctataagcactaacaagtgagcaataagttatagaattaggcttcactcctagatgcttcatcttcagaaagtgttgatccattttctcaatctctccagctttgccaaacacctcaatgacagtattatatgtaacgatcgttggagtgaaaaacctcttctccatgaaatccataacagtcttcatcttctcatacatgccagcttttccataggactttatcatcgtattgaacgtcgttatgtctggctttatccccattagctgaaattcatcataccacttctccatcttatcaagttgcccagcatttccatatgctccaacgaaagaattcagcgtgaaaacatccgggtgggagttgcagttttcaatcatattattcaatgcatcatccatctgttcaaacatgccagccttaccatatccatcaatgatagaattataagtcacacagttacattcgatgcccagatacgacatctctgctagaacatgttcaatcagatcaaaacgacgaaatttcgcacaacagcggataagaatagaataagtatatacatccggttcgcagtcaacaactgatttcatatcttcaacagtagaaaaagcctgatcaaggagaccactttgaccataagcacttgcaagagcagtgtagacatcaacagtaggtttaaggccttcagacaacatgatctcaaagagcagagaagcctcttcaggctgcctgcacttgccaagcatcatcaaaagctttgcatacgtttggcatcgtggttgataccagtattgcttacgaaggagtgcaaaaatctgcaaatgataataataataataatcagtcataattacttgtttcagagttcagacacagaaaatgttaatcctaaaatcaattaattactggcctcgagagcggagtgcgaacgacagcgtttgatggcgtcgtcgagggcttcgagaagggccttgggccagagctgtttgtgggaggaagacttggccttgttctgaacgcctctgatggcggcttcggttcggagaatgcggcacaagtccttattggggttcttcaccaactccacagacgctggtttcgaactccgcttcaacgactccacccgaaaacgacgacgtgtctttggaggagtacggttggttgaagaggtgaagggtgtggcggaggagatggaagaggaccatcttaacatcattggagatagaacaagagtcactcacgaccatcttacaatttttttaatattcgcaaatatatgtggatatttagatgctttaactataatttttatttattttaaccatttctttaaaaaataatttaaaggtcaaaactaaagttatttaaacactcaacacaattatattaattattatactttattttaataaatttaaatattaaaatgcttcagtcccatgaattcaaaacaaaacttaataaactttagggagtgtttgttcattcaaatcctttttaagaatttcgagaaatgaggagatcaaaatatatatttttacatttatttaaaggtaattgaaaaatactctttcatatcttttatttttaggaaagtgagatattcatgttaatgttaatattatattgagatgattctcatgaaaagaggatgaaatataaatttttaagaaatgagaatcatattaattatgtaaaaattctattataccctcaatataatatctaaatatataagttagtatttcagattttactgttcaactttgataacaaagggtgtgaatttaaagacagaagacaagtatgttgcagttgttttttaaatttattttttgatatgaagacagtttatcgattgtgtttttggtttacttggagtttggttaaagttatgttgtatgtgtctttttatgttgtttgtcttttacaagggtattcgtttctttaatagtaaaatgtggttaagaaatttattagaaaaatttataagattcttcaatgttatttgtaaactgcagtatttgatctcctgtattattgtgtaggtgtatataatgagttattttatatattaaaaaatattttagtaatataacatacatttttagaaaaaaataatgtgaaccaaacacattttaaaaatatttatggaaatctaaaaaaaattctcaatcaaattttaataattaaacaaatgtatttttcttgaaatatccaaaaatatcattctatctaatctaatattcttggaaataacattcccaagaatgaaaaaagattccaggaaccgtcctcgaagataactcaattctataagttcaaataaaagctaataaaatataatatttaaatttcacaaatccaaaataatttttaacaaaaatatttaaataattttattacaacaagtatttaacgagtatagtaaaacaaatactttaatgtatcaacgagtagtttaactcaagtgatcgagcaaaatgtgaaagttgttataaatttcttaagattgtgtttgattcttacaaataataataaaaaacaactgatatactttaatatctgtctctaccattttattaacaaaaataaatattgcttaaattattcatccatacttatttagatatttatcattgtgtttatcaagtggattgaaaaaaatccgtgatctttgatccagtaaaagaaaatgtctatcttttatctgtttatatatattacaaattttatccacaaatatatccatccacatccctaactgaaaaagtagccagccaacaatggcttgatggtaagttctatgctgattataacacaatttgatatattttccccaatatattcatttatcaggcaatgatataaaataacaactgggtaaatgcattgaattcggttacttttttccctgaaagttgttcagtatatggtcaatggaaatttggaataatctaaattgtggtgctgatgtattacaagattccagcaacatgccaaattgcctattttacagattgtgtagtggataaaggagaaatataatggaggaaggaaaaaactattatatgtgatgtgactatatcgaagaggttttctttagtattttaaggttgattatattttcttgtctcaattgaataagttaaattttaataattactcctgtaattaacctttttggcaaatgatacgttctatagtacttataacataaaatattagaataattggaaggatattgttagatatgaaatcattcattagttttcaatcaatagctttcatcgatgctaacatttagtgcatatattttgaatcttgtgtgctgaacttaaatatatttttcataaattaagccctctcatggagttatcttaacaataactatgcttacttataagatttacatcacgttttggaaatgaaatttgtttttgatgaatgattatgcatggcatgataaatgtattttaggctccattgttttacgattgtctgatctattttttgcattgatgtgtgatgtgcttgacatcagttttaccaaaatttctattgatgcccaagtcagttgtaatttgcttaatttctcatgttgatgctatctgcatgtagcttttagctccttcaattttctcctaggtggttgaggctttagctaactaatattaattgaaaactcataatgccaaaggagagaggaaatgggtctttgttacatgatagttgtgttggaatttaaatgcttagacataagacatgcacacactattatgatcatcatgtggtttactggaaaaggatggatccagtcttcttggtcatttttttttttaaatctttggctcacaggatattttcaaccaaagttcttgcagagctggaaaacgtggtatgactctccgaatttgactttagttggttttaaaatggacattttgttaagtttttgatacctgcaggtatgcaaggtcccatatctacagctaatttctaatcccatatggcattctcgggcttcgtcatggacactctacatggaggttcctcaatctattcttcgtggtagccaagccaaaacatcagattattatgagaaaaatgatggcaagcgtcagttttggactaaggtggtgatcaatgatgattgcatcaacgttaaagctgaaggttctccaaatgtcgcaggcctgttcaagggaaagtttgaggaaacccattcaataaacaaatataactgcaacttagctgatctttctgtgattattttgcagcaggtaaagcgaaaaaatatttgatgtcattgcagtgactttcgtattcctaagtggagaatttgcatatatgtgagtcttacgtgtaattatacagcaagcttattactgcaattgaaatcatgcaggttgcgagccaaattattaattggctctatcaggaagctatgatggatgggataaaagcaaatcgagacttcttatgcctatcttttgagctggagcagggtgaaacacttggcctggttggaagggttgatccagaaaatagtgaagggtgtatctcttggtggttggtcatggaggacagttttgcagaggagcaaaagcttcatatgagcatcactgatggtgcatctgaatataggaaattcctaggtcacttgtctgttgatttgttatacgcaacactgatcgacttggttggcttgtgcattggtggaggcggccaatgaagttgtgtgaatgtttttcttgcactttgtcaagtgaaagaagatctaggactaggaggtctcttgtgcaacaatggtatataatttacgtacactacttctcaactgatttaggagagaaataaaagcatgtttagtgtaaggtaaccatcttttaagtttaagatttaagtttaagatatgatatttattagattttttaacaaaggaattgaatagatttcgatacaaagaatgagttattgtagaagatctcttaagatctggacattgttcaaaaaagaataaattttcttcttttttctctcttcttaaaatttcaaaatgagatctaccattaaagaaaaaaaaatgaaaaagattttgagagatctttaatcctatgtgatactatgagatctactaaaaaatagtctaaaattctaatttgagatctatcaataaagatgttcaagaagatgttttttatattaaatgagatgagatatagaaaaaatataaaaattttttaatcatgtgatctataatgtgatgtcataactcataagtacgtgatttcataagtaaaaatagactgttaactacaattaatgtatataaaaattagaagaagaaaaacttggtccggatcccaattattatgttatgtaatcataatggaaggtaaagggaattcgtgacaaaagatgaaaaaaaaaaaaacgaaagtaaaaaatttataaaagcaaaccattcaacaattcatgataattcagaaaccaaggaaagaagcactgaacagtaatagtataatgaaattgaaattgtttcaatcatacttacccatcataatgaaactgaaaagtaatggtttcgattaggagcgttgtaatgacttggcataatttggtggaaaattaacggtacttgacagagttaattaacgcttttgcccaacaagaaaaaatggcacaattatgaatgagtaaacatgtaacgctagtcaaccgtgtgaaccagtcatcgttggaaaacacgaccagaccaccttccttcccacttccacagttcaaacaaaaaataaaatcaatttgattattctattttgtcgtgttcttcttaattcgccggttccgtccttttcccggtctgaaccggtcagggtaaaatgggcaaacacaccattcctattttgacctaaccaacccatttctcttctttgatcccccatttcttcttttattaagttgtgaacaaggaagatatatactccaatcgattagccttctttccatttttcttctcctctctctggtaaccttcctctcctttttaatccaaattatcattcttatattttcaaggatatttttgctgtgattgcgtgaatttcgatcaacctttgaaacatcctttgcagcgacttttatgtctcaattttaatgtcaactttctgtgctgggtcgttcaacttgcatctttatcatttgatctattgtttgagttgatgagtgaacttgtgtgacatcatagtttctgtgagagattgcatatctctcaagcttctttatttgataagaagctcgttgcacaatagaatcaagagtgaaatcactggtattaaactttctaatttttcttcttttccgttatcactgatggattttcctgtgattattgtgtagattatgataatatgttttttcgaatgtattttgttttttggcatcagtttgtggaaaaattagggcctgactgcttactaaatagtttgataattattctctctactctctagtctctagtctctagtacttgctttgtcttttgtaatgtttctgtgttttggaggtttatgtggagtgggggcagaggatgaaaggctgtaagcctgcaacttttagcagattttgaattttctcaagttcctcgctcatttgtaacattttagtatttaactatttgtagcataacaaagagtatgtgataatcatgtgcagtggtatataatccccttagctagttactgactaagtaaatattttttgggtaggtcaccaggctctaacataaaacagaagcctttgtgaaaaagaaaaaaaaatgctccctccaccacagcagtcacgggttggaggactacaaacctctctatctctagtttcttcggatccccgcctttctcccgaggagcctagatcaaactctgacaatctccgtgaatctcctactgaaagtgccagttctcgagaaacttggcctactgctgatgcaattgctgcaaagaagatggagaatggaaaagcagagatggattgtcctgatcagttagttattcgccgtgtttctagtgcagacaaaattagtcttcaggacattgcaagagaacgagttgatataatatgtgagaaaatgcatcttttacctgacgaatttcttgaggaactgaaaaatggacttcgagttatccttgagggagggaatggctcacagcatagagaagaatttttcattttgcaaaagcttgttcagagtagatctgatttaacagccaagacattgataagagcacatcgtgtacagcttgaaatccttgttgcaataaatactggaattcagggatatttacatcctagcatcagtctatcacaaacatcactgattgaaatatttgtgtacaagagatgcagaaacatcgcttgccaaaaccaactccctgctgaagattgtacctgtgagacgtgcactaatggcaatggtttctgcaatctttgcatgtgtgttatctgcagcaagtttgactttgaagtaaatacgtgccgctggattggatgtgatttgtgttctcattggactcacacagactgtgccatacgtgagcaacttatttgtatgggcccttctgcaaagaatggagcagggccaagtgaaatggttttcaggtgtcaagcatgtaacaggacttcagaacttctgggttgggttaaagatgtcttccagcattgtgcaccatcatgggatggagaggccttgatgagggaacttgattttgtcagtaggatctttcatggtagtaaagacccacgagggaggaaactttattggaagtgtgatgatctcaaggaaaaattgaaaagtgggaaagtggaatctaaggcagcatgcagggcaatattgatggttttccaaggtacaagttttctagtttacctgcaaattgtagttttaaagtttctgccttgacataggctacacgcacatggatgcacatgcacatagtgtgaatacaacattattgtttttggcattttttttgggcccatttactatgttcatatcatagtagtatttgtttgtactgaaaagttgaaatttcattaaaactgtgttaggaatgattaaaaaaagaagcttttagactatactttgaggttatctccaaacttcctgctttctcttcattaaaacctgaatttgaagatatctaggaatgaaattgtgatttgcatagttaaaaacatgtataatcaataaaattaattctattactttattaattatcctttcttcttgttttaaccaatgcttttcatatatgaagagcttgaactggactctccaaaaagcctggaaaatgcagaaagtggaaggctgattgctccccaggaggcatgcaatagaattgctgaagtggtgcatgaggctataagaaagatggaaatagtagctgatgagaagatgagaatgttcaagaaggctcgcttggcttttgatgcttgtgaacgtgaattagcagacaaggccagagaagcaggagaactgaaaatggacacgcaaaaaaagaagttacagattgaagaactggagagaattgtgaggcttaaaaatgcagaggctgatatgttccagttaaaggctaacgaggctaaaagagaggcagagcggctccagaggattgctcttgccaagtcagataaatcagaggaagaatatactagcaactatttgaagcaaaaattaagtgaggctgaggctgagaagcaatatctgtatgagaagatcaaattgcaggagacttctcgtgtatcacagagcagtagtgggggtgacccgtcttcaatgctgatgtattccaaaatccatgatcttctctacagtgttcctccgaaggcagacggtcaatctaatgagtcccaccctttcagaacaaacccatgagtacgggttttgtatgttataatcttttacatattatagcaatgttattctgttgcacaattgatgaagagttagtctaattccattaggttcaagcattgtaagccttttgtagatcgaagaggtactagtaactaaaggcttaactcagattgaaattcggtttgttctatgcggtgtatgtatgaatacgcatttgtgacaaattattgattgtttcttgatttgtggaatctaattagttagttagtcaatatgtttaacattgtggtgagtgggttggatcaggactacaggccaaatagctcattgtggagacaaagtaaaagtaatattatgttattgataaaacgaaacgacattacagctgaagggcaaagtatttttctcgccttactggaaaggtgggatattcatctttttgacagataaggatgggtttgtcacactgctgttctttggagactccttgggttttggagctcggtgggaaggcaccatgttttcaaatgtcaaagcagcactgattccgtggcatcttatggaagagctttggcacacatttggtgtgacaatccttgcattgttgacaaacaaacctgttctcccaccgttggtgatgctgatcaccctgcttggaacgctagagggaaccacagagccatttggaaaatgtaatagatggctgagcaataatggtgttggaatagaatggctgagtatgaaatcatgaagctggtctagagctattgagaattgagatagttcatcatcatttggcattaggaatgtcaaatcattgttttgcagtgagttgggctggctgttgagtattttgaggaggatgacaaatccatagtaggaccgacttctcatgtcagtcatggctacctgcaggtcggtttggttgaatgacattgtggactgagattcaccaatgacaaagaatgtaagaaggatcacaaaccagatagccattagggaaatgatgagattttgcttgaatgtttactgtttgtgattgtgtgtgatgaatgcaatgacatctcggtttgcttggtttttatagccacgttattgtttcacgcttatgttgccacactttcttcccctttctaggaatgtaggcgggaggccggttgtgcatgatgaggtacggagaatgtagtagttagccaaggaagctgagattgttttggagtttagaggaaggtgattttttatttatttatcaatattcagtattaaaccctttttagaggaaggtgaatctccactttacatttttctgttttacatgaattacctacccatcaaggagtgattattgtgacttaagcctcgaaactcaacgagctatatctgagtttgacccattttcttattctactatgaacacagtatgtaaggaaataggaataaaaattattttaggagaggaatcctaaagcgatgacagatgtgttttaagagacaaagataggaaatctttttcagattttagctacgaaaacagctagtcctaggcacagaactcttcgttggtaacttttaacttcagacagaagcagtttgttgagttaaacaacatgtcaatgtcatattagaggagatcaggcgattgtacaggtgtctgcagggcaaacataggtttatcaaaactttgtatgaaaaaaaaaatgagtaataattttttgaaaaatagtaacccatgtcccaagagtattggttaaaaaattaaaaggaaaaaaattattgagatatacaaattgtgtttgtctataattttttagttttttctcttctcatttttactctaccactagtaatggttcttcgaacatcgaagtctttctcgcttctagtcctaggaagatcaaacaaattgtccccaatgatataatttcttagacgaatcgcgccagacacgaaattttccacaaatctagttcgcctcaacgttaagcagtgaacattacgcactcgacaatgaacaatgcccgtccagtagcaatatgcagggactccgttcacgctaggcccgtgttttgcacctgtcaaacactgtacaattcaacatctgcatctctaaatatgctcaaaacattgcacttgtgtcgatttgtttttgacgatgttgtagaggaatcataatcaaactctcttcatgaaaaatatagatctatattttttctttaaacattgcacttgcgttgatgttggtaggacaacgcgtcatcttcaactttaagtccaattttgtctatgttccgcgttgaatcaagaggtatattttttctatatattttttttatatataatcaagaggtataatttctttccatcgttattctatttttagataaagtgataatcacttcatattcaagtcaagtcaaaattaaatctcaaatattgattaagaaacctaagtgacaaaccacttataccaataactttttgttgttccaccttgaatctaatcaaacaatcttcatgaaaaatatagatctatatttaagcttttcacggggaccaagatgacttcaatcacatttctagagtttgacaaagaggagatataaaatttgaagcttctcatcactattgttcatcttccctacattaaaaatccaagaaaagagaagtctattcacgcttttttctttcatttaaaccattgaaatcatgaatcacaaaaaatatataatatgaatttttttctcacaatattccaccaagttaatgctttgaaacatgttaaaaaaaatctataaatttggatatattgtagatttatcaatgatcttttaaagtttgcatcttaactttattttttttaaacgttttcatctcacaatatattgtaataataattttttttactttcttaattatttaatttaaatcatcaattagcattgctttaaattagcaagttcgcattaacatatacaattagaatcataaataaataacttaactttaagaaaataaataagttaatgttgattaatgtaaaaattaatttttgtatgttcaagaatgattttcttattaatatctaaaaaaagaatgatttcattaatgaaaaatccaagagtattaattatggttaaacattttaaattcttttaaatcaaatattaaattatttttaaatgttttgtataatactatttttattttgttaatctgtaccttaaagttagaacactcttataaaaacgaatcatataaatttcatcttcaatattcattctgtattttaattacatacttatctcttaaaactttttcgccaacatattttaattctttgaaacacgagcatgctctaaattgattcagctgttgaaaacttcaactgccacttgttttaagtggtagtcgtgtctccaccataggtgggggacaccttcttacccaaatggtctccaaacgctagctcctatatgagtaaaacaaaaataaatttgaaatcttcaatttgaccaagagtcaatatggtaaatcatttcaagacaagcttggagattataatctttcatgctcaatttataaagccatttgcatcagcatgtcctcttcacacccattattataaaatataaacagctaactgacactatattatataagttcaaattttgatgaatatatcaaccttacagaaataattaatgttcactagctagctaatattgagggttacagacgtttgcaaagataaaaatcagcagagcaaaggttgctatcaagcttggtcaagacaaggttgtgtgtcaggaaaatagataggtgagctaatttataatgtcttttgtcttttatcagttttgtctctattttgattaagttgtcaacttcagacttgtacatgttacagttgtcgattttatttaggaagaattatgaaaaatatgacatttagtaatatttataaagaatcattctaataaatcattttatagcaacattttttttactatataacccttttatttattaaataaaaatattaaatattttgaaatattaaatatttattttttattcagtgtttctttcataaaatcttaagaagattaatagtagcgagagaataatatgtcgttattcatttatgaaaaattgaacaaagacatgatcatattgatataatacatttttaaatccaaagtatataatcattcaacttttacttaataaatagttaaatttatatttttaatatgtaaaaaatacaataaattagtatcataaataatttaatgataaattaattcttaaacttgtaaattaatatcaaattgatttttaaaaatatatatttttgtgaaattagttcttaaacattataatttaataataaaattaatttatcatatattttacatattaaaaattgaatttatttttatttttcataaattaatttatcatggaatcacatgttttaagatgaatttaattatttattcaaataaaaatgatcatcttatttgattattgtcataattgtgtctctctagctaactgggaatagactagctatgtagctgcatactaaagcatagggcatagcttattacgctgaaattgaaaggagcagttattgtgcatccgaggcagactacacatgctgttggctgccatctaccactgtattcagatttcttgttaatgtttggtacccgccttgtatcaaacgtctgatgttaccttacgtagttttattcttcaattttctctctctattctctactgcatgtttgtgattcactttttttgaatgtgcagtatcccaaattgaaagttagagaccaatttctcaagttactgaaatttatttatgttgtatttgattgaagagaaacacattagaaatgagttgaaaaggacgaaaaagtgattaagattatgttaacaaaatcatttcgttgaatgtaatgactgttttctcaaaagtaattaaggaaatacttctttgtgctcaagaacgtgcatgtgttttctccaatgaacaagtattcaaacatgtactaattataagaaattcatagtttgacatatgaagaagtattgaaattttttttaaaatttgtgaatcttacataaaaatattttggtgcaaaagaaagttgaaatagcaaagaattgatgagaatctagtctcagaagcgttgttcacttgactgaagggtgtatgataaaataataatggatcatttttgtattataataaattatattacattttatatgaaaatgacaaaataatgccttaaaaaacatatataattgataatcaacatgtttggattgacattgaggcatcgtgtctttatcgtgattttttttttttatacaaataatagtttcaaccttgaacatggatcgatatgaggcagttaggtgtatcataaacacatgtccaaacacttacatatgtttattttacataatcgattatgatattttattttatttttctcttttctcttttacttaatttatcttaatttttcttaaatcaaaccaacaataattttttatcacttacatatttttactcttattttatttctctatacaaaacaaaagaataagcaatttcttttgggccatttttacatttttatgttaattagggttattattggttgcaattttcagttatcgaaatctaattaaggaactaatatattctgatatattatattatactatattatatatatatatatatatatataagaattaagctcttaatcacgtacttaaaaaatataattatcttacgaatactatatcatgttagtgatttgctttttcttttaatatttattttataagtataaaataagtaattatattttttaagtaaattaatacaaatatgcatctaacaatcttaaatttgcctcctatagaatgaaggacctgcgttttaaaaagttaagtataattatgattattaatttaaaatagttaaactataattaataattataattacattttattctttaaaatataacatgactttggatcaaactaagtctttcattcaaagcaaaattaaatatatttttgtcccaaaaatttaagttattgttatttctggtttcctaaatttaaatttatattttagtctcttaaaaaatattctttttaatcattcttaattgatttttgactattcagatgcattgtgacttttttacttcaggggggcattttttgtaattgaggaactaaaaataataaatttaaatttaaagaaccaaaaaaaatgatctaaatttgagaaaacaaacatatttaatctttcaaaacatgtatttaactattatgtatgaaaaatttattgaccttcacaactaaaagtcatatcaatagtactttttaattgatttacattgtaaaagtctttcattgattgtgtataacagtcaacgaattgaccataaaaaaattgattatttagttattttaatctttttgggatcaatttgatgatttaaacattttggttggattttgaacatttctaataaggtatctattttcttgagtacaaataattaaaaactacttaaattttcttacttgaagaacatacatatacattgacaatgtaaaatattatcattcaattataaattttcatgtatgataaatttattaatttttattatgattattttaaaattatgtggttgataatattgtataatcattaaactattttatttatgtataagataaattgtactaattttttttaatgtgtatttatctcttttttttttttacttttttttataaagttttatatttaaataaatattcatagatgcttataaatatcaatactgtttagaccaaaaaaaatatcaacaaatctacagttgctcttcagttattggattaggatgatattcgtatgcatccatatgcagcacttatccaaaagataactaacttcaagcatttgcattgggatctgtccttcaagcatgatcataattatagggaggacaatcaatatgcccgactggttggctcgacaaggttcttcttcaacatctgttattggctgatgtctctaatgtttcttttactatttactctttagtttctattcttctgtttgtatattagtttccattcatagaaaaacaaatatcaataaataagttaatatttataaaatttgtgaatatttgtttcagatatccacgtggatagcaaatttttcattcagccagacaaatgaaatctctacttacaattatttccaacatgaaaattagacgctcactaaagaaaaatatatatttgcctccctcccctccccctgaaagctagagaccgcagtcattaaattaaccttgaaacttactctcttaacctatgattaaatggttatatatatatatatatatatatatatatatatatatccctacctttgtccacaagtttctttaattattttgctttggtgagtagactataaaacatgtgtccttaaataatttcattgacctatatatttcttaattcttaaccatcactgaattacatcgaagagggaacattgattgaatcgttggattattatgtaacagccgtacaatactaaatttcacattataaaatcctcttaatcaatacaaacatgcggacatattgtagaaagatttgaaggtaaacggctttgtttggtagttcttgaaaaccacgaaaatggcgaccaaacctaaattaagctgtgtcttaaatactccccccctccctcaataagatggtttctgtttaaaataatatcacataaagaaaataattattgtacaaccatgcaaggaaattgtattaaatttaaggcatttgaaaatagtttcttcttgttactattcattaatttaaaaccattgactgaagaaaaagtaatattctagcaagaaaaagaaattaaaaaaatagattgaaagattataaattccatgtctttaatgggttaaatcaataagttacaaataaaaggtgagaaatcctgtagctggaataattaggaatagaatgcatattcttgaagagaaatcttcctagggagaataataggcattgtggtggccggtgggtctatgcccaactggattttgtaattattgaacctacacatagttactcgatgtgccccatacagtaatgcacttcccacatgaacatagtacttagcttcaaaagatgaataaattaatatagcgtggtagtttccatggcaagaagtgaaaagaaaagttggaaagggaaagtaacaaagcttccaatgccattatgccgaagtggattacaatgaagcatggccctacaagttttaaccatctaagagttgctttgatgattggattaattcttttctggctggtcactttctttttgaccctcaagtgttctgtttgccaatcttataaaaatattttcttttctacaacacgtatatcaatgtaaaaattataattatagtaaaagatgtaaaaattataattcaaattcatttaaaaatacatcttaatcactattgacaatttaaaattaattatatcaatttataaactaaacggctcctaaaaccgtaggttttactttctttctcgtaaaatatacagccactacttgcctctggctatatgtcaacttattttcggcggaagatattgtttatataataacgttgaaaaatattatattattgtgaataaatattttatgattttacttgataaacgtacttcatggtaatggtgccaaattgccaactatgaacagcccaaaaaaaagtaatggtgccaagccaaattggcaatgatgatcgaacactccccttaaaaaaaacaaagtaacggtgccaataggaagcacagctagttcagcttgcatcatcatattccaatatgttgttatatcacccgaatcgaactgacctgcattcataatacggaattttgttttttaccctttatcacagaatttaaaaaatggtgatttataacttttttttagtatgaataagttaaatgctaaaaattacaagaaaatttatatttgtgaaaaaaattaatacttaaagacctgtttgattttgaggaaatgcttctgttttcattttctatttttagtttctttaagaaataatgaaatagtaaaaaataacaaaaaatattttacttttttctttttataacttttgtaaataagaaatataggaaaataatatggcatttttataattaaaattaaaaacatatttttcaaatcaaacaattcctaatttttcaattctacattagaaagtaggacacccccctcccttccagataatgagaaatagatgagtttttttttgtttttttattttttatgaaagagtttattattatatttagcttaacaagaaagtatgaatacagattaaatttgtttatagatctgactataatataagaaatggaaacgctttattttattaactcaatccaaattgtgtggatatgcacaaagtatgttgtacacaatatattttcacagcaaaaaagaccattcaatcaattgacttttcttttacagaaataaattgacttacataaacaataacaaggctatccagttgaacttacatatgtgattagcatatgaaaccaactcgtcaaggaaatattcaagctcatgtaatctcattagacaataatctgtgctgtgtctgtctaccactcttagctaggttttacttatgtaggtaggtatatatactatttcctcctcttttattgaactctatgaaaacttcttctctctgagtgaaacttatacattcttaactttccaacataacagtaccgtataacaggttctccttagcatcattgattaatgtaaagattgtaatattgtttaagcactggaaatgttctggatcgcaagaaaaagtggcatgacaataaacagcaataatttggctgtatgtaaaacagtgttggtagttactatttttgctagaaatgacaaatctcaccgccatagcaaaaatcataaaagtgggactccactttaaaacttaacctatttccgaaaaaagtatttctcactaatcatatatcatcattaattaataggcataaccctacttccatatcccacaatgatgattaactctcaaggcaagaaattcacagatctaaactctcaaactgtatatgagggtttttgtgccgttgatcaccacctaattaagattaccttattaaatgtttaaaatgataaaaaaaattaagttaatataataatatccatgcaatgatggtcaaaccaattatgcttttgatagtagtttttaatcaaattggcactttgtttagtactatttctgggttgattctcactttcgttcattattatatattggtgggtaaggtatatagccgacattcattttatttgatgcccccattacacctatataccccttatcaaacctatataattttctcaaaaccattgattccagaatattttggcaccatgcgcacattagcctttacccctctgaataattgcccattcttcttccagtacgttttgaacataaaattacagtgttactttccacttatgatggaactgggaactggacaatgtgctacgtgcattaccatttttaccctttttttaatttctctccctatctttcaagatcttattccctctctctatattctctcaccgtttcaccggaccatttcttctcacatattttttttctgactctcttttatcttttctggcacttaaatccgtattctgcagtgcacagttggagtactccctctttaaacactgaagggtgcggtctttgtcaactcttgcaaaagcaaaacaccaaatcgaagttaaaaaaaagaattaaaattaaccaaaaattcaattatgctatatattgctgaaaaaactaaacagtaataattgatattaaaaaaaactgatgtttttattttccttttaaaatttatttttaatcatggatttttgtttgcttttggttaaaccttccccaccagatgatgagataatcatgatccatcctcaattagctaatgctgcacaccaaactggggggagagagagagagagagaggggggacatttaacattttctttctgaaaaacaaaatgggttatatcagcaaatttgcaagaagatgatggtcactgtgtgatattgttccactctttgatgcttctgttgggtgttcagaggtcagtgaggcagaaacaacctgttctagaaaaagaacaaattttcctatctcattcacagctcctctcagtgggtttgatttggtgtgattattaccccatgctcctcttcctcctcttcttgttatgttatctcttcaacttcaaccttcacggatacccacaaaaaaacaaactttttggttgggccactccagtccaagcatagtggagctccttccttgatatatatcaactgggttttgtgcaacttttctctcttgccttgtggaagtatcataaagcaccaaactttatgccctgaggggtggattgctgagaaaacatttgggtgtgcttcaattttgcttttgcagttgaagattcatggtggggtgcttggtggttcagctttttgaatgttctgctcaagctgctggggcttgccttgaatctccaggactgttacgttggtgaatttggcaaggatgtctgtgaatcgaaggcttcctgcttcaaatggtagattgctatcaaatatgaagtcttggaagctgaatgagcctctgcatgggtctaattctcccaggacatgtaggaggaagcccttgcttccttggttttttggctttgttgccatagggagtgtttggttcatcttgagtttcaatagtaagtatttggtcagcaaggagaatgaagcaatttgtgaagagagagagagaaccttgctacaacgttacaatgttagtaggaaacagattcatgctttggcttccttgttctctggatcagatcaggtgagctacactttcccctccactctttcaattttattgcgccatatcgtggtcgctgaggataattcataattatttacttttgcttagaaactttaactatttggcttcttctatgtattaactgttctttctattgggcgttattgtcactaaataaacaacttcttgttggattttatatttgagatgaagtgaaagatgtaaaatactgagaaccaatagattgtcttaaatgaaagggtataaactatactattctgatgctttttccgcaaggtttctctaggatcgctttatgttgtacaaccggttaagttctaaaagtgatggatactatcttgctagatatttaatagaaaacagtggttgttgcagagatgaatatgaatagtaacaaagtggtgctctttgtcctatgtcttactaagtttatgatgcagattttatccaactgtattgatgaaagaagacttcaaatgctgttaagcagcggcatggtcagtactccacagttaatatgtccagagaatcaagagttacaaaatgagcatacatgtgttgcagacactgtagaacctacagaacaatgtccaattctcaatgattatgtccagacaaggcttgaattatcattcccattgaaaagttgtgtatcattggcctcgcactctgcactttcaactgatttggttagttatttgcaccacggaaaggtagaatctttactaaagctaaggcatatatttgttatgcccaaaagttccataatataaattgttgattctcctaaaaaatagggagtacccaagaattatagcctagcttacaattctcttttctcactgctcaacctatcctggggggcataatatggttgttgattgaatggagataaaaaaagaagcatagtgatgaactttaggattcctaaatatcattttctgtaagagtgctcagtttgtggaagctgggtgagaaatgtaactattaataatgcatcatctggatctacagtggtaccattttgtatgcacttgaatgtaatcaaaagattcccttgaattgcctatctggcatcatagcattctttctatagcttggctagtgctataataaatttttgtattgatgtgtaaaagacagggcatcaccgatcatagtctagctttcaaatcattcaacctacagcctaataataatagtcatatcaaggaaaagtagtggattttggtttatttgctccaaatattgtctttcccatgttacttgtgaatgtgatttataccatagattctgattgtaagcttgtccaataactatgaaggcatgcactccttgcatgcttatttgaaacaaatacttccattatataattaatttgctaattcattttggctttgcagaacattgtgcaatcatgggaactgagggtatctgcaattcggtatcatgtgagttcatctaatttaattaaaggatgctggtgggtcctcattggaattataatgtcctacttctgtttactatggaggaatcaaaagcagaagctagttcaggggcatccagctgcacaacaaaagtggttgaaacattttccaaggggtccttcaaggggtgctgggaggtggaggaaaaagttactagttatatttgtgtcacttggaataatcgggtccttttggttattttggcacctgaatatgggaattatgcggagaagagaagaaacgctagcaaatatgtgtgatgagagagcccgtatgctgcaagatcagtttaatgtgagcatgaaccatgttcatgctctggctatccttgtatctacctttcaccatggtaaacatccttctgcaattgaccaggtaatgtactcaatgtccttctcttctcttattggtattctcccactcccatcttatgcagacttattcatggccagtgactccagatattttgcatgtctcctagacacttttgcttagtatatcttatgtgaatctaactaacatatttgagtggctgcatagtaaaaaaggaaatgtaagttttttctattctaaggaaagcaaaatctgatccaaatgatctgtaaaaactagggaaaaggcactgttgctcactttcatgtagcaaaaactgcatacatataaaataaaataaaatgaacaaaagtaatggaaaaaggtggggatgctgaaaaatatgataatattgacaaaaaaaatggaggaattcaggttgtgccattgatccgtaatgtgtcaaaagtttgagctattgaaaagtatagataatgaagtaaagctcttgctatatgatttattttttctccacaactagcctagataaaatttctagcttctctctgtttttttcattgtgttatggtaatgttgttgcaaaaactaaatctgaaaggagagtgtgaatgagggtatcaaatgaatatcttttggcacttttactagctataataagaaaagcatgtttgaccacatttctaattgtcattgttataaattttattagaaaaatgaactagacctaattcaaccccaaaagctagatcaacagagggggagagaattgcccaagtgttataaggaataatttggccatgttttaagccattgtggagcatcgtaacatgcatcccctcatgcccaggactacatatcggagtgttaaggaataatttacaggtacctaacatcaagattgaatagactttggtatcatatttgaaatgggtgggatctaacttaactctaaaagttagctcaaaggggaggggggaattactcaaggctcaagcctttcaaggagtatttggccatatttctagctaatgcggaacgtcttaacaactttatacctgctttaagtatatgctaatcttacaaaaaagtgtacaaggtttgaactgggttcctcttttcacttgtaattctgatatggttaacactgaatttgattgtattagaccagtaaggtttggatatgtgtgaagattgcatagtataagtctccatgttgaaaccacattaaatttatgagtcctcttcaactctctgctatttatatgttgttcttgttgtaatattatccatcttgagggaaaacaattaaaaacaaaagaaaatttaaggataaataacattgaagcttctgtttcactgcagaaaatttttggagaatatacagagagtacagcatttgaaagaccacttactagtggtgttgcttatgctttgaaagttctccactctgataggatgcgttttgagaagcagcatgggtggacaattaagaaaatggaaactgagaatgaggcattagtacaagattgtattccagaaaatttggatccagcacctattcaagatgaatatgcaccggtgatatttgctcaagaaacagtttcccatattgtatctattgacatgatgtcagggaaggtgtgtcttgcttagcttgctgtcaccctaacatgatttactttttctaagcaaattgtggggcaatggcttaaactgcaaattttacattcctgttaatgttcgtaccatatttattctgcacaagtatgtatgagaaaactagagtgtgaagtcatcagttagaaagacttttttgtctgtattttctttatgcaaggtttaggtcgaagcattagatgcttggagcttttgtatacatgaagtggaatattagaactggagatcactaaacagtatcttatataatttactttgaacagtgaaagtcaaatgtggggtaaacagaatcaactacatacaagagttttacttatcaacatcaataaaatgactctgagcactggtatcacatgcttttcatgcctaatcagttgatttacattcatctcagtgacagattaagaagaaataagactaggagttactattgtctattgaattatttattagattcctcattatctgtctggttaacagaaaatattttgttgcattgttacacaggaggaccgtgagaatattttgagagcaagggcgtctggaaagggggttctgacatccccttttaaactactaaagtccaatcatctgggtgttgtacttacatttgctgtctataacactaatcttcctttagatgctacactggagcagcgtatcaaagctactgtggggtaatcctacatctaattgtctactggttaaaatatgcatttcatttgtgctctgatccaccacccctaaaaggaaaacaattacagtgttatgtgagtattgttacctatttattggcaggtatctgggtgcgtcttatgatgttccatcactggtggacaagcttctacaccaacttgccagtaaacaaaccattgttgtaaatgtttatgacacaactaatgcatctgcaccaatcacaatgtatggtactgatgttgctgacactggcctactatacataagcagcctagattttggggatccgctacgcaaacatgagatgcactgcaggtttgctttcacactttaaaaaaattgtgttgtgtccaaagaattgaaatctcataccagcacaattccttcttttccttttcttttgcaggttcaagcagaggcctccattaccttggacagcaatcaatgcatcagtgggggtgtttgttattactttgcttctgggtcatattttttatgcagcaataaatagaatagcaaaagttgaggatgactatcgtcaaatgagagagctgaaagttcgtgctgaagctgcagatgtggcaaaatctcaggtgtgatatatttatgggatttaggctttctgttatgccttggcacaacagtaaagttgtgccttggtgacttgttgatcatgggttcgaattcggaaacagcctctttgcatatgcaagggtaaggctgcgtacaatatccctcccccttaccttcgcttagcgaggagtctctgggcaatggggtacgtagtttttttaggctttctgttatgccgcacaattgttagagtgatgtcaagaataatgtaattcttgtcacatttcatatgtatattgcatcacatgatgatcatctttcaacatcaaagttatttctgagttctgatggtttataatttcttttacttaattaaaattaatatttccaccttgacctccaaggattgctttcccttttttgcagtttcttgcgacagtttcacatgagatcaggactccaatgaatggtgttttaggtaattgaaagtatttgttgttttcatagataaacccaacctgtcaatactcagtaataattatcagctgtttcaaataattttccaggtatgctgcaaatgttaatggatactgagcttgatgaaaaccagatggactgtgcccaaaccgcccacaagagtggtaaagatcttatctcagtcataagcgaggttcttgatcaagctaagattgaggcaggaaagcttgaacttgaagctgtagcctttgatccacgagctattctggatgaaattttatcacttttctctgaaaaatctaatgaaaaagtaatagaggtgagatcgtatctttccgctaccttagttttgtacctcctataatttgtacattaagtcttacatgaacttgtgttctctatacttttttggtgagtccagctggctgtttatacatccaatcaagtacccaaagttgtcattggcgatcctaaacggttccggcaaataattactaatcttgttggcaattcacttaaggtttgcattatttcatgctgtattgttattttttgggtgggtttaacccattttattctttgcatatatcatgatgctggaaacatctcataattttaaacaatgcatcattttgtccttttgaaagtgtgtccctttactgattgatattgaaatggtgttaataagtaaattcattgataatcctggtgatattgttttttattcattatttctttacaatatcaccttatatatatactcactagtaagtgacccatgcaatgcaatgggcagacattgtaatactacataaacaatttgaaggatttatatgtttacctcccttctatttagactttgaaataatctttcgaatttttattttaaattagtgtattttcttatctttggaataaaaaagaaggaatcttattggttatttatattctctattaatcagtttacttggtgcatttcagttcactcatgataaagggcatgtatttgtctctgttcatctggcaaatgaagtgaagaacccacttcatattatggacgcagtgctgagagaaggcttaaacttgaaccagaacgtatcaaacagaacatatgatacgttaagtgggtttcctgtatgcaacagatggaaaagttgggcaaattttaagcagttaggtggcataaatgagcctgaaattattcaacttctagtaatagttgaggacacaggtataggaattcctacagatgcacaaagccgcatattcacaccttttatgcaggctgacagttccacctcccgaacatatggtggaactggaataggactgagcattagtaaacgtctagttgacctcatgggaggagaaattggatttgtaagtgagcctggaattggaagtactttttcctttaccggaactttcagaaaaggagaaagcacgtctctggatgcaatgcggcagaataatcattttggttcagagttccaaggattgagaacattagtggtagatagcagaaaaatccgagctgaggtcacaagatatcatctgcagagattgggaatgtctgtggatgtaacttacagtctgaattctgcatgctcttgtctatctaatgcatgtaacaagaggtaatttgtcacttgactcactttagcagttgaaattaaaaatccaaatcagttgacagttgcgcacaataaaccttaagaacttacctatttaagttctgtcattcttcaatagcatcagggcactacccagtatatttcatgtgtacaagtcatatactatgtaaaatgatttcagaatatagattatctgtatcacctgctttatgtggaatacaacaacaaagccttatcccactaggtgagagcggctacatggatcacacgagccagcctcacctagtgggataaggctttattgttgttgtattccccataaagcaggtgatactgataatttatattctgaaatcattttacttagtaaacaacttgtacacatgaaatatatgttttttttttcagactgacccaatcctcaatgcatgcttttgtgtggatatgaattttgcgtgatcttgtgaaggcttgaactgcttggtgttctgtaggaaattcggttcctatattgttattaataagttgcattgttctttttttgctactggttgtttttaatcaatattggcaattgcttgtgttcaacagtagtaactttaaggtgcaattagtcatgaagtaaacatggtgttttatttctagtttatatttgttgatttttttataaaaaaaaaacttgtactggacaataggctattatttgctaaattactactactgtttttgttccttcagtatgtcgacccagttggccatgattcttatagacaaggatgcttgggataaagaatgtcatatcttatacacaatcaagaaacgtagacagaatggcatcaaaggggatccaatgaatttaccaaagatttttctcctggccacccaccttagctccaatgaacaggatgggctcaagtcagttggtattatagatgatatactgatgaagcctctttggcttagttctttgattcagtgttacagagtatcccttggcactgaaaacaagagagtaaataggaaaaaagtgtccaaactcgggaatttattaattgacaaacaaattttggttgttgatgataatgcagtgaacagaagagttgcaaaaggtgttctacagaaatatggggctaaagttactgctgtggagagtggcagggctgctctaaagatgcttaaactgccacataattttgatgcttgtttcatggatctccaaatgccagaaatggatgggtaacatatcttcttattcctattttttattttagttttagttttctcaattttgaatgcaaatggagacactgttctttcctataagaatagaaccaaggagcaatgactggtctagtaagtttattttgtaccagagaaaacacgtgaaaaacagtagataataattaaaggaactggtgccaaaagtcaggcccttacccttatttccttttgttaagaacctactacctagaatattttaaccacgactgatttttcccgggcctcatggccgtgttgttaaactgtaaaagtgtccactcaatcttatgtaaatagatataatgattaggcttttgccttgtaatttatttattttattagaatgtatgaaactatcttgtgattttttttttatcctctaggggggcgtttaacttgtgtaagaaatatcctcttgggggctcagttagtgtatataagaaactttataaattccccaatctgcatgctatcatgatatccttaggtgtgatcgatggccattttaacttgtgtaagaaataacagattactgagtgctttctagataggatctcacacctggaattctggatacatggctgagatataacttacaagtatttctcttcatcttaaatgatacagttttgaagcaacgaggcaaatccgttgtcttgagagtgaggtaaatgagaaaattgcgtgtgggcaagcatctgcagagatgtttggtagcatcccttattggcacattccaatacttgcaatgacagcagattcaactcagtcttccaatgaagagtgcataaagtgtggaatggatgactatgtgtcaaagccatttgaagaagagaagctctacatagcaatggcacgtttcttcaagtcagattcatagtgtggaagtttgaaatctttgataattagtgcagacagcctgctgacaagtgtggactgtgatgtgtagtatgatatcaattatcatcgaatgccatttgttggttttccattaaaagagctagcggatggattaattttggctaaattatgtccggatattgtaatggttggacatgccccagatgatgtgttcctaattgagactgcttgccagcatcaaagttatctattcagcatcatggatctcagctatggtcttgtttagtgttagtaagtaccatctttatcatcccaggatttttatattataagcgcatttcatacatatatatttattataattttaacaagtagaaatggatcattgaaatatacatgtgttacaattctaaatttcctttgtaattcaattatcttgagccattataggagtttaataagagtataagcctattcccgcattaataaattttgttcttatttttttcttcttttccaggatgctgatttcgagttcaagatattatcacttattgcaggacaggaggaggtcaacagaaggcataattgcgttttggtgtacataccccgtttttgttcctgcttcccatctcttattattctttgtaaatatttatatttggagctagtaggataagataaaaatcttatagtgtcgacatcattatttcattttttgggggccaagatggaaaggaatgacagatctttgaccctcataattttgtaagtaacatgtaaatcaaaattatttacatgataccagcagaatggcatatgtaacaatattttgtgacttgtaagattccaacttgtcactttgtaactttttttttccttaaatattgtcaagaccaaaaaatgttcaattcattaaagttgaatattgagctacaaggctacagattttggtaaatgagatacagtagaacatgaggaccactaacgaaccaagacttttttcccattgaaaaaggcaaaaaaagaagtggtggtaaaacagaagagtgtggggaaagggaaaataaggtagataaataatcattttgtaattgataaggaaaaaaaggtaaatcgtttgttgagttggaagaacgtctgacatcagagaaagttaagaatataagtcttttatgtgtgtttttctttccgtgattgtggagcacgtgacaaagtgtaaccgctgaaattagcagcgacgtcagaaataacaaataagcttttgctatgttacagctcagttctttctgtcaatgatggtatatgttattctcaagggagagccccaatttcaatgtgaccaaccctgcatgatccacttgcaagagaataacataaatttccttcttagccgttagaaagagacccataacttccttgcctttttgtttggctatgtatataagtaaccacattgcttatatctttggtatctattttataaactctttagtctttatcaatcagcaaagcctctcttatctttttctccaaaaatggcaacattcatgctgaagttggtgcttcctctacttttcctgttcatgattcctccgaaaacaggtaatcgaaatgtgcttcctctactccataaatgaaaacattgaaatgttcctagttacttcttttctccctctattgtttttaattggccttttccccattagggggtatttttttattttttatttttcatttatcaaatgggggcagtatttaaaaaaattaccatttgggagtaagtcgtgtcacgtggttaaaaattagtcgctaaaaatttagtcgctatttcagtcgctaatactttttgcgatagaatattgttttatgcgactacaatattttatcgcaatttttagcgaccaatttttattttaaataaaaaagagtcgtgaaaataaataaaaaaacccaaatggtaatttttttaaatgctaccccatttagtaaataaataaaaaaaatatccccattgaggaaaaaaacctttttgatttcattatcatatttaccgtttgattaaatagttaatctaataagattctggattaaaattggacttgttatgagattataataatgagaataaagagcaatacatcattcaagttaaaattgattacatgatagattagatgttgtacatatatattcatcctcaacaaagtgttcatcttaaaaactacaattcatgcagcgtatgcggagtttgagcaatggtgtgtagctgatgagcagaccacggagtctgagttgcaggcagccttggattgggcttgtgggaaagggggtgcagattgtagcaaaattcaagtaaaccaaccatgctatttaccaaacacattgaaagaccatgcttcttatgccttcaacagctactatcagaagttcaagcacagtggaggttcttgccacttcagaggtgctgccataacaacagaagtggatcctagtaagtattaaatagattcctgataaccactcacttatttcctactttggtttaactaggacataatgcatgttcacatgacagagtcaattagtgcaatttaaatgaacctcatgcttgaaggttaatctgtcaagtatagattttacaaataaatccaaaatctttaaactacattcaaactacttcggtaagcgtgcgtgaaacagaaaaatttgaactgaattggcacgagtaatgttctcattctcactaaacaaattttagatcaatcaactgatgaacaattatactttataatctcataaatagtgtttctcatctcatattataacctgaagaaattattcttttacacttttttccttccatctccttttacgccactccgttctgcacaataaatggtctatgaaaatggttccacacacgagtcccttttcagttgtcagggattggaacaatcccgatttaaaattatttaagttttgcaccacagaaaagtgtatgaataatggtgatttataacctttttgcttaatgtttgtgcccaggtcatggttcttgtcactatgacttcattccctgatgacaaccgtgaatgaagacttaaaataactgcagcaaaaactagagctcgtgcctttgtgtgtttatgtgtcccaaactcccaatcaagcaatttttttggggcctttttcttgtattattgatagtgctgaaatcttacaattcacttgatctaggtcaaaggctggaaagtcataataaaatcttgtctagcaaactaacttgttatcttacaaaactaaattaagtttttcctacattaatgtacgtgtagctcaattgaactcagtttttaacaaggtattatgtgtttgtataagaggatttccacgtcaaatagagcaaaagacgtgaatcaagttgttttaaacgtgcatccaaacatgcaggtatacttgttccggaccaaacccgggaggctgcttgacttaagaaggcatgcattcatcttggaccaacattgcttgcccctctatacgatcccttggtgggcatcactactaaaaaaaattctaataaaattgtgaattatattcagaaaatttaacttgaaaaaggatatgattcttctacccatgttatgcacccaaagtacaaaatctctaattttttaggattattgattcttaacatagtatcattacacattaagtgatgacgagtttgatcacgtcactcttgttactattcaatgatactgatttttagtataaattatctctagctgcacttaacaaggactaatataaagtgattcatgatggaccacttttgttgtgattggtggaatattaattatttaacgagcagtcaagatgaaaaatatttgacctgttatagacggtggatattagaagttatgaatttagctggttcaacctttgaaaattaggtctttttgcagaccagtttgtttttaagtgtaaacataggttcggggcagagttatggaggaatgactaatgagcagaggcatcaaacatcctcgaaagactattttgtatataaattgtgattaaatgtaagtttgatgaactcttccaaccaagctgggccttggaccatttcattcatgaattgtaggagatctcctcaaattcaaacttgacaattagaccgtggtgatggaccttctcataattcaaaaggaatacgattgaaatatgacaatttgtgaatcaaggtagaaggatcgagttagttatcgagagttggattctagaattgaaagtttaatcagtgggaaaacaaaaactagggtagaagagagagaaaaatgttcatttttctaatgtaatggtctaaactatggccctcacatttgaaacaaatcacttttatatattgttaaagagtgagacagaaaagaagtttcctttttctaatgtgatggtctaaagaatggctcctcagatttgaaacagtgacactttaatatattgttaaagtgtgttaaggttgagtaatattgggccaaataccaagaagcccagtacgatcagcacaacgagatttatgacaaacttcaagggataattacctcctaaataattatccgaatcaagagaagatcatggataatatttgtatgaagaatattgataatatatggttcatcttttaaagattatgatcaagaattgcaagaatttcccttattttgcacaggtcagtgagaataaatagaagtatcaccaaaggtgtaagatacacacattctagctctttcttttccattctcacagtgcacacatcccacgtccaattgtggtttgggtactgtgatcgtctttctggagttgtttgatcttcataagcatcttcagagagagagagagagtttgatcatacatcaaatatctgacattgttgctgaacatctgtttttaaggaacagaacagagtgagactgaaaagaagattcatttttctattgtaatgatctaaactctggccctcacatttgaaacaattaactttaatatattactaaagcgtggatcaaagagtgtattggtaccgttggcacgaagttgttctatcttaagcacaacctgtccttgttttcatatattactctggctctcacattcaaatcattacaatagaaaacttgtcataataatctaaaattgtttatatttgaaaattgttttttagttgattaataattaaaatcattaaccttaatttgtttatcagtattaaccttagttcatgagcaaagcatttatatccaagaggaagtgaatagaaagaattctttgctgttctataaagtgagtgtcattctcattttaattgagaaatgtttacctgttttttagagaagaaatttttacctaaatctgttatattttcagaaacatttatgtctttaaatagtaagtctaatctaaatttacgtataaaaatggatggattacaaatttaactctttttagtttgtttttttactccataaattttactctttaagaatcataaaaataaaaataaaaaaaggtaaatgggcctcaatatgcagaagtacagcccatgaataggtaaatgggcttacaagtattatttattcctttggattttggagaactttgatcagtggagttaagctttaaaaagtacttatttggaaaggtttgttaacctgatcaaaaaggaaatcatgctttgttgacaattcttttaatatacttaacagagtttggttgtaacgaaaaatgggttagttttagctgaatttatttttgaaaatgcctttacttaactactattttgagttcgagggttagtgagtgtttaaatatcatttgggttcaactaaacccggtcaacgctaattcaacacagaccttgctaaattgcttctgtgtttatgccgtggaaagtgcaaaacttccgtaacgtggatcaaatgggttttcaaacacacccttaatcgtttaactgcatcagtagaaatatttagtaaaaaataccttaagtatattgaagttaaaataatgattttgtaaacattaacctttaaaattgatgctaagaaaataaatttgaaaagtttttattgaaaaacatttattatattagaaatgtaaaaatcattttacattgtaattaataaagtacatttagagctgatatcaacaaaactatttactcaaataaaaaatttcccctcaaaacaaatatacactaagagtgattattagatttagaatttattatatatgtaatagttcttatttctccaaaatcttcacctccttttctctcgtacttttttgtctttccatatttctctactaacatttaattatttatgattcctaatttttcatcataattgtctattcttattaaactactttgaatgattgttttggactctttaacttctttttctaacttacaaaaaaactctttgttattcatgctcattaatgccaacacatttagctaaatgagtactcataatcattcaacttctttaatgttattatttttttcgtctcaccttatttcatcaattcaattttcttcaacctcttaattgattcttcaattttcattatgcattcaatgaatttttttttttcacattataccttcctttttccatttgatgctttgttttcttcccaacacccttaattatcaactcatttcatttctttctatcattgtgttatgctctagtgagttttcttcacctacatcccatggaggtactagccattttttcttcatccccttcctttcttcaattaaattctctgtagcatttttttgcctctttcaaataagctaactacatcggcttccacaagattgtcacatcgccaactgcatctcaatccaacattgtagggcatgcttcaacattaggggtaataagacgaggtacaaaccacaagcaataagagggagcatgttggaatatgagaaacaaaagacacttatacatttttcagttctttttttaagttatttttatcatttaaaatgttctatatttcactaagtcattattttttgtgacaatttgaatttgagattcaggcatttaagcatatcaaattgaagtcaggcaacacatcttttcttcatttatgtatcgtttcttggattttttattctacctcctttgttttattaatcttcatattatcttttaatttatttgtagtttttgcctctcggcatctatcaaattgcattatcaaaagctactcaagttattcaattatgcgattttgaaggccaaaatggatttttaaattcaagccatctaaattctgatgttccctttgaccccaacatcaaaatgcttgattatgttttttcctgatattccctttaatcaaaattcaaggttaattttttatttttcgatatatttttaagttttacgagatgcaatgagtagtgatgcaggtttcatgagccagttttagtaacaaacaacaaatgtagttcacaaaattgagttacattaagaattggagagctttggatgcaatgaacttataattctaaaacatcctacaagtgcatgcgaagatattggttgcggtatgtgtgagtataaagtgagaaaaatatgtatttaatattttatgtattttgggggtattttttgatggatttggtaataacaatggttggaaaataaaaaaatttggtatgttgtttgaggcaagtatgtatatacacaatttgtgtttttttagtttttttataaaatataatattgtgactgtgttcatatttaaatttcatttaatgatgtatcatattacatatttaattgttattgtaaaataaatattaaacaaaattaattcatgcatgacaagggtcacctaactagttaaatacaaaactgtttccgaacaacacatgcatagaacataaaatgtctcttatgtaatttatttacaacataattttttcgctctctacttatctttattggttgatattgattcgtattacttactctttgcaaatagtcgttcatgccaataatactattactaaacatataatcaaaattacgtggccactcggaataattatttagttcttcattgtaattatcataccaaactagtccttaactaaattttatttttctctcttagaatcatcatgccatgccatgtaagttaggtttttcatcctatattactcaaagaacttaatccctttgttgcctcaaaaataggaaaagcatgtatatatatatatatgacactattattcctttgtaatattttctctcttatatttctggaattttcatggtttcttcaatactcaaggaaccaaactgagaagccctgcaataagagtcaaccagaatataatttgaggggcaaagctttctacggtctctgtttagaatttggaattagaattaacaggatggttcctcgaaagtcaaagtccttggttgactctgcatttgaataaattaaataaagccaacattctgattaagacatcagacaaattacaaaaccaaaaccaaaaccaaaagtatacattaattgaggagtaatcctagcccaggaatcttaccaaaagcatgtcttaattatggagttattcgattcgagtcaggagtcaaaacacactattctttgtaaaattataaatttccttattcaaaactaattcttcacattgtaaacttattagtatttctgttgatcaaacgtattcgatccttgaaaattgagtagggaatataaggtgatgatattgacccaaaaaatggtttggtttgccagttaaaatttggtactatgcttgacaagtgcgcaattcatttcgtccagtccaatatttcaacttgaaattcccaaatatttagaactttaaaggaaagaaagagaccttgtcaaacaaattcttttagtctagtgtgttggaatgccctcatcaaataactgactctgacttgctgtttgacgatttatatatggtaattggtaatgaaacttcaattctagaaaaatgacttattatcaacaaagaacgtgtcaagaaggtagccaaaaagtttagagaaaatataggttggctaacgtaaattataattaagtatcaagtacttgcttacctggtccctctgaaattgggtttaaacgtgtcatttgcttttcggctaatatgcttttcgtaggagctagtgtctttattctttactgctacacaaaagagagaagatggataatcaatataaaaaaatagacaatttgatatttgatatatgtataactcgtgcacacaccctcgcatgccttagcattaagcaacttgtaaatttaaaaatatttatttggagtgatggatttggatgattttgaaattgagaaaggaaaaggctaacccaaaatcagatttggaacatacacacatgcaaactcctccactacacacatcccaattggaatttgccgcgtcaggaacaaataaaaatgtccgagtaaagaatatgttccaaattaaagatgggcacatgtggtaagagggacccatatgttggccaaaatgcatggcagaacatgttgataaacaatgtaaaccctttaaaatttacaaaatctgcaactttggtaattgattggataagaataggacaaattctgcagatgaaaaaggacagaacattaaggtaatgtatctcccaaaaggccttacatgggcggtgccatgacagcaaaactgaatacaaaagtcaagcgctctcattatggctttttggttttgaaacacactcctgaaacttggtaaaatttcagaaatgtaattggaccgagtttaagcctagccccacatagcagctaccgtgagtgtgtgtattaaacattggtcactctatatgagttcagcttcattttaggaatttggaaacgggggacaaatatttatcagcaaggcctacattttgtcttttaagtatgcaatttacaagactctgcatcctaaagtactacaatcggcatgccaaggtcgagggacaaccttttgctatttgatcaagattttctgacaacaacttgaatgtctagagcccctcttgattttgataagcttatgcagtttggttaatcattaaagtttgatcttcaaagttttactgttactgttaggttttaaactagcttcaaacttgcatatcatatattatttttgtttagttaagcataactgggaaatgaattagttaaaaaaaaatatgatgtgatataattgatagataattatgtctcttaaatatatagttaggagttgatctctagatatgtatgtttataaaacaacatttgtttatacattaaaatcaatctcttaaataaattttaatacatcaagagattaatctttaatttttaattgaaatattctaattttttttttaaaaagtcaaaactgaaatttactctaaacctcccatttatatgaatgaattgaattgatcaattattgaaaactgctacgtggagaatttttatggacttaagaaaagggattatttaatttctaatatgtcacatgcctaataaaatgaactccactttatcattaggtctgattgtcttttaacttaggcatgactcgcactaaaaggacattaattagcagagagatttcactcattattggttagagtgtgtagaatatatatggaagaaaaaaaaactttgcttcagtgttgtttgcactgttttttttattagaattgaagttttatctcaataatttacataattttttaatacaaacttttttaacacaaattagtaaggtggaactctaattctaattagcaaataatacaaacagtatttatagaattatatataagttttgtacaacataattctcaaagaaagctcgaatactctcattcgctatcctgtaggttgtagtatgttgcgtactcggcaagtgcaccggtcgctcaagtaataaagtgataagaaaggggatttgtcgttcccaacgaggattgtttggtcaattaaatcataaatcttagctcaaggttggatgacaaaagggtatttgagagagatgttgttggacaaagtaaattaaaagctaaagataaacataaaggatatatatacaagatggataatgggtgtaccaaacgcaacctaaggtaactagggactcacacttaacattcctagcattcttcatggattaattgcaacattcatttacactacctatttagctagtgtgttttcttctattgactaagcttggatccctcgccacttagttctttaactcacactccaatcctaatcccttagtgattttcggtaagttaagcattaggcaaacacacaaatgaacccaagccacgagcacccatccctattcctaggtgatgttagcaagtcaccacacttggttccaagactagagccccaacattcctattgtgaaccctagctctaaacactcaactagattgatcaagtctagagaagagaaggaaacattcaagcaaagtgtaatgaaatagcatagcattaatgaacattaaatacaacccaatccaaatggaagtcacattaaatgcttgccctaattacaaaaggaaactaaccaaacctagacaaggctggccttggtacaacaaaaagaagcatgaatggagatatacaagaaagaagaggaagggaagagggaagaaccctcttcccctcacacccaaaccctagctcaacttccaagccctcttttcttccttggtggtgattttcgtcctccagagctccctcttcagtgctgaggcttcattatttatagggtagcaagtgcaatctctattttgcccttattatgcagagttctgcgacctgtggcgctcctggcgcgagaacggcgctcctggcgccaacatacagagaaaatggcgctccaggcgccggctggagaaaacgtggcgctcctggcgccagcctggcgctgatggcgcaggttccagagacggtggcgctccaggcgccaccctggcgctgatggcgccacatgcaaaactagcctatgtacccccgatagtacataggcttgatttcttctctgcataattctctgctatttcacctgctaaacatcaatctagaccaaaatacctcattaaagcacataagttacattcataccaaaaggaagttatatatcatataaaatgatgcatttaacgatctaattaagcttggaaagcatcatgtgctaggcacatatcaaacaattcccagatttgaacattgctgtcctcagcaatgacaaagatcttgaacaagggatcaaggacagacattcaatcatcgcatcacagaaagaatcatagaatccaaaattactacacataactgagcttttgtattgaacttcaaccatgtttttcaatttcatcaaaccaaccaacttgaacacccttaccagataaaattcactcatcactcaagtgtctagggtgcaatcaagatcactctcaatctctacagccataacactgccataggcttgaccatattctcaatttcctaagaaaagacaacacatgcacacttgatcaaaaggactttcagggttgtaacttggcttgactaaagggtggatatatttggaaagtgactaagcaaatgttgagattgaaataacatcaacttttccattcattccgattttcattcatttcattccactacctctttttagcatttttttttcttttgcatttcccttttcatttttgctttgcctcctttttctttcatttcatttcagaccatcttttgatttttcttctttcatttctaacacttttcacctgaattcttttatttcatccacaaatcacatttgcattccaatctcaaccaaggtgaggttatgatagtggttttcatgtctttatcaggtttttgaacaattaggtcttaggctcaaaaggctagcaaaggatcattattttcaggaaaggctatttggctcaagcttaaaagaataaaattgcctttatcacatcatttatgcatgtatcatagagaaacagggcaagttctagagtgttaccactgtgagaactctctaaaaagaaaaattttctgtataggctcaattttctcacaggctatagtatcaagctaggtttgttgattcaatatcaaacatcacattcattccaacaatcactcagtcatgcaataattccagattccaatcattattcatgcaatgtaattctcaaatgttctaatcacaatttccctattctcaatcaagttttcactgattcagctttgtaaatctgggtcatgcttttatcaaaagtgtctaatatgtactcctacagtgtatgctaggaattagacagtaagttacttatccacaaaaagaatttctgacccaaaaagaatttcagacatccttagttctcaacatcattaattttctcaattaacgcatacccccaattcccagatttaaaatttgctgtccccagcaaataattaatgctaggtatgggaagaaacaaaaatggtaggcgttaattgagaacacaaaggtacaacggaacatcagtctattagttatcccaaaatatgtaccaaggttcaatgcaaatagaaacaaaaactgataaataaaacaaaagatacttctaaaatgcagaaaccaaaataaacctaaatgaaacactaggacagtaaataaaatgcaatagcaacattactcttcagccaaaaggcatctggtgctagtgggggctcaactcctttttcttctttcccttgtcaacttgcttgccctgaaagtcaaaaaccaaagtccaacataccatatgttcgacaaatctacacacaattcatggcctaatcagtggacaatgggaattcccagatttagaatagactatatcaaggtagaattgacttcaaggatgccttaacagttcatctaacattataaacattggaaacaagttggacaagtaaaaagacatcaaacaaaacaaagagtgaacacacagccacacagttaacacgtttgtgcatacgcaagccaatgctgtcattcccagatttagttgaaatcatattgtgaacaataagatgtacaagcattccatatgatatcaactattgaactacaaacaaggaaccaaaatgactgatgaacatgaaacttcaagttcaggataatggtcataaacatccaaggttaaacaacccaaattggtcacttacaccttcaacaaagaaatcctaaacttgaattcaacaaaaacttacaccagtattaaagcaagcaagacagattccttgattggagcacattgaggcaataagaatagaccatattagaatgtaatgcctagacatgtgctcaacaaaatagttctgagatgtcacagtgcaaagcaagtgtaaaattgatttccaacacaatttcacacaaaaacctctcaatagatgatattctatctaagcatatgaggccatctcagaatcacaagaagcattatcagagaacaacaacattgaactgccctaattctaaccaattcccagatttatccaagcaacattactatgcattgaaaactaacaaacataaataaaaacaacacaaagaaaataataacaaccataaacaagaacaaaaacaaaaacaaataagcacagatacgggacacaaagatatcctccatgagtccatcctcaagcccttatctgctccctattctctcagtagtatctagttcctcctcttgttcttcttctggtgacgatctggaactagatacctctacttccttcctttgtttcgctaattctgggtcctctaagcaaggattcacgggttagcggtacctcgcataaactctggaagcaggttagtaacaaaataaatccaaccttaaagataaaatattataatgaaattggctaaaacaatccccggcaacggcgccaaaaacttgttgcgtactcggcaagtgcaccggtcgctcaagtaataaagtgataagaaaggggatttgtcgttcccaacgaggattgtttggtcaattaaatcataaatcttagctcaaggttggatgacaaaagggtatttgagagagatgttgttggacaaagtaaattaaaagctaaagataaacataaaggatatatatacaagatggataatgggtgtaccaaacgcaacctaaggtaactagggactcacacttaacattcctagcattcttcatggattaattgcaacattcatttacactacctatttagctagtgtgttttcttctattgactaagcttggatccctcgccacttagttctttaactcacactccaatcctaatcccttagtgattttcggtaagttaagcattaggcaaacacacaaatgaacccaagccacgagcacccatccctattcctaggtgatgttagcaagtcaccacacttggttccaagactagagccccaacattcctattgtgaaccctagctctaaacactcaactagattgatcaagtctagagaagagaaggaaacattcaagcaaagtgtaatgaaatagcatagcattaatgaacattaaatacaacccaatccaaatggaagtcacattaaatgcttgccctaattacaaaaggaaactaaccaaacctagacaaggctggccttggtacaacaaaaagaagcatgaatggagatatacaagaaagaagaggaagggaagagggaagaaccctcttcccctcacacccaaaccctagctcaacttccaagccctcttttcttccttggtggtgattttcgtcctccagagctccctcttcagtgctgaggcttcattatttatagggtagcaagtgcaatctctattttgcccttattatgcagagttctgcgacctgtggcgctcctggcgcgagaacggcgctcctggcgccaacatacagagaaaatggcgctccaggcgccagaatggcgctccaggcgccggctggagaaaacgtggcgctcctggcgccagcctggcgctgatggcgccaggttccagagacggtggcgctccaggcgccaccctggcgctgatggcgccacatgcaaaactagcctatgtacccccgatagtacataggcttgatttcttctctgcataattctctgctatttcacctgctaaacatcaatctagaccaaaatacctcattaaagtacataagttacattcataccaaaaggaagttatatatcatataaaatgatgcatttaacgatctaattaagcttggaaagcatcatgtgctaggcacatatcatagtagaacgtgtgtgaaccgtttcttgtatgcatattgtataatatggacacacaagtatttttgctcctgccttaaccaacaccttcaatgttaagggctactattcgaccaacccatcttccttactttcacatctagctgaaaacaaataaattcaattatgataaataaatatactaaataagtagaaaatcgtgcatatgcaacagtattgcaagttcattctaagagttcaagttcattttagtgctttgggagtgggggacaaacgcagccctacattcccctatgtaaggcacgcaagttatagggtcttctagcctaaagtgctattctattgccacggccagatgcaagcattttgcccttttgattgagatatctaccaatttcttgtctccaactgctcatcattttgatatatgcacgttggcaaatgattagaggacagaacatggaattggtagtaataagattaaatcaaatcaattcaaaattaatttaagactcaaatttgataatatatttattgaattttctttatgactcaagttggacttatttgaaaattgaattcattatataaatgagttggatttgagtaatgtataattcaatttatttgatttataattttaaattgaatcgagttaattgatctaaattgaattattcacaaacttaaataaaatattatttaaattaacaaaaaggtttatattgaactcaaattaaattttaaaccaaattaatttttattaaaaagagactagctaaacttagttccattcatttcaactcatttttaacactaagtggtaaagttttttttttaccatatgataagattaatgatttataggtaaatgtttgtgcatgataatgtactaaaataaagaagttttaaaattttatgtaaatagaagaattgaacaatgaatgttggggatgagacattcaccagtaagcttaggttttgggtcttatttttgcaagctcaaacgtatcttcttattcttccagatattgtacagagacaacaatgtgaaagtcgtgggagaagaaaaacagatctcataacgatggctacacatgaagtgagcctgtggaaatagttgttgagatagaatcatagaactcatctcctaacgttcggacatgacaaataaataccatctagtcatgtggtagttgtcaagttttgttttgtccacgtctgagatgcgaagtaatatagaagaaactaatattacattggacaaaaaagtgaagagtaatggtaaattatactagtttggtatgagtcattgacttattaaaattaacatttggaattaattatgttggttctaatcttattatatcatactaaattcccaagactttatctcttattatcaaataattttagctcttcaacaatgaaaatgcagtcaaccatggtgaaatgtgtagaggggaaattactctgtttttatggacctgaaagggagtttcaattcgttgaagttaaaacatgccattgttagacgactttaatattttgattagatttatactactttatggatgaagtacattaaagaaggataacaaggatagatgtactgttttacttttgctctttttttaaccatagtattgtaactaacaaaattgagtcgttattgttgaaaaaaaattatcagtgctgaaatcaaattaaactattataaatattaagaaaacaacaaaggtattacaataacaagcaaacctttttttaaactcttgagttccaccacataaatattgaaacaaactattatatatggtgttctttcaaatttattatcaaataagggtaagaaacttagacttgaaggccgaaacatttgaaacaacagaccaacttcagaaagttgattgatggccctaagtccaggcgtaaagcaaagaacatccaaaactccatcctaacttcaaaaggccaatccaaaaattcagcaagaattacgtgatggcattttatataaaatgataactaagtttttttttttcttttctttttccttttcatcttttcattttttttttcttttcatttcttaatactcggatttatgccttttatatgaagtctcattcaaccctatattcacttaagctaatcgtaaaagaaaaacaaaacaaaaagcaacaaaaaataaaaacggtttggtatttgccccattttttttttggccaaattctagaattcccttagatttgtcaaaataaatttttacccacctttaaatttttttacatttcattaaaacttgattggttttcaagatttatctgaaatttaatcatgctttatcttttaagtttcaactcaattttttataaagcaattttcaactcaattgatattctatatacaccaaaaaaaaaaaaagaagaaaaaaaaactcaattgatattcaaatccttcggccaattcatctaagacagaagaattattttacatcaatcagtgacatgatatcaagatctaaatttggggaatcaaattagagtccaaacaatcgatgatggcgaaatggcttatgtcactttcatttcatctcgtgtcatttttcttgtccaactggaactcagatgcaaaccataaaagcaaataaaaaattatttgagagagattagagatcatcttcgcttgacctagaagctaaattaagtacatatgctccaccatatgtcaaataaataacattttgctctctatgtagatcttcgacaaaatcgctggcgcacaccagaataaacacaaaactccaaattagagcaattgacaaataaaggtttaattgcaggtaagggtgtgggccatgatgttcactcactttggactggacaaagtattaccaagattcccttttctttcttctttttttggtttagttctttggtacatttgattccccaaagcatatttaaagggtaaaactacttgctaaattacatcaatagactatttcatgttttggcaggggagctttataatttgtaagatcaatggacgcataataatttgacacttggtttcacgtaatatctgactataacaaagaaaaaacaaaaatccttcatgattttattcatttacggtttctagagaaagaattaggcatttttttccgttggtctttcagcatttcattaagaacatgatctaacaatatcataagagcacgcgtataaagtgatatatatatatttatatatatatgtgtatgtatgtatggtggaccttaataaataatagtagcacggccaagataggaatataaacagtcgtgagttgatctttgctttgtcttttatctttattttcttctaaaatagtcagtttattttaaatttgggatttgaaacaacgtggattcaaagtcagttatgcagattatttattaacaatcttccaaaaagttgatacatgttgtcctaagccctattattaatagtcagattatttatattcgtactagtgtgcattgggtacatgaatataaaatgaaaaaagcattcatgttgtattaaaaaatctattgtaaagatgcttcttataattaaatttgtacaaaccacaggaaaatctgaatttggcattataaaaaacaatttaaaaaatggctaaagcctaattatcaccgattatgaaaattcactttacctaccttaatgcagttatcgcccaatccttttcgcttttaataagttgaagacgcaattatgaaagatatcctccaggaatgtgcactcttcaataatttgagttagcagtaactttccataggctgcatcattataacttcaaattggattaggataagaagtagtgattattttaaagctttagagattctaattggatatttctgagataagttcaatggattatgaaagagaataagtgcaacaagcaaaatacatatataaataaatgtacagattttaaaaaataaataaattgcaattactaaatttgatagaaatggagatcatcaagtgcatgttagctgaagtgtaaggcactacttacatcattggtgccactgcctttattgtacggttctctctcttctaagttctaactcaaccgtgtggtgtgggtcatcatctaaatgctacctttttaatctcaacaattcactgatgacttatgtatactattgatcgatataatttgaaaataaaaagataatatggtcgttaaattacgaaaacgaccttaatttgctgacaccctctttatcttagttttctaatttagttggcacaagctaagataaaatatagaagcacctgaaataaaaagtgaatctaaccagattaatacatacatgcatgcacaagatccaacataattactacttatgaatgcaatagatttgtcacttctcaagatttaattgcagacaggtacctttgtataagtcaggttctgattatttggcacttctaaagtaaaaaagtgtctaaagtgataaagtaggagcgcatttactgtcgaatttttaattaaaaatacgttatgattacatggtattttaattttaatccagagtagataaattcttgttttctcactttatatagtttttcactttagaggagttaaattgatgatttttagaccgtttgttgtgtgtgaggtaagcaaaaagtaggaaacatttaattactatatataacataatctacaacgaagtggggtttcctgtgtcacactcagttacatatgttctttccgtataacctaggtctatatacctttgatcccttcgaagttagtgcagtttatatcagtttctcttgcatagatggtcacggatgatggttttccttagattaaaagtgtggacaccacaccaacctatattggttcggcttattattattattattctcattaaaatacttgtaacaatcactaagatatacacatttcattttcacaagaccaaataccatattgctcgatatctttttccagtgtgaaatgtgaatcctctctcaagacttcagatttcattcatctctagttcttattttcttgcttttgatgtgctaataatgccatcctccaaataactgaaatgggaaatttttatttcatgctactgcaatcccctgaattgcacttgcaaactgttgagtctccctttctttgagcaaactatggcaaagataaatatcctttaaatcttagtttctgttatttaattcgtgaggatctatcaccagtttcatgtcaaactatttctcagcttcaatttgaaagaattaaggaaaaatatcactcctggctttgattttcaaacaacttactgcaccactgtatttcatctaaacaattactcttaaattttctcaaatcagagataagtttggattttgctagtggtagaataaatggtatattgagcagtgacactcgaatttctatttaatgtatcaatggtttggggtcaaatgacaatggattttcctagtcgtgtattgtccacctatgaccaacagaaagaaaaatacactcgtttttcaaaactataacagaagctattataacacaaagtaccattttttgtagctaataataatagttaactacaatcgaccgataagatgagatgagcatgtcatttctctgatgtcgttgctcatacatgtcgtgcaagagatatcggtccagctaaaccaccctggatagtcattatcatttatcattattaattgtatattactaatatttgtctatgataattaaaccataatctatataattaattcttattatttgggggttgttacttcaaataacttaagtttgttggccgaggtttttttttttttttttttttatcattggttgacaaattaaattaaacttcactagcagtattcaataccgtattcagcaatgattttcacgatgtgaaataaatcaaatatataaataataattttaaaaaacgagagaaatgtttgagtgaacatataagtaatgaataacttgttaatcagttgtctaagtagtgaaaaggatttaatttggtttcattaaatgataaacgtttaatgattatgaacagtttaatactgcatttgatattaatttgatttgagttaaatgataaaatttactgatcattgaagtagaagcagcgttgcatttcggacaaaaaacaattcatgtatgcagatacaattatgcttctgtatgttgaaatgttgaatggttatgtctttagtcaccaaattggcatcaaagttggtaagtcattaatgcaaaccatataggaggtggtgtggtcatgaaatgaagtactgaactacggtttttgtagcagtaggtagttaaatttggatgtatgatactactcaattgtacacaagaagaagaaaaaattaaacatacaagtatttgttttttctacatattttcttttgaaaaagataggtattaaaggtccaagagaaaatgaatagataagtagatggactgaaaaggaaattgaagtgaagctgctcatgctaactcactcaaaacgggccacgtgtgattgtgaggcacatttgtaagagtggcattgatggcagtatttgaccaagcatactattaacaaggggtattcctgtcatttcaataaaaaagagttgtcaccgagcatcatcatattaacattaataacaccagccaatggtttctgtgtagtttctataataatggaagggcaatttctccttcattattttatatgcatatgccttagttttttctccattggaatagccttgtcttctacactcccccaagctctgagtttctaatcctctgtggttttccaacctcagaatttactcgaaacttggtaagaaactggttttatgttcaaaaacttctcaaactgaagccatttcattcatggcttcatattttccttgaaaatttgcttcagttttgatcttcattgatttacaagggtttctccaaacggtttggtgaagtaaaacatattctgttaatacttcttgcccgtgaactttttgagttctagtgttttagcatttctgcttatgatgtgaatttgcataaatgtcaaactttcctttgtactctttaattgtttcttaaccaacttctgcaatgagatgtgagctttgatttgatgtgcatttttctgtgaacctatctggttgttgcacaaattttgttttgatacacacacacacacacatatatatatatgtgtgtgtgtgtgagtactgtataaggggtggtttgattaaccttgtcttaactaggtgttgtcagctaacaacatctgtaacttcatcaaactcagaaagaaaaaaaataaaagcacttctccaattgctgttactgcttttgtggtttgtgaatctgttctgtctgacattcaagctttcttcttttcagctcagccaagtgaatttagttaatctagtagaattggaaattttcttaactgtgatttataaaaattatatttttcattagatttggttgagcctttttccgtatgcaaatgttaattctgcagttttttagaatgattaacttcattcaaatgaaaactaattcaatacaatatgtggggccatgtatagttctgcttgtctcatcttttgaattttttaatggaaattagatgttcatatttagataattccctttccctttctgaatatctattcccttctctttgttcaattccgagttatttttctttcttttttggtggagaaaaatcaataatctttagaattggtcgtttatgaagtttcttggaaattcttctaattgattccatcagttcttcattttttgtcataaaaaagaaaataggcagagagatgaattgtttgacttggtatgagagtcaagttgttgataatacacggtagaaggagaagaaaaaagtaaactaattttaacagtgcgctgaccctgaagagtgcctaatttctttaagacaaaaaagttgtccttatattctggttcctgtcaactgaatatttcagctattgctttctatctcttcaattcattggaagcaagttgaaagttgatgatatgataacactgatgacgttgtgatttttccacgcagacagcagattatgtcaaatatgtggtttataacctcccagaagagagaaccttgacaactcaggactatatctttgttgccatgagtatcaattagcagctttctctaggccactattgtccattgttctgcttcttcatataatctgctggaggagatcacttgaactactataacacagttgagaccaagtcaattctataatgcaggcatcagagcaacatagaagttcaagtatgtactatcaaccattacaacaaattgaagcatactgcttgccgcagtatcagactcgaaatcaacagctatactaccatgatggaggccatggtactcacttttcaactccaagttcttcagaactttactgcactttggagtcatcttctgtagctctttacaactccccttcaactgttagtttctcacccaacggcagccccatatcgcagcaagactctcagtcatatccacctgaccagtatcattcccctgagaatacctatggctctcctatgagtggctcctgcataactgatgatttaagcagcttcaacttcaagcacaagctcagagagttggaaagtgtaatgcttggccctgactctgataatcttgatagttatgacagtgccatcaacaatggaaacaacttcgttccacttgagatggacagttggagacaaacaatggtggcaatttctagcaaaaacctaaagctcatccttattgcatgtgccaaatccatttcagacaatgatttgctaatggcacaatggctgatggatgaattaaggcaggtggtgtcagtttctggtgatccggttcaacggttgggagcatacatgttggaaggacttgttgcccgattggccgcctctgggagttcaatatacaaatcattaagatgcaaagaaccagaaagtgctgaacttctctcctacatgcacatactgtatgaggtttgcccctacttcaagtttgggtatatgtctgcaaatggagccattgcagaagccatgaaagatgaagacagagttcacataattgatttccaaattggtcaaggaagccagtggataactttaattcaggcttttgcagctagacctagagggccaccccacatccggattacaggtattgatgattcaacatcggcttatgctcgcggcggtggactacacatagtgggacggaggttatcaaagcttgctgagcattttaaggtgccatttgaatttcatgctgcagctatctcaggttgtgatgttcaactacataaccttggagttcgaccaggggaagctctggctgtaaattttgcattcatgttacattacatgccggatgaaagtgtgagtactcagaatcacagggataggctgttgaggttggttaggagcctatcaccaaaggtggtgacacttgttgagcaagaatctaacacgaacactgctgcattctttccgcgtttccttgaaactctgaactattacacagcaatgtttgagtcaatagatgtgactcttcccagagagcataaagagagaatcaatgttgagcagcattgtttggcaagagacttggttaacatcatagcttgtgaaggggttgagagggtggaacgacacgaggtgcttggcaagtggaggtcaagatttgcaatggccggtttcactccttaccctttgagttcattggtgaatggtaccataaagaaattgcttgagaactacagttatagatatagacttgaagagagagatggagctctttatctgggttggatgaatagagatttggttgcttcttgcgcttggaaatgagaactgggcaatatgtgactcctcaatgttcgagggggaacaaaagcataacatgtccctcttctttttctgttccattactatgtagaagttaatgagaaaggtctcaacattaaatccaatctaattgtccattttctgtgtttcaagaatttcaattgaaattgtatgtagcatttttctttatcagcaatattaatctttcatttcaaaatcttttctggtccctgaatgtttggcttattagtggctggggaaagtgatttcctagaatattagtagagtggcttttcttagcaatggttccaacattgctgtccattcactttattagatgaaatagatagatattttactttaataaattactagtaatttactgaaagaaaagaaacacagctgtatcagattctttgaaatttatctttattctgtgggggaggagtaggcaatgggactagaattaacttggcacaatcactccttccattctgggtctgcgtactcgagggtttgtggcaatgggatcgtttcgttgctctggtggaccaacctgacagaacctttttttttttttttaattgaaaaatattaatttattgattttgttagaaatgcagttggcgtcttcgaaccccccacctcttcctcttcccttctttaaccatcgagtcaaccttatatctcctaaggaaaattcttgtgtccttctccataaaaaaatttcttcttacaggaaagtggtataccattgaaattaggatgtgacttgcatcatcggtggacctcaacatttgcatgtctcttggtgagcgaaggaagaaagaatttcttgcaatttgacatggtccaacgtgacttaaaaaggtggactttgacaaaataatagcagtgcctaataagataattgcgtaaaacagaaaagagattctaagctatccttatggttttagtacccaactcgtgacacaaaaaaatatagacgatttttcaggaaggtcttctctggtttacaagtctttctattatttttaattcaataaaaaaaaaggtaaaactccaaaaacaaataatgtctaagaagagaccctcgcactatctcccaaaagcatagactgcaccaagaatgagcataaacgtaatggatatggacccataaaattctcagcctccaaccttgacgccaattggttatcctgtttgcttggacaaagtatgagaggagtggctgtctaaatgaaccacctccaggctccaacccccagattttttttttttttttttttacccttggataaataataaattaccaatccaatatcctgttatatttagtcgagcatcgatcattacattaaagaatgaatctaaaccactgcaccaacaatcacacattttaacatatggaataacttttgctatactcaattactgcaattctgcaacgcattttgtaaatttacatggaagaaaggaagattaaagcattagtaggcacaaaacaagaattacatgcaaatagctgagtatgttcaacaatacattagaattttagatacatgtgtacgaaaatgtaaatcttatttaactcaaataataatggtatacaagttatgatatcctccaatgtagtattaattgtaatttgcatatttagtcaacctgcccaaagacaagcagagagctagaagaagagttgaaggttagagtcgaaataggaattataatcccacagtatatctgtaaagcctatgtcattgtcaaatatttatactcttctgtaactagggggccctttcaaaaatattgcaaatttagctttggaccggttctgcatcagctgcggattgcttgttaaattcactttctgtactaggagtatcatgaacggcaaccaccttaaggcaatccttacttccttctgatataggttttacctcacctttcagctgttcatttgatctacacagaactccagaacttgaatggcatataacgtcattgctgacagaatcgtctttagtagctgagttatccttttgttgttgctcacttaatttaatttcaggaccctcattagaaaggctgatcacacgaaactcaaccatatcaccagcctttgacttagtagtcgactcgccaattaggtcccctgtatcatcagtattaccctcagatttggttcctgccttgccattagtggccgttgtgcgagtatttgtagctgcattctgagtgacagtccgtccagggggaatttcatgatcatgctgtccctcataggtagttattacagtttttgaatcatgagaggccctttccacatgctttttgacagggcatccaggattcgagcatcgataataacttctggaagagtggagagaaaatgcagtcaaattaatttaaaacatttgtgaacactgtatccatgtaagcacagcatagaggggctgagagagcaaataaacatctaaaaaaagtgtaaccagtgggagaagaggcaacttgacaaatgtaaccagcagatgaagaagttgaagctagaccagaggaatcggtcattggcagatacccaatatagtgaatataccagttcagaacaaaagcattattgatacaattgccttgcttttttaaaatgctaaagaaacacaatacttctaataaaattgttcatctatgttcaaacatttgagagtttgggttgcatttcaatacctggttagaactgctaaatcattgttaaacccataaaaagtgtgacctagttgtgcggacttaagtattagccacagattataatcctacaaaacgtgcatgtgggatacactttgaaaatgatataaaaggaaatactataatcacttcctgttggtttcaagaaggcgaagaataactcaaacagatctttagactggaagctaatgaaattaatttatagtcacaactcacagggcttcaggctagctcttccaaggcagaatgatataatatggatcaatataaacacattctaacacacacaacaccagcagaaaataggactgcattttgaaatgaaaagttaacatgtaccttgggtttgtattccctttaactagcttctgcccatatttgcgccagcgatacccgtcatttaccagatcaacctcacttgaagtctgaacaacaacaacacgagattcccgagttgacatgtcaactctagtgacatcagcattactattgtctttcttcctgcttggtatcaatttggcagtaaaggttagctatcgcatatatatatcaacacaaattttaaaaaatagtgatataacgtacagccgctttgactcaggttccttgttatcatgaaccagattctttgccttagtcaattgtaaatgtgcagctttcaactcattaactggggaaactgttgcaggaggaaaggattgtaaaggcttgatctgttgaggcatacatccatgctcaacggatgctttgtcttcatgtatgatgtcaaaaaatacattaagatctttcctacagaggcatagaaacaaaagtacagacaaagtgtactgctcaccttccacattggctagagagggtttgtgaagtgcttgttcaacaacaggaagaacacactcaactgatactgtgtttaattgaggtctaggatgattatgctgaccgatacaaatggaatccgtgatatgtccattatttgactgctgcaattgtttttttgcctggcagtttggatgtgtacacttgtaatagctccttataaattcattccccttaacatgtttctgaccatattttcgccagttatagccatcttttgataccttttcacgtattatagagggacattcctgactggactgcgatcgaggcaattcatgcgaaagagtatcagggctctgcaaaggtttcccaagtggtaaagagcatgtgcttccttcttgatctgattccaaggcacaagcagtagcatatgaatccttcccttcatttttaactacaatagaaagaatacttgttgcttcctctggtttggacagatcatttttagtatcatgaccttgtgacaatgtcgtatcactatcaggactcactctctgctgcaattgatcagaagggatattttgatccgcacttttgtctgtagaaaccatgtgaacctttttctaatatatcagaaggaaacaggtctagtttcattaactgcttccatgaatggcttgaaccttgaacaagcaatgcgtgcttgtggctgttcaaagctgacacgtttaaaaagcaattagcaaaacacaaatttcggtgccctgtgacagcaatatcatgaatatgaatagtgtgggtcgagaaaattttcttttcatacgtggttcctttattgaacttttagcagttttgttaatgtcaaccctgttctaaggaacaaaatgtggaaagtttatattggaataaaaaagtagttattgtaaaaactctctttctacttttagtcgctcaacagctgatcttaaaaaaacccaacttttattagtagaagccgcaagataaaactcactttaaacatgtgaaaccatttcagccatgatggaccaaatagaatatctacatacatattccgaatcggagtcttaacgcaatactatatacaaacagacacatgcataaagccatgttaattaattttcagatagaaaggagctcaaatctcaaacaaaaatcaatatccagctcctactttgagatcacttttaccatacagtacttaacgtcttaattactagttgaataatccaattaattacaaacacaacagttacagagatagcttattctttaatttgtatctgaaattagccgaaccaaatccagaggaaagagagagagggggaggatttcattgcttaggtctcaaaaaaaaaaaatgctattccaccttctgtggaagcatccccaaacccccacaacagttcatacctcggttagaaagaaaaaaagacccccacagattttagtatatgaagattaaaataaggggagaatttaaaaaaaaagaagaagaagaagaagaagaagaagaagaaggaagaattgaagtaggcgaaattgaatggaatatataaaaggagaaagatagcacgtgggaagcattacttacccggaattgagacctcaaaattggtgaagaggaagtgcgagttgagtaaacaaaacaagtgagggtattttggttgtgttgcagaagatgtcgtctatgttgtgggtttgggtggaaggaagcaatgggagagagtccaatgtaacatcctcatttatttgacccaaaaatcaaggcaaaggggaacaaaagtcctctctctctcctcagtttattattaattttaaagtgacacgctgacacaaacacacacaaaatatgcctttctgtgctttcatttcatttgtcaagtcttcgttcggtggttcttattttttctctcctaaaccacaatttggatttgggcctccctttttttttctcactctgagctacattcaccattgggcttatcatatcatataaaaatatactctttttttttatttgacctacacaattaatttttttttcttaatgtaacttttaatttattatgtttcacaattatttcattttgatatattaagttttaaaattttcatcatgattttttatgttttcaaaatgtaaagctccttcaccaaattggagtatagaatcatcccaaaaaatcttggtcaaagcatgcatatgccaaacctgaatacctcccgaaaataactggcaaaaaaaaaaaaacacctagtaaagaaactcaatcttgagtgaaataaataatgcggctttgaactttaccaacaaaatcatcgaaaccttagtattatgttaacttttaaattttaaaaatgaacataatgatacatttcgaaaacataaaagatcaaaatgaaaattttaaaacttaatatatcaaagcaaaataactgtgaaacataatagatcaaaagaaatattaaatcttttaaaataattgattttatactgtgacggctaaagattgtcactatctttattttattttaaaaaataaataactaaaaaattacctaaaatattaattatataaagaaacgtgtatttaggaaaaaaaataaaattttatataaaaacttacttttattgtgaagataaaaaagataaatacttatttataaaacgaaaaaacacggtttgggataaaatctgttccatgttccaatctcgctttgttttcgtgttgaacctgaaagagaatcttctccccatcaaaccctaaccctaacttacagatttgagttttgatcacacaaattcaatcaatcaatctttctcttcaccctgagaaaatgcttcaatctccagggcactcgccgctccacatctcgtcgccgtccccttcaatttcccaggtatcggcgcaaaaccctaacgatccaccatcatcatcgtgtgcgaagcaccctgcggtgctggacgaggacacgtacgttgaggcgttggagaagatcatcgagcgcgactacttccccgacatctccaagctccgcgaccgcctcgactggctcgaagccatcaaaaccggcgaccctgttgtcattcgcgaggcccaattgaagatcctcgaacgccgcgccggcacagcaaaggtaaccaatcccaatgatacttctagaacaacctcccacacacccggttccacattcgttagaaatttcacacctctcgatgagttcgacggaaaaccctctcaaagcccccgtgccccggttctcgaggctaaagagggggagaataacgatggtggggctgatacttcgcttggcctcgatcaatttatgaggaggtacacgagtgaggacaatcatagtttttcgaagattctagagaaagtgaataagaagaggaaagagaggtttgggtatttgaatgaggatgtgcagggtattgaggatgtgaagagggataggattactgatggttatggaacctcttatcagcctccgagtacccttcaagggtggaattacactgccaagaatttgttaatgtatcatcctgctgatcggggtgaggtccctttgaccgaggaggaaagagcgaatagaattaaagccgccacgaaggagatcaatcgcgggaacactaggtttcatggtaaaatgatggattctaggccaaaagatgatggaactgttgaggtgctttatgcgccagttgctggcactacgccggcgcctatgtctcttagagaaggggataagttaaagaagtatgatttggatgatttgaggaagactccaaatccgttttatttagaatctgggaagaaagctgagaatggttatagctttgttaagacaccgtcccctgctccaggtgttgatgaatccccgtttattacttggggagaaattgaggggactccgctgaggttggatctggaagatacgccacttgatattggtggtagtgctgatggtcctcattataagattccttctgcaccggcaagagattcaaaggcacattctctttctagggaggctgcacgcaagataagggagaggtcaaaaatgtttcataagcccccgttggcatcaccggttagaggggggagtgccagtccaagcatgcgtacactgtctcctgcagctcagaagtttgtgaggaatgcgtttgccaagtcctcatcttctgttgatgaaacacttcgggcaagttaccgtggttctactcctgctttggctactcctagaagtgttagtaggagtgtgtcaaggtttggtcgtgatgggagcttggcttccaggtctccatctgttagagagggctccaatcctcccttgtgatatgttgtaacatattttgaaaccatgatatgctgtatgtctccccctcccccttgatgatgtattaaagttgcaccgccatataaatttggagagaaaaaaaatctgggaataataataaacttgtgcttgctgaattttgtaacctcaacttagattgttaattcttgtagttttagccttgctcagcgattactggttgtctatgtacaaaatcttcttgatagaagttcttcagtcaattcctctatgccaaaggcattgttgtatattggattaactacgaagttactatctcacttttctgcctatttgagagattttttatgcgtctatgtgataggttttgttcttattgaatagtttcttcacgtttcttttttgcataaaaaaagtaggttctttctggtttcaccatacattttgcagttgccattcatgtagccaaatctcacatgaatctgagtgaatggcagtttgatgcttatttttatggtatggccttttagagtaattatcagataaaggttatagtcgtgcaagaattgagcctgcatgtgatgtatgtacattgtacagatcccttttcagttcttcaattgcatttacttgctccaaataaaataaacgattaatagtacaaagggaaggctgtttccatagtagggggaagacgtcctagattaggggtgttttacaatggtgaagggacaagtttgtttggtaaagaaacccatgggagccattgattctgagagaggcctgaggtgtgttccactgaaccagtcagtaacttggtcgtggtcattgttgctgaaaagatagtccccattggtttatccttatatgtagtttgcgggattgtggttgtagtcttccaaaagcattaaactttaaacacaccatgagagactcgcaagacattcactggggattacttgtggtaacatggaccagaaacagaacaagagtttcaatgaatctaaatatttcgaattgaagcatttgcctattagacatgtcgtcatcagcaagttgctgtagcttgtcaaatacgttgatgtacatctttgtcaattgatccctgataaatcatattagagccatataatagcagcgccggcaggggtatgccagaatcaacaatgaaacgataatgacgtaataatcatattcacaccaatttttaatttttgctaaaggctacaccaatagttacagtacgcataggactaatggtatttgcgagcagtttatttgaaagtatcatgaaaaaggtggtgttgttgaaaggcctacggtgtattccattgacaaatcaattactcgtttgtggttattgttgccgaaaagataagctctattgatcaactcatctgagttgcttgtttatttttacgttgtttgtgggtgcgtagtctttcaaaagtattaacaagcacgccctgataaactcacaagactacaatgttgcactataataaaaaggagaagaatttcaatagatctaaacgtttcagattaaagcatttgacaattagacatgtcgtcatcaaggtgatatagctgttgaatagattgatgcaattttcatgtcaattgaccccccccccccccccccccccccaaaaaaaatatagccttttattagagccataacgtacaggtaccgcgtgccataactcatgcatgaagagacaacgaaaataacgtaactgaagcagcttttgaataattgaaaaaacagaatcgctgaagattacaccagtagtttttgtacactttgcatagggaaaatggtatttaattggaagtatcatgattaaggggtggggttgttgaagaaaatattggaaaattcagatttcagataatacagtaagagagactgttggtaatggtggttgagcatgggtacgggctttgcctgaaacttaaatgttttgccattcttcccgtgaacgtaacaaacaagttcagaatccagatccaatgatttccattacattacgattttgcgtcatggcaaggatctcaaatgtattactacaaagtgttgaattgtgtaatttaaatttcaaattattattaagatttgttaggttgttatagtttttttattattatatttaaataggaattaaaattagatcttattattccgtattattaggatgttgttgaattgctcttatatatgtaaaaacctcatgttgagggaaaatatatgaaagagagaagggagaaatgaatgaaatgaatgaagaattattattccaatatatgcatatctgatttttaacatggtatcagagccatggttccctccatgaatgagagtcatggtatcctccatgaaaaaaaatcatgatttcctccatgaaaaaaaatcatggtttccttcatgaatgagaatcatggtatcctccttatttgttcagagtctttcttcttcataatcccaaacgtacatctccttctatctttttatcttatcttcaatgtattccatttatactcaactatctatctcctccttaaccttcaccttttccgattcctttacaagttatgattattattatcatgaatttcatttttgccttgcataacctttgcgattttggttccattttgaatcattcttgtatccatttgaaggtcattaatgtgaagtcagttgcattgttttgaatcattcacaaacaaaccctgaagtctattgacatgaacatgtgattgtttcgtccatgcacgtattccatttgaaagtcattgatgtgaaactcgttgcattgttctgaatccttcactgaccatccctgaagtctattgacatgaacatgttattgttctgaatctcttcctgtatctcaattttctttctacctcacataaccgaagcacattatggactatcttgaagcacttcttgaacctattgctgatcaaagtcattccttaaagagtgtttgaagaagcaattgacaagttgggcatgaccgatattcatgcaccaacttgaggggagtgttgaattgtattatttaaatttcaagttattattagaatttgttaggttgttacattttttattattatatttaaatagaaattaagattatatcagtttgttattattctgtattattaggatgttgttgaattactcttatatatataagaacctcatgttgagggaaaatatatcaaagaaagaaggaaggaatgaataaaatgaatgaagaattattatttcaatttatgtaaaagttaaaaactaaaaaaagtaaacggaaaaggagattgtgtgtgtacctcaacatttgccatctcattcaacaactcaatctcccttcccttgcttatttattctctacacttccgcgtagggtctcaaatatttgaggtctcagattcccaatctccgttcgccacctgttaaggtaataagcttttcttcttacgcatagattttcactattgtacttgctgcttcatgcacaatcatatcagaaattggacaaaaaaaatactacaagttaagatcattgatgtgataatgaaccgacacagagcgaaaaagtagggttatagaaaattattgaacgagtaatcagtaatatattaattcagtttcataaattccttttcagttagtttagttaagcagttagttgttagcgaggtaatcgaattcaccaccttttcccttccttccttctccttttaccaccagagagagagagattgaaaatgcctgcagagaagtcgaacagttgcgatagcgaagtggaagcgttcgtggaggttgatccaacggggaggttcgggcgttacagggatcttcttggttgcggagcagtgaagaaggtatacagagcgtttgatcaggaggaaggaatcgaggtggcgtggaatcaggttcggctgaggaacttcagcgaagacactggtctcatcaatcgccttcactctgaagttgagttgctcagaaccctcagcaacaagtacatcatcgtctgttacagcgtgtggaaggacgaggagcgccacaatatcaatttcatcactgaggtctgcacctccgggaacctcagggattaccgcaagaagcaccgccacgtctccattaaggccttcaagaaatggtccaaacaggtccttaagggattggagtatcttcatacgcatgacccctgcatcattcacagggacctaaattgcagcaacatctttgtcaacggcaacattggccaggttaataattgctttgtttttattaattagtatttctcatgctattgatgattgatgaagaaacgaaaacacagtcatgccaacatatatatgcagttctcttctttttaagcaatgattaggtggttcaaagaaaatgcagttttgttacacgatgaattagcttatgcagttatgcataacctaaaaatcagttgttggagaagctaagagaagagagcttctacaaattacaaatttgcttatgcataagctatgttttgcattgctaggttgcattttgaaaacttaaggtgtatttagttactatttccaaaatttgtttttagttttcgaaaatggaattaaacaaggtcactcatatagttgatggagggtgatgcaagacaaaaagaaagtgtagaattgaagaagagtttgaaaaacatctcttaattatttctgctttctggtaatttggaaataattttcaaaatttggatgagaagtcgattactaaataatgtggaattgttttagaaaacagtttataaaaccaaaaaagtgaatggaaataaatagaaccttgatttttgaccttggcattttgtaggtgaaaattggtgatcttggattggctgcaatagtgggacgtaaccatgcagcacattcaatcttagggacaccagagtacatggcacccgaactgtacgaggaagattacactgagatggtggacatatactcttttggaatgtgtttgctggaaatggtaacaatggaaataccctacagtgaatgtgacggtgtggccgagatatacaaaaaggtcacgatgggaatcaagcctgaggccttgagcaaagtcacagatcctgaggtgaaggaattcattgagaagtgcatagcacagccaagggcaagaccttcagccacagatctccttgaggatcctttcttttatgaactcaacaatgatgaagaatcaacgccaatcaattgaataccttcattcacacgtattcagagttcattgtttgatccttatgtccaactactttttactccaagttccaagtatattcgtatcccacaggccacaactaattgttggtcagtacatgcatttcactccagtttcactatatcagtgatgtacataacttccgcagtggactgaacaatagatgacactgtttggagaaaatgccaatccacttgttttccagctgcttccctcatttatttctggcatattctgttttacttgcttcaacagtgaaaccgttaggacttgggagggcttccttaaaattggttgcatcatctcttaagctgaaaccaacaagcttaagattaactatcaaatttagatgcttatctctgcaactacattcttgtctgtccacctaaagtgagctttcaaaattagcccggcccaatgggttaggccgatgggctttttactttgaggttcagaaacaataaggtcaaattgacccgacccaatagaccaaacaggttagcatactatgttttttaagccccaaaactaaaaactaacatgtgataggatgaataagttttgtttttggtccgcgatattaggatgaataagttataatggatggtcgttctatagatatatataggttgatttaagattataggttaatgacagttttcttaattagcaagtaattcatggtttcattttcagttgaattttgagaagtgtattcatcttgaaaacatgtgagatttaatagaaaatatgacaagaaagaaaaactttcttaaatgcacaatttcatcatattttaataataatattgtttctatcttttatatacttttttaaaattaaactacgccatttaataggtgaaaaacttttctttaaatttacatagcaaactaatcaatcatgtcatattttctaatcatgtctagaatcacaatcatttattttgtcattttggatagaagtatttgttacttatatgtagcccatttttataaaataaaaaaaaaagtatattcgttttctataaccataataaacttatcaaaaatatatcatttttattcgttttctctagctcctgcttgctccttatttatcatttcctgaaatgaataaattctactttactcgttaaataaatcgagacattatttcctttgaactaagcagcagcaatactacatataaaataggctctacaaatttcaacgagtatttgatgaattaaataataaataaaaagcataaaaatatagaaagaaaagtaaaatcatactttttaataaattatttactgaaattaaaactcataaattaatgagtaaaagttattaaattataagcttttttctcacaatatcctttttcaaaagcaattatacttaagacatgatgaaaaattaaatgtagtcatttctcttaacgaggatttaaattttagtttgtcacattgtgaagaatgagttcattccgccaattccaagtcacatatgttggtattaaattagaagttaattaaactcatcatcacttcatttcattaattagttaaaaaatttcagataataatattgagtttttaaaaatattatatgatttttttatcagattatataatataacgtgttagtgatatttcttgtatgaaaatacactgaaataaaagtttttttcttacaaaaacttaaatcaaagtttgtattacattagttatgttctacaatcatattgctatgaattagaaaatatacgaacgctctttctttgtgtattcaacaactaataaatccatcttttcaaatagttgcattttgcttaggtatgtcaataaaaatccaacctatggatatctattcgactccgccatgagttttacgtgaaaaacccatattaattgggacccaggtagagttcggatttcccaaggaagtgggattaggaatgttacttatatttttataattattaatagtgtagttacatatttatatataattctataattatatattatatgtaattgttaattatataattatttcatattttatttttataattattaaaatatagaataattattttaatagttaaataaataatattataattataatactaattataataaaatttaaaattatacatttaattaaaatataatttaacttaaatatgtttatgttatttatttttattaaattatatatatatatatatattgaattgaaatgtaattaataatttaatttataatttatttaaagtatatgaacaaagaatttaaaaaaaatgtgagatggattttctataaatttttttgaacatgataaaatctagggaagaataggattgaatttcatttttcccctcatcttttataaactcaaaacgaacttgtcccgccttttgagggacaagaatgaaaataagcaaactcgcgtttgattgctgttatccctaattttgctataagtagatgaattgtttgaaattttcattttccaatgaaataagtgagctttaaaaagaaaaaagaaaaagtaaaaacaagagaagagaagacatatattagtaacctctacagtattcaaagcatgctttttttcttctttaaatttaaagatccctccattaaaaaacaaaaaattaagagaatttcgcagtgttgacattaagaagcacaaatctgctacaaagatttggcaacagcatcatattcgtattccttggtagtttactagctgcaaatgcaaatgataaagccttccttaggcggcgtgtcaatggttcactgtctaagagatgtatattactatattagaaaagaaaaatatcaaacgtatttttcttttataaaatcatcaaagcagttgtattaatggaaatcgatcgataccagaaataccaaacttacaaatagagagattattttatatttatatcaatgaggatataaatattatataaccaatataaaaaaaatataaatattatcaaacatatatctaaaaaatagagtgtataaacagaaagaagaaagaagagagataaaaaaaatggagaaaaatgtatcaaacgcatacaatagaaaaaaaataagtaagttatatttcgattaaaatttgtaagattaaatttgagttaaatttaagtttacagaaacaactcaagtcaagtcttagcttgttattacaaaacttaatttctaagcaaaattttaatgcaatcatatttttgaaactaatcaaacatattatgaaactgagttattcttcaaaagtaagcttagcacccaaaaataatttttgaaccgttaatcaaacatgctctaaagagacaagaagaaaaatgaaatgaaaatataacagaaaatacagtaaatgcatgaccataaatgctcacaaaaaaaaatgcgtgacggtaagtcggtaataaccctattagaaattccacatctgcatatgtattggcaacttcgataaatgattacttgaattctacgaatagaaaactaatagagctgcatcaaattcctgtggattttgtagccagcctcttgatgtaagactcaattataaaaaataaaaaagtcattacggtataaaaaacgtacagcataagaatcacacgtgcaaaaacgatatatatttttttaatagaaggttacgtatcgcaaaatccggaagccgaatgtcattaagaaattataataaaatgatgggtagcttctgcaaaaaatatatgtaaaatattggtgataaattatgttacagttagagtttaattactaaaatgtacgaaaagaaaactttgttagttattatgtttggcaaaaccatcttattagctaatttaaaattaaaatctagtttaaagctgaaaatttataaataaacttattgaattaaaagtatttgacaaaattaattataaaagtaattaataactaataatataaaaatgtatttatgtaacttttgtttttgtttaatttagagaacacaagattcccttcatttaactagaatcgtgagaggcatgtgatttctagtcttaggatggtaattaagaaacatctatgttaagacttttttttctgcgttataaaggattgaactttgactactttgattgattgtaactttcttttactaatttagttaactgtttattttttgtatgataattatgcataaggtaattcaaatatttctcgagtacaagaaaaatgttagaattaaaatatatcaattacaagtaaattattggtttgcactataaaaaccatgcaagcatcgccttgtatccccattttgtgtatgagctcatttatttttattctatctctttctcattttctctatctacgggtcactatctagttgcatttatatgcaaggatgagatagtaactaatctaaatcatcattttaacccaactaacaactttctaactaattctagctatatatatccaacaccctcccaagttggtagttgtttattaacttttacagcatgagataaataatacaaaccgaaataacgcagtaagaaggacggaagaaagaagagaggggagaatggtgagttcacctcaaatctgcaaagactttgttaaggagaatggatggttatagggttcaaagactttgttaaggagaggtataatagttatttgtcttcatatgataggttccaacacttgatgatcaaatatagtgttggtctgattgcaagcttttcggaagaggaagtcaaggcagcgatttgggactgtgaggggagcaaaagcctgggtcctgacggatttattttcaaattcgttaggcacttctgggatactcttaactcggacattatgagggtcatggcagaattctgtagatatggtcgcttttcagttggtggtaatgcgtcatttcttgcgctcatccccaaaaaggagactccacaaggtgtgggggattacagaccaatctctttgattgtctgcttatatataaagtggtggtgaaggataaacattcaacaaagctcttttgtgtaagtggtttggtcctggtccctatatggaatgggaaatccctatggaagaagaactgctgcagctattacaaatttggaaaccgaaaaggactggtctagatcactgggtgtggagagtattagtattaccctcggagggatattcgataaagggagcatatacactaattcaaaacttgatgattgatgaccactcaagtttttttaatgctttgtggaaggtaaaagcaccatcaaaggtgcttgtgtttaggtggcgtgtgacactagacaaaattcaatccaaggaagctttgttgagaaggaatataggtgtggctgaggaaggattgttatgtaaactgtgtaatgctgagactgaatctgcatttcatttgttttttcttactccttctcatacaaggtgtggcaaagctgttatggctggcttggcctacaacaagctctccctacaatctgtgttgcttacctttggagtcaccatgggctttgtagagggaatatggaccatttgtgctggatgggaatttggatgcctgttctatggtctatctggactcataggaatcatgtaatttttagagaggcagaaccgtgtatacaacaggtgctaagaagccacgagcatccttttcctttttttgaatggatttctaaccccttgctttgtctgaattcgatatcataattgttggtgctcattgtttccctgtcggtggagtcttgtgatgtatagaaactttcccttctataatggatgtataagggtctaggaagattgttaatttcgtgcatcatttttttaaaaaaaatttgtatctcgtacttatgtatctctttcgtgacttgcaataataaataatagtttaataaaattcacatttttcttaaaaaaacaatgtaggaattgagaagatgttgaactcatatataagcaaatacacaagtgaacaataatgacaactaaggaaagctcaactactaagtagaagtcacaatcattgtttaaccacataacaaatgcaaaccaatatatttaaccaaacaagtggaagataagtacattattaacccacttgacagaaacaatcaacatcttcaatcactgagagagagatattaaccattctaagtagaagtcgtatcgtatgtttaatcattgaacatgtatctgaaaaatgagaatgcacacatatatgtaaacgatcaagaatcatgaagaaaggctacaatggactttacaaattttagaattacatgtttactcaaatattctacaatataaatataaatttataaacacaacataaatcatgctattactaaataagataaaatccaaaaaaagaaattcaattttgcaacgcatcatgtacttttcaaagagtggggaaaagtaaaatattggatccaggggtccgtggttgaaaggaagcaaaacccaataaccaaagcaccccaatttgagtagccgtgccgtcttgggcgttaggcatacggcacataaaggaaccacaaaacttcacatgcacttcaccatcttcttttcctttgcaatattttaatcctatcatttcctcaattgcctatttatttcatttcatacccttgcatttcttttttcccaatacacccaaattgttcttttatgaaaacctaaaccaaatccaacgtaactttgtgtaaactgtttggtcccatcatttccccaaatgcctcatcagccatcaattaaggccctatacgttgacaaagacaatcgagactgaaagtttcagccgttggatacgttatactaaaagactaaaattattacaatgacactaattaagcaaataaacaaaaaaaaatagttaaaattgcaaaacacatatttttaaataattaaaaatatttaataaaatattaactaattttctagtataggttattgggtatcctatgttagtttaataatacaattgtagaactaagggggtctaatctcttaattaaataagatatatatgtaagtgttataaatctcctatactttatttgattttcaatgacaaaaaaaaaatatcattacaagtgtcaatattttttctttaaataatatttaatatagttacatatataaaactaaaatttatcaaactgaaatagtttcataccaattgattcatccactaagtattaactaattaatttgatggctggttaacataatactcatgaattttaggagtagggttttatggttgtacatacacaaacttaaagtgcgagattgagatgttaggatgcatgaaaagtcaccctattctattggccgaggccgccaagttgtagcccaagaattcaagtacccaacattcgagaacgtttttgaagccttaaagtttggagttcgagtttcactcgtgtgcatgttgactttgactactgcaaggtgaataatagtacaaatccagcaagaatatgttggggacaaactcctcaaatctcacttcaccacactacttttctttctttaacatcagaactctgctgctctagttaattccttaccagataaggattcagaatcatatgcattcgtttagtcacagttagaataagtagcatccattgtcagaagtagcactaacatggaggttgcgagtccaaaagattattctgttgcttctagtccttactcttcacctaacattggagccttgctcaagatcaaggtcatcacatggtaatatatacatgtcattgatcattcattccatttccacgtgtggttatatgtctgaagtttatctcatgcacttcgatattttgtcacaggagccaacaaacaggtttacctgtttctgtccgtgttcgagttaaagacaagatattcaacctgcataaagtaagtttagacacaattggaatccaagaatgtttcacatagcttaccagtaactaccttaattattgatttgcattttgtgtttattgcagtttcctttgacttcaaagagtggatacttcaagaagaggttaaacaatgcatctgaggttgagcttccggaaacattccctggaggaccagaaacctttgagatgattgccatgttcgtttatggatcctccacattgattgacccttttaacgttgtggcccttaggtgtgcagcagagtttcttgaaatgactgaagatcactgttcgggcaacctttgtgaacggtttgatctttatctgaatcaagttgtgttgcaaagttgggatgacacccttattgcacttcaaaggtgccagatgctgcttccttggtctgaagatctgttaatagtgagtcgctgcattgaatctcttgccttcatggcatgcatggaggtgcttgatccagaaagaaggagagacactcctgttgtgacagtggaagagttggcttccaaagattggagctgtgaaataatgaaggatgatgctgtgagccaagacctgtggatgagggatctgattgctctaccctttggctttttcaaaagggttatagggtctttgaggaaacaaggaatgaaggagaagtatgtgagtcccatcattgttttctatgcaaacaaatgggtgctctctaaaaagacgcgtcaattttgggagagttcctgtgacaagattggggagggtggcatgaatagcaaagcttctgtgattctacaaggtgttgttgatcttcttccagtgggtgataaggctaggaaagtgattccagtggggttttattttgccttgctttctagatctcttgagttggggttgaggactgaaagcaaggcaaagttacaagaccaaattacatcacttttgcacttttctcaagtggaggattttcttcttccagaaagtggagcagagttaatgtcctctagcatggagttggtgactatggaaagcataatttcagcatatgtagcatctagctcacgtgtaaaccataccccagaagctagcaattacagggttgcggagttgtgggatgcatatttattcaaaatagctgcagatccagatatgggaccaaagagatttatggaactcattgaaagggtaccaccatcttatagacagaatcattaccccctttacaaaacaatcaacagctttctcaaggtaagcaagcattcagcattcctcaaaagcttcttaaaaagtaggactcatcaattaaactacattagttgattacacatgctctcatgccaataatactatccgtttaggaactgaacactataatgaatgttcagcattctacctagtggtctaactgaataattaactagaatgatacaataatcatggtccttagaataagagaaataatgagtaaatactatttacaagcttagcaaaagttgatcatagctcatttcccaacttatgtcaaagaccaatcattaaaaaagaacaatacaatttcagctttaacatatttcgcttttttctttctttttatttatttattgtagacacattcaggtatttcccaagatgataagggagccgtgtgcaagtatctggactgtcaaaggttatcacaagaggcatgcattgaagctgttcaagacgaattgatgcctctacgtctaattgtccaagcactttttgttcaacaactcaatacacacaaagccttcaaagaatgctcagattcatttagatatgcacattgtggagacatgtcaggaagcctatcaagctctaggtatccatattctgcaagtcagaatctaggaaagagcccatccactgatggacctgagctcagtagcaggccattgagcttcctgctgcagaaagacaatgtgatgcagaatttcaagttctcaactacggaatatgagtcaacaagcttcagaatccaaaatcttgaacaagaactcatgtccttgaaaaaaagccttaaattgcacaacattgttacaaaagcagaaccaaatttgatcaaaagccagaagatgaagccgtgtggcttagaaactcgatcactgagcaaaaggagcaacccaattggacaagcgactagttgcatcagttctgtaaactttgcttcacaaagaaggtatgcaaacaggctactcaaggtctttcgccgcataactttgtctggaagtcggaaactgaagagaaaaccgggaactcctagtcaattgtccaagtaattgtagcataagaactttactattgatgtgtatgaatatggatacaaatagaaccacgtagagttggagactcaattctctttttccttttatcacatttcattgaaaataataagtaaacaggaaaagagggggtgagagaaagaaagaatgaaaaggaacaaaagaaagaaaatgttattggccatttaataggctaatatacttcattaacattcataacatatatgtccattaaaattatataaaggataaggttgtagatattgaacattgaagagctgacaaaaaagattggggttcagatggcttcaacttgtcatatttgagtacaaaacactattggtttaacttgacatgataggatcatgaagaaactctgctattatatatatatatatatatataactaggccatgtgaaattccacaaaacttgcagctccattgcatgatttgcatcttggacaatggcatagtgatggtggctgacattgacaggcatgcagacatcaacccactaatcagttttgtctgtctttttgtcttcctcaaagtaaagaaggcacatttgtaacataattcactactggctgtcaacttagttacagtatcaacaattggtgtgatgtgaagcactgaaccaaaagcttctcctgaatggtttaatcacccaccagtaagatgagcatttgtttactaagattcacagtgacttatctgcacagttcataaacaaagctaaattagcataactgaatagaaaacactagtagttagagtacaatgggtaaacattatagaaccataaatatcacttcattatgaaacggtgcattaattactgcattatagccaaaaagttaaaaacaccaaacttcattcatagtgtactttcagtaactcccatatttggcccaaccaatttattaatcccttttgagattttttttgttatataatattacccttaagtcggacctccttacccttaattatatagtcaatgctatctctctaacatgtcagtcgatggcaagggtaaccaatgatggacttgtaacttttggaagaatagttcctttctattgttccaccttgcaagcttcataattgaaccgaaaacacaggcatcaaacaaataaaggctacattctaggcattttttttaatgctgaatactttttgtgagttttctcgctttaaggtaatctcaatttctttttttgtttattagatattcttatattcttggtgtacgagacagattccttgtgatttacaggttaagtcctccttacaaatattataatctcaattggtggccaccgtttattttgatcactgcaacttattatcttttgaatctataggcgaaaaaaaaatccttatgacgtgtgaactgtgattagcatatatgaaatgaatatcatcttttcactctacaaaaatatcatccttttgtattacaagaaagtcaactagacaattgcaggggaacgttcgcactgcctttattgtccctttttttcttctttctcgaagctaaaatatacattgtttatgttttagattatattcagttggatcaattgtgtttcataatttcatggaagttaatttaacgagacaaattttaagtctccaattagttaaaaaaaattaaatcatgtcctaaaataaataaaaaataattatttaaaaaaaatcgtttaaactcattttaaaaacgtaaatgattacattaaactttttaaaaaataaataactaaattaaatattatagataacgtaaagaactaagagtatattatttagccttttctaaatgacaacagatttggcaatgcaaagcaaggaaatttaatgcatatatcttgtatctttgctagattttatcattgccatatttttttcacaagataactgaaaaacggctcaggtgagaatattataattatttttttgactgaatattataattatttgggaaatcaaaataatgaatatgtatcattaagtcttacctaaatggttaacgattaaataataaacaaatgtatccttttaaatgtcatgtaactattaacatttgaattattttatacaaattttttatcttaattgtttttgtatggtggtatgatcaatatttataattctcatacttttaatataaatgttgttctcattatatatatcccaaataatataatgaaaaaacgaggcaggtaaaacatattatttaaatcacttcattttctgttttaaaaaaatcaagtcatttttttttcaataggggaaaatatcattttattttgttttgagtaaaggataaattttattttatcttaaaaatctgtttcatttgggagggaacatattcggattaagttcctttttattatatagttcaaaaaacttttaatgtctccagctagcataagaaaatagtacttgtttgggttttcttaatttatgcctccctttttctttgttggtattttatgtctcactagtcacgttaataaaggaatgaaaaggaaagggggggaaaaaaaaaaagaggtaatggttattgaaaactggaaattgagaagaaataatgttaattattctacccaaattacttacaatatttttaaaatttaactagcattttaacttatacactgtactcaataaatatttaattttatataattaatttttcataagtgaacgtttaatataacaattatattttaaaattataatataaatttatttttagttattgaattttaaaacattaaaattgaatttaaaaaaaatattaaaattgattttatattcatctaataattaaaatatattgatagtataaaaaattgatattttatttaataataaattatcatgtacagtaagattattgagttatttttttttttttgtagtaaaaggaaaaaggagcacaaattattaaaaataaaaaactacatccttgtgaaagctactcccactaaatcagctaacaataacgtggtgatttctgatggaggaaaatcagaaatcgtgagacgatcttgagatagagctcccatttttgccaataattttataataattactttaataaatttatttagagtaattttaattgactaacaatatttttttttacatgatagtgtataaaaaataaatactaaaagtcaatattaaagttttttttattcgtaaaaatggaacaagcctcaaccaagatccattggtaatattaaaatgtgaatactaattatggaaatgaattttgaattttaattaagaattaatactaaaaacacttgagaaaagtgtacatgtgttttccttcatcctccacgtgacacaggatcgtgctccgacccaactctgttcaataatttaaatttaccaccgccatatcaatatctaccatttctgctgcatcgttatatatgtccatcccatcatctaccttcttcgagtttaaggttaccaacaacatttcactataatttttttttttttgcactattctcaaattatcaaactccactgttaattcgtttgatccttcaccacgttgtcgtagtcttttccaacatgcatgctgagcttgatgtatatgtaatttggataagactcttctcgttttaacattttttaaaatgagtaagagtgtgtttatatttaatttaattaatgtattatgcatttttcttaacatattaaatttaaataattaatacatatttaattattcattttacggaaaggagaagaaaaatgaatggattaaaaaagcaaaataaaaaaaatcatgttattgcatgataaaagcagaagatgaaaaggcatttcataaatatgcatgtttcttgtagtgaacagaaaattttaaatagcttgatcaaaactcgcttagcaagtacttcctaaaaagaatacttctatagatgtaatatttatattgctaaatgaaacacgatgacatgtcacttaatgagaacaagatgagaaataatgtgtctcttaacaaaacactttgacctaattctcacatggacttgccttggatgttgtatggtagttggaagctctctcatgactccttcatccatcttcttcatttcttactcatttttggctctacatgtgtctaagaggagctaaactcatccttgttggggttggatgtaactaagttgactcttatgtactatttataacttaatttgattttgcacttcaatattagttcttattccatgcttaaagctttgtatgatttgatcatttatattttgatgtttaatttcattcatattggaaaacactctttaaaccttgaactaaagttgaacacctaatgaaccttattgctaggaacaaggcatggtttattagtcatcttaagatcctgaatctcaaagcaagtaccttaattaagtcatctaaagtattaatgttttacaaggacaattaggctctttcacacaaggaatgcaggtttgagtgtacttatgaactgattcatggattgatgttaatttttgaagtgtaaaattgattaaatgttaatgagttccaggaagaaattaatttaacaataaacattttctccatatttgatatgtacattttctacactttatctattagataaaaattcaaaaaaatcttaatatttattatttatagtcttgtttgattatgtttagaacgattaaaatttccttcattccaaattaggggtaagcaacggttggtcacgattgggttcgggcagaaaatgcttaaaatgttgaaattcaaccacttcaaatgttgaaccgcaaccaaccatttggaccttcgaaatttgtcggattcaagtaacacggttgacggattacacgggtgggttatgtcagtttcaagagaggaggtaacgcgaagggaaatggaatgtcgaggaaacctatggttgttggtgtacactagaaaaagacttcatggtggttggtggatgcagggaagaaaccttgtggtggttggtggatgtgcgagatggtttttccacagcaccttgcttaagaatggtaagacttcacgaaaaaatggcatgaaaaccttcactgaaatttcaaaaaaaaaagaaggagaaagaaagaactatgaacaaagaaaaaagaaagagagttgagaagaagaaaggaaggtggagagaaagaactttgatcaaaaaagttacttgatatatttgaatgaataaacaaattaagcttaaaaagcatgattcaatatttttgctggtaccaatagaatattttttattgtgattgattgccaatgcaaacaatgaaagaaagaagaagaaaaatgattgattggagaaaataaaaatgaaaaaaaaatcatgttgtcgcaagataaaagtagaataaaataaaaatgtagtcaataataaaacaatagtaaaacaagaatccttattttctaggttacataaaaaagaatccttatattaaggacattagaattttctttaagctaataaatcatctttgatctaattagttacttaatacctttgaatgaataaaaaatttaagcttaaagaaataaagttacttatgatttaaatttggtctaaactaaaatatttgatataaaaatattatacaaaattttaattataaaaatattttatttaatattttattatacaatgcgacatttgacttactgattcaatattttgaccaatcttatttagataaatttatctataaagaataagtcaacatcatcaacatttacatcaacaacacctttaatccaaaataattggggtcggtagtagatgaactcactaatagatacgaggaggttgaaaaaaaggaaggaaaaaaaaaagagaagggaatcaatcttaaaagattctaaaaaggataagtaaatacaaaaatataaaatgaatgagacttaagataaaattatcttatgtatttaacttttatagagatcctctggtctaaatttttttaaaaataaagtatgtaagttgattgtagttgacaaaagaaattcaatccattttaccttgttttcatgttcatcaagaagtttatccaaaaagaacttagaactaatggcttaatcaaatttaatacatttcaacattagttaatatcaaacattttccatttttatgtttgacactcaatggcagtaaaaaaaataaaaatgaatgcgtacaaaaagaaaagaaaaattatcttgttgctagatgaaagggaaagaagatgaaaatgcatttaataagaaaacaaaagtaaaaaacaatcctttgagatatttttagtatattagagtttgtctttaaagactaataaaccaagtttgatataatatgttacttgatatatttgagtgaataacaaatttaagcataaaaaatatgattcaaatttagtattaattttttaaaagttaaaatttagtattaatttaagatacatacatgttaataattttaatataaaaatttaatcgtaaaacatttatatatatttttattatgcaatttgatcgatgacttatttattcaatatattttgagtaagtgaattaactcattaagaaccacgaaggttggcctatatgagagtttggaataatatgcatgagttgaggttataggatcaaatcttagtgtgattattgtaaaaaaaaaaaaaactcatcaaatttaatacattttactatttgttagtattaagagattttgtttttctttatcttttttgattgacagtcaacacaaataaagaaaaaaacacattgcacataaaaaagaaggatgaaaaaaatcatgttgtaaaataaaattagaagaaaataaaaacacattaaataagaaaacaataattaaaaagaacccttatattatggatatttgaatttttcttgaagttaacaaaccaactttgacctaataagttacctgatacatttaagtgaatacaaaatttaagcttgaagaaataaaagtaaagtatgatttaaatttggtctaataaactaaaatgtttgcataataataaatttcatataatttctaattataaaaaatatttttattttattttattatcaatttgaccaatgtcctactgatttaatatttttttaaggtcttatttggattttgctataaatatttacaggataagaaaattaatatttcccacataatacattttttgggagggacaatgagctttgaattaactaaactacaaaatgagaattagtcccatagtcgataaaaaatattaaagttagtggtgcatttaacttttatagtaacattttcatttaactactttgaaaactaaagtgtacacatattgattttagtttataggaataactcaattcattttactttcttatttttttctataaatattttttagaactttatttaaatagaacctaagtaatttacttaatcatatttaatacatttaaccattggtcaatactaaagatttttcatttttatgatttgcaaccatgggcaaattttaatacattttatcattggtcaataccaaagattttccaattttaggatttgcgatcgtcgataacctgtcgttgataaacaccaataaaataagaagaaaatgaatgcacaaaaaaggaaaaataaaaatcataaaagaaagataaaaacataagaacattgaaatgcaattaaaagggagtgtatttgattgagtttttaaatgattttagaagaccttttatgataaagaaatattatagtatttagtcaagattttcaagtagtataaatattatgatattgaatgttacactcatctaataatctatttgaactctttagacttttccatactttctccgattacacattatatattttcctttagctgaagacaatacaattattgatcatttctttcttcctatcatttaagaataatattatttacaaatatttacaaaatattacttgattagcttaataggtattcttgtgatattaaatttcttgattgatatgataactagtaactactcctttgaaataacttgattattaattcaaattgggagtcacaagaaagaaacaacaaagaaaaaagaattataattaattattaaagatgtgattgatagataattttattttttacgtatgtgataatggtttggttcctaacttttatgtatgaaaaatatcttttgagagatattcattatgtaaaggatctcaatacctcaaaaaaaaattagtcattgacttttggtctaaaaatatattgattcacataaaaaattaaaaaatcatatttgtttaatttttatttattaaaatcttatatttgttttgttatattattcattgactcttatagtcttaaacatttgttaaaaatccataagatcttttcaaattttatattcataaattacttttaatcttataaatcctcataatgatctaaatttaaactatcaaaatctcgattataaagtcttaatttttattataagtcattatattctctttcctttcaagttttatattttcataaattacttttaatcttataaatctttatgatataaatttaaactatcaaatcttgattataaatgtcttaatttttattatgagtcattatattctttattttaaaatttacaggacttttttttaatatcccatttcagtacattgttatataaattaaaattgaattgttttaatacttactgatatatacagatttagataataaatgcaactaagtaaattcaaaaaacaatcagacaaaagaacaacgatctcagaaattatttttttggtaatgatctcagaaattatttgaacatgatttttatttaaaactagcaggtaaaaataagaagcaaaaaaactagattcccatttttattcttcactaatttgaaatcaaactggtaaaaaaataataatagggaaagaaaaaagaaaaatagaaaaaagggaagaaagaaaatcatcatcttccatttgcagaggcactatataatggtcataccacatctcgcagcttctttctcgtctcggctttctccttacaaacttcttccgatgtgtttctctctttctctctccgtacttttgatttcttcataaaattttgcaatcggtttgacaactgaatttgcatttggtaatcaaattaataattgaaaaaaaagaagaaaaaaaagggtggggaggcatagccagatattgaacctgccctctgttcttaatctcattgtgcctcccctcagatctcgtcttcaatcggtgggtttcgacggaatcttgattgaagttttgatctttgttcaattgggtccgcctttggatctttgattcttgaaactttttgtgggttttctccaggagtgctttgccttcattgattcactgcttgatgattgttgatgaaggatccgttgtttcgtaactgattccgacaatatctatttttgcatcgttaatacagtctctcagtttgtcttaatttatggtattgcttgtaatgctttttttttttttttttggtcgtgctagggactatttgtatttcaacattttgttaaatgataatgctatcatgtttttgattttattctacccggatttgtgcgcatttcatcccacaccaggattttgtttttatcttgttttctatgagtcattaaaaaaatgaaataaaattatgctatagcctatagatatatgtaaggaattggattggatccgtcaggaacacgcctttttcttataccctatggttaggtgctttagaaggttggctttgtccatttctaatgatgctgctgccacttgcatttctaagtttttgaactcaaatgctaattggacgaggcgtgtcttttgcttgtagataaaatgcaatcagataatggcaagttattcatcggtgggatatcatgggacacaaatgaagagcgactcagggagtatttcagtacttatggggaagttgtggaagcagtgataatgaaggatcggacaacaggtagagccaggggatttggtttcgttgttttttctgacccagctgttgcagaaatagtcataaaagagaagcacagcattgacggaaggatggtaatcttcttgtttacccccttttaagtctaaagtttgcattttgacattacggttctctttttgaattatgcaacattggaaggtagcagttttgatgttgaaatgttgttatattcacaatctcaaaatatcttagctagattttaaaatggagcaggagtacattaaatttttccacatattttatattctctaatcttttgatttttgttattgttctcttttctaagcatctgtcataaggattgacagatcttgaaaacttttttattttctgatatacagtaaatactcaatactgtttcctctcttgctaggttgaggctaagaaagctgttcctagggatgatcagaacatactgagtagaaacagtggcagcatccatggttctcctggtccaggtcgcactagaaagatatttgttggaggtttagcatcaacagtgacagagagtgatttcaagaagtactttgatcagtttgggactataacagatgttgtcgttatgtatgatcacaacactcagaggccgagaggctttggatttatcacttatgattctgaggaggcagttgacaaggtcttacttaagacatttcatgaattgaatggtaaaatggttgaggtcaagcgagcagttcctaaggagttatcgccaggaccaagccgcaccccactcggtggatataactatggtcttactagggtcaatagtttcttaaatggcttcactcaggggtattctccaagtacagttgcaggctatggacttcgagcggatgatagattcagtcatgttgccggtggtcgaagtggatttgcttcatttggatcaggttatggaatgagcatgaattttgaacctggtttgaatgctggatttggagggaatgcaaatttcaatagcaatcttagctatgatcggggagtaaatccttattttatcggcagctccaataggtttggcagtcctgttggatatgagagtggaaatggaggaaacaattctttcttcagttctgtgactcgaaatttgtggggtaatggtggccttagttatggaacaagttctgcaaactccaatgcatacattggatcagggagtgggagtgttggagggaacacatttggcaacactggagtcaactggagttcttcagcaatttccgggcagcagggaggagggaacaatatgtcacaaagtagtggcaacctgggatatggaggtggtgacaacaattatggtttggggactggagggtatggaagaagcactggtgccacttttgcaccaacatcttcatactctgcatcaaatggcggtgttgatggggcttttgcagacttttacaataatagttcagtttatggggaccccacttggcgatcttcaaattctgagagagatggatctagtccctttggttatggacttggtggcacagcttcagatgtttctgccaagagttctcctggttatgttggtggttacactgttaataagaggcagccaaataggggtaagagttacaataatttagacaaatgcccttttctagatactaggcattttgaggaaatgttatctgattgatctctgattaatgttttatcctctttgttaagtttgctattataatggaacaattgtaattggttgtttatactatgttcaacccattacttaaatttaaatagttaggtgaagttgtggatgcatatttttgaaagcttgtttctcagaacagtgttcagtgacattcaatcacggacattattgctctatagttattcaatagaaggggtgacattgactaaataagtaattatctatgtttgagttcattatacttttgccccattccttgttttccgaactccattcccttaattattgtatctgtgtgccttatttgttgtataagtaagcttcttggaacactagcacatctttagataaccataatgtcattcagatgccagaattctaactacatttatatgggttttctttctaatcttatgtggaatatacttcaaggatgtgaaaattgagaggtcccataggaatcaaaaattaagcttgaaattgaaagatagctattactgaaacaagcaaagttaaccttcatagaaatatgtatatgattgtcattgttccacaacctaactttgttttagcatggcttggtttagaggaggaaggggttcagattatagatggactttctaccatacctaacagtagaaaaaaaagtccctagtttgagggacgaggaaagtaagcaaggtgcacagtgttgttttatagttttattaaacaacaacaaagcctctactagatgagatcggcaacatggatcacataacaccatttggcacggttaaaaaccaaagctttaggaataatattttgcctgagatcctcttacaacttcctccaatgtcccttttggtcttcctctttcccttttcatgagactaaatcatgcaatatactcctaattgtcgccttgtgtgggcccttttgtacattccaagccaacttaaccaattttttgtcatcttttcctcatttggtgccacaccaaacttttctcgtatatagtcattccgtattttgccctttcttgtatgactgctcatcaatctttacattctcatttttgctactcccacttttctctcatgttgtccctttaaagcccaacattcactgccatatagtataactggacgtataattgtgtaatgaaacttgtctttgagtttggtaggtactttgtgatcacaaacaactctcaatgcctttctccatttaagccatcccgcttgtatgacatcctcatattttttccatcattttgtatgattgaacccaaatatttaaacttagaaagctgtgatacgatttattcaatttttaattccgagtcatattactcttgtctcttgctaaaattgcaatgcatatactttgtcttactcctactcaagcaaaatcctttgtttccaaagtctgcctccaaagttcaagcttaatgttaattgcttcccttgattcctcaatcaagattatatcatctgcaaaatgcatgcaattaggataattttttgtatgtccttgataagcatccaagactagattaaacaagtaaggactcaagccttaagccttgatgtaatcctgtctcaataggatagtccttagtttcaccacttggagttctcacactagtagttaccacttcatacatgtcttgtatagcatgaattataagccttttccaagtcaataaaaaccatatgtaagtctctttattactgtacctttccgtcaaccagaaataacacctttgtgacataaaatcaaattgattctctacaatccttgtttcttctcttaatctctatgctccatcaccttttcctctaatttcatagtgactcataatttcaaaatgttgatttatattttatagaaaagaataaggaggggtatatgcttttatatattataaagtttctattagtgattcagatgtttattggtataagtagagtttgaattctgctagatgcaaggctcaaccttacacatacttttacaatgtgcacatgcagaagtattttaatgaaattaagttctcaaactaaaagtattacttcattcatgaacagaagttgtagaaactgtataacttaataaaggtgaggtttcaatggagattatcataatgactcttgtctaattgcatcttttccaatgaaaacagttgggtatggatctgtggattcaaaatctgcatggttgattgtaattttgtgagttagtagatggagaaaaaaaaaaaaagagaaaaaatttgtaaacatgttgcccataattccattgaagtgttagaaatgatcattttcatatatatagatatatattccgggctcttttcaacagtattgccttcttttttcgagtgtcttatcacaaaacttgaatgaggggaagaaaactgacttctggatagcaatcatagatgtcatgtaaacatcatactagaactagttcttcgatgtccttttccttctgaattgtctgatagattttagatgttttgctgcatgtgtttagagtatgcaatcatgatttgcatgcaatcaaatcttcataggagagttgatttttttttttttgtctgttatcccctggtgctctacccctcacacttagagggcaatataagaagttttaccctcttgatgtttaatagttagtcaagagggctgatataaccccaagttctttgtaatagagtagaatctgttccacatcattttcttctttatgatatattgatatgttatctatgttcaaattttttccaacaatgaatctcaatttctttagtcttggtaagttatggaagttctttatgatatgaatttatctttgatcttttgtcttttagcaaaacttgactacaattcacttatactctttctgctgtatgctcctttgtagtgctccattttttcacatcaacatataaattggatggaaataaatattgatgctttatacttgtgaagtgtcctttcaatttttcattcagttgtcttgtatgccaacactgataaacttgtatatttacttcaggaatcgctacataggaagatcgttttgatgacacgaacttgtaggtgaagataatccagtgaagcaggtgaattgtgaattttgcacaccactgttgttactgaatttgggtttaagacgcaagatatttggttttctagagctaactggagtgcctgttttgagggttcagatatagagatagattacaagggaatgttaaggcttgagtttttgagttactgtttaggttatgggatttgagtgagatgtaaaatctgattgcgggatatagcggaagtgtatcatgcatcacttgtgaggaagcaatataaaaaagatggacagagcatttcttttttcctttttctttttgggtagattttttgccttttatgtcttgcaaagttgtgggttcttctcaggaattgtttgtttcttcatccgttcattttggtttgcttttagcagattgtatctgaggtttttgtttattactagtgtgaaacattgaagggatacccatctagggtcccgtgaataagttaccatatgttctgattctttttctaaaggggaatattttatgctacaaattcaaactgtatgtgataaatggatttatttttccccatttgaatattttccaaattttgtgaactatgtagtattttattacacttgcttttatagatattttaatactatagtttagtttaccccattgccattcttaacacagctaaatcgtttaagatagaattgtagaactttgtaagcgtcattaataaagcaatgcacccaataaaaaaaaaaaaaattaaatatagattaattcttttagaaatactagactggattttctgttcagtgggtgtttgatgtattagaacaaccattctctttatctattaaattaaaatgaaaatgaaaagtcacaattaaaatattttaaattcaaattaaagtatcatttaaccataaaattaaatatgagatttgtggcagtcatgtaggtggatttgtggcagtcatttaggtgataatgatggtggtcatgacaacaaccatggagacgatcttgatgtaaattaaatctttaaaatatttgattttctttaataaatcttagaaattttataattaaataatgttttaatttgaatgttctcattcttacataacaaagtcattttcgtatgaaacattatatatatatatatatatatatatatatatatatatatatatgtatttctaaatttatatccttaattatttttgttaaaaataattttatccttaattaataattaaagtgatttttttttttaaattacattaatgaggtcaatttaatccttcactaatattctatttgattaaactaaatcaatagttattgtgtattgtaacttttgatcaatgactaaataagattaaatcaaattaaaaatgataatgaaattaaaatcttgatataatggtttaaaatacttcaaacttcctttactttaagtatagatatataaaatatatagatagatagataaattggatttaggtgttgtacttgcctgtttagcacatccttcttgagtagagattagaaactgttccgatcttcaatcttcctgagggttaatgttaggcatttaagatattgtttttctttaatttaactcttgtggtctaaatatctaattattgcaggactttttgatggatggtaataaacaattttttttggcttaattgcttatttattttgttcagttttattccactattaataaatgattcaatttgatctcttaaatctttaaaatgattcaattaggttccttaatttgtaaaaagttctaacagcatgagaccaatttagacgaaaaaggactaaaatgcatggtatttgaaaaattaaggaaccaaattgagtcatttattaatagtgagacaaaattaaattaaattaataaataatgaggccaaataaacgattaaatttggttccttattttttttttgttttagctgaaaaatgacttttttgtgtgtttgtatttactgacttgttgcaattttagaaaattgcttgtttttctttcaaaatatttgaaaaaggtattcaattgttattttctaaaatctgtttctgcttgcctttctttcctttttaaagatattttgaacattttaactaactcagtatattttactaaataaaaattgtctttcgagttccagttgtgtatagaaaagaaaatctttagagttatttttatcatcatataaatgttttttgagtcgaataatatcatatcctatagaagatattttttagtttagatcaagagacagacaaatcaaaagcaaaagactttgggagattctttttgctttaaatatttgtcaaacaaaaattttcttcgaaagcatcattccaaacaaatatatttattaggaaaagaaaaaatgtgttggctgattttggaaagtaatattacatccccagaagtcagaagacatgaagtcgaataaagtgaaaaccttctatattgttaatttttcttccctcctcgtttgagcctgtttcctatttttgtatttgtttaatacaatttctatatgttatgccgtttacacatcctttcatttgccctatttctacattgggtcatctgactgatttctttatagctctgctgggattttttttttatttaaaaaaaagccatgtaagtggatagtgggaagcaacgaatatcgaataacatacaagttacaacgggtaggaatagacatggtctcgtacgactttccattcttctttttgtgtggtgcttggctacttggacttttttttggacttaaataaaagaattcatgataaaataatttattttaagttttgaaatggtttagatattatgaagtaaaattactcttaaagcaattactagctagttgattgaaaaattgttaatgaatattaatagaagctaattacaaaatactcaaagttttattttagaagtggagaggagatgtttcaacttgcaacttaatacccgtgaatttgagttgtccgaaggtattaatgctagcccaataaaaaaattcactcttttccgctttaaaattacatccataccatcctccaattgctctcacaaaccttacatagtagtgtgtgtgggagtgtgtggactggacacttgacatttccccgtggcatgcgagaaattaaaaaggttttggaccacatattcactatcaaattttacattacatttaattaatcgagtgttattaattttatataaaaatgatagaaatcatgaataagtaataatagtggatcatctaatgatttcttgcctgcatcacctttcgacgcagtggaactcccaaatgatcattaattcatgcgtcatgtttgaactattgctaagaaacattaatagaagctagtgaaagtatgtatgtattacttcttaatctttgaaaaatatttcaaattgaatgatatcttaattaatattaattcgcttagaatattttttttttgacatatatgtatgaaaaaatcttaaacaacattcattttgagacaaaggaagtatatttcaaaacctttataattgcacaacttggcattggatagaaaatgaattaaaagagaaattaaggaacaatgaaatgaaatactagagtaataatgaggaatgttaattgtggatggcacttccactggctttgtcggaagttccaatgagtccctctctcctcatcttgtcttccttggatttcctacagaagacaacccaagagttgacctccaaagcaatgcaaaggccaatgagagtggagagccctaagcagtaagtcaacttggcataagatctgctggctcccataacttcaaatccctgaaacacattcacaaagccaagcaccacacacgagtaacctacaaaatggtggtatgacttccagtacttcctgaacttgttcctggtctttggcctaaataacaaggccagagtctgcagagcccccagacaaaacaccgcgattccaagcttccggtggagcctatactccactcccggcgacagttgccccagccggattccgatcacaaaccccactgttcccagaacgaaaccaaacagttgtattcctgcatgcataatatttattttccgtccaatttcttattatcatcaaattaagcaattactactataacacaagtcattgtcaaacaagtattaaatgactgcccgaagagtttttttttttttaaatcattaatttaatgatatatggatatgtttagaatatatatatatatatatatatatatatatatatatatatattaattaattatttatatttatgttttttttaatcaaatcatataacataacatattgcatacgctcttctattttctgttttttatatatcacttataatccttatattagaggattaaggtagtctaattctgatacacaaataacactaaaaaatatatattttgtggacactcattgagggtgtttgtaatatgtactcaattgagaaagtaacacaagaaaaagaattgataaacaaatggatttgaagtgtttgtggaatatttcaatcttttataatggaataataatccttcaaataaagattagtgatatgtgaatattttgtcactctacacattttattaacatttatattttttatatcatatcatattatttatatttttctttttttagctttttactgtctagtcaaactaaaaatatgaatggttgaaattaaagagtaatatggagaattgtgttgatgatcacacctgcatgaacatagaaccatgcagggccgagcgcttgaatgtgcctaaggtagcgtgcggtgatggctcccattggtaacaaaatgccccaggagatggcgttaacggtgccatggatcactctcaacgtcgtgagatccgtgtgctgtggagcagacgaacccgacaacacgtcaaaggtagcaatggaagccagatcggtggaagtagttggatgaatggtgggcgagtacccctgaacgtaaagtcccctgttccaaacaaggtgaatcttggtcttgttcgttttcagtttcaccgtgccgaagatttggatggcggcgccgttgtgcacggtggccattttgcctccgtacatggcggcggtggaggagaggaggtggatgtcaagggggcgagagagcagtggagatttttgaagcttcactgtggggtcaagaatataagatagaagcactatttggcctgagtttgggtccgggaaagctattaaggcacgtgttccggtcatttcgggcgatgtgggattaatgccccatccaacccaccctgaaggtgatatgaagcttccaaagaagactagttctaaggttgagttgtgggggtggaatgtccatgctatggaggcttgttgggttgggaggttcatgcatttttcgaacgttttcgtggcggtttccacggtgcaatgggatgacaatgcaatgtggggaagtgaacacacaagggagaggtaaagaagaattagcatggtggtgccgtggatctgtgatggatagactgggagagaattaatggttcatggttcaatgcttgcttttgttaacaacaatgttgtgttcagggtgagtgtcatggatttttttattattaaaaaagtttatgtgagttgcatgggtcccaacttcatcattattaggatagaaattaaaattcaaagaatttttacatttacttacaaattatctacaaataaaattttcgtatcgtcaataaaaatcatactcatgtttttattatttcttactaaccaatttttgctagctgtcattatggattttgagctcgtaataagtgagaatcgttagtgctttctttctttgacgtgcgaaatagtatgtagtttgatgcttgactttgaaggaaagacaaggtggtgttgtgcgtttggtagaaatgggacaatgtgatcgggttttaaaatttgtatctagtggtgggagtagagggcaatatagtatatcaaacgagatattattatgtcgatcgagtgcggctactccttttgattatagtcattgtcttcacgagatacgaaggttgatgtttgcatattgtgcttggctttgaagctatgccataatcattctacttctgaaattttacccatccattttgtttttaagcaaatgaaatgtgtgttttactcgtcctttaattatgtccctaatttgaatcccaaacttcgagagaaaaattgtaaggttaaacacataatttagtttctatatatattacagattttcaatttggtcttctacgtgtaaatgttattgatttggtttatgtcatcgtcgtcataacaccatctttaattgtcttatgttagttaaagataacattgaattgaattattattattataacattgaattgaattattattattatctccttaactcgagaaacacaataaattcattatcccgaaaaaaagtaaaaaatttagaatttaaacttaaagacaattgaatataacttctcatataaaggaatatatacagtttagtgacaacatatgtataagagaacctagattcaatcccctcaaataatacactcttggaaatgaccgatgacttggcacgcaccatttgtgcactcagaaaagctttctctccccctcccaacaagtcttctgctatccgtggatatgccttcttctttgacaaggtaagttgacgtgcatgggttttgccgagtacatgcatgacatgacgtgtcgcgttgttaatttcagcttatgactatagagcaatctagaaagtggtttaaggacgtgcttcctgcattggcagatttgctagctctggaggttgccctatctctttgttggaagcaccctaccaagatgctcttcgcatattggaatcgcaccaaccaggctttgtgtgccttagccaggttacttactttcttattattacattttatctacttttttcctccaagatggtttctaaaccaaaatgaaaattctgaagtcataagtattgcacaactgtgattgcttttcaggagttggttgctactcttcttgtttgctcattattttgtctattcccagacgatcacaaccatgtgaaaggccttcaaatgatcaactttgatcaattgtttgcgtaaggaatcctttgctcattttttgtcgtaaatttgatccttttagtgtcagcatgctgcaacatagagatgaaattgatattggtcattggtgtagtccattttttattctcttgcaatattccaaggtttttcttaattttcaggagtgtgtatatatatatgatcatatgaatgaaaaactgcaagataaggttttgtgcatccttcactattttcaaaggataagttctgatatgcctaagtgcattgtctcctttgagcgaagagtatttcccttcaaaaattactctaatattggtgatcccgacgcggagctttggggcgcgactcgtacacctctatgcaatgttttggtaaatgaaggaaatttattttcaattgtcagcaaaactaatttctttcagttttttttaatgattcatttggtttttaatagttaatactttggcattgtaatagcttctcaattcaggccacttggaaaatcaatcaagtgtagcccttgaattatattttgcaagtaaaaagcttgtgggagatgtccttggcatggggacttcacagttacaatatgttttttgtttccatccattatacctaggtatttatgatagcttttataccatagttcctgatataagcatatgcatgcagtcgtgtacattttgtaattttgtaagttgagatatttgtcacgtgaacattttgttttagcctattgatgttcaataaatttgcttgtaaatgtcagatataggaggaaatccgcttcatgctcagtccagaattgattgctgctgggatgcttttttgcagccgtgacggataatgaggctatagaaattgttggtgtggaaaggttcttgacttatacaagtgtataaatataacagaagataaagttaaacaaataaataattcaaataataagttaatccaaattcgttgtatcttctattcacagtgaagtatatttgattcttcccattgagaatgacatgtggaaaagaaaaaaataacacgatcgacttcacgtagcaaaatgtgacttggagaaattgaaagatgattaaaaatccggactgtaagtattcaacatggaacttcacaattgtccaaagatgtgcatggacgatccttgtgttcaagagttattatctcaccaattacttgttgtttatctgcttgaaaatgatcgtccgctgaaaagttaaggaaggatagagttaactcatgcgaccaattaaaaaattagaaattttataccctagaagtgaagcaacaactttatacctttgtcgctattaaagttgtccaaaaattgcaaaagcttatgtttgtttgtaacaaggatgctgacaatctcaggaggcttattttgatttgcaacaaatagctgtcaattaaaataattaaatttaaactaagaacactgagtttagaagaatctattaaaaaatatatacttgctccatttcaatatacaccttgaaaacgtgtaaggtgtccaattgaattgtcttattttgaatcctgcaaattaaagggggggggggggggggggggggggggggagtgaacaaattaataagtacttttatttcatgaatttacaattctgaaaaatttgagtataggataatgcatatatactcttaagagattcatgaggatcctcatattatcgaacgagctcacatactggaccattacagcagcattcgagcgatccaataccatatcccccaataactgtaacatattaatttgattacaatggtgaaatggataaaaaattgtgactaatgcaagcagttaaaatggacaattgatgctgaaatgaatttgagacttaaggaatctaccacagattaaattatttataccttgatagcgtaccgtctagtaaaataactggtggattcaagcaactgagagttgtactctttgaagaactgacaggcacagtaaaacgttttagctgataatatattaaaatattgataaaaacaaaaaacttaaaaagctatattgtatgaaaacaaccaaattacttatgttagaataaatttgaggattgtgaaagaagctatgacttcttttattcaaataattgactccaatgtgaataagtttttggttcatatctgcctcattgtgcatgttgacctcaattatatataaggtacgaaaccttacattccaccgaggaagccaccaactaaagacaactgatgaaatctttgtaaaccaaattaaattgtctaatttaaacttttacaaaaagataaaacaatgataggggaaaattctttccctcttctacagccttgattgcttttacattctcgaatttacagaggataaatacttgtaccttttgcatgacataattatatactaagtagactttggcgtacttacccagtcataatttttagaaagaaattcagcaactgtagatttgtgccttgtcaataactcctttgtacatcagtcagggaatggattagcttaatttcatgctaatgaatttgctgtaagagcaaaatagtagtacccataactttattatagcaacacattatatgacaaattttagttaattagggagatataaggatgactttttatttttttgaaaagggaagacttagagtgaagggagttggagagaagttataatgactttttatttttttgaaaagggaagacttagagtgaagggagttggagagaagttataagttcaaaattaacaattctaacaaaattaacaaattaatatttattgatataaaaataaaacattttagttaatcgactttttcagttgtgaaatcagttttacatgtcaaagtctatttatacaaaacaattatcataaaacacattcccaaatacaaagagttcttcgcatacatacattcaaatcaatataattaagcctggatagtttaaagatattatttgtttggatgtcgcataaaacaaaggaaaattaaataagaagatgcaagataaaaatatattatggatgatagtttctcttacatttctttttgtatatttctttcatcacatatttcattttctctcggaaaatgcgaaaaaaaaagcagtatcctttatgccttttgctccattgtccaatatatatagaatatagaatatagaatataaataacgtacgtagatatgtatgcaatatactagagatatattttgggactttttcgcaatgcaatgcaagtaaaatgaagaacatgtaaataatgagaattaggcttagatttgtgaatggaaattaaaagacatagcatcataattagcatactttaaaagttgcaacagcatctgacgctctttcaaaatttggtagctgaatataatcagaaaacttcttcatgtgctctgattccaaaatatgcctaaaaaacataaattaagctagtcagaatttgaaaaagaggaaaaagaaagtaaaattccaaagtcagccatgcaagatgcctggctacattttttttaatctccgaaagttaacaattaagaattatgatcctaacacaagcattcatgttggatatataactcaataaattgcatgattatattaattaatttagaggtcgatgattggaatcgcgtaccttgctacgctctggtggcgcatgcactcccttgcaaccgcaccatacgtcaaagcaatgtcaccctctttctcataactaattaaatcaacttttattaaccatttatccagcacagtactgaaactatgaaataaaatttgaaaattcaatgtggaatatcccataaatattcatacccgtctatgagcatctccacaagatctagatttttttccaggtactgagaagcaattagttgcgaattgaattaactcgctgcctttgcaagtttgcaatcacgtgggttgcatcttggcgtgcctaccgacatatatatatgaattaattcttaaatatgctagaaagagaaattaaaaaaacataatgtaactgacggtgaaatataaaaatggctaccccgagtttaagatttgatagatagagaatgaaaatgcgaaatgtgtcatctttgaaaaactctcatgtgatctgagaacacgcatcagcatttggctctgattctccgtttccataaagaaccgttcttatctccagtacgttttgcttaggtctgatagctgcaacgcatgcattttatatatatatatatatatatatatatatatatatatatatgaattaatcaaggttttaaaatatagtaatgcatggcataaaaaaaaatagtaatgcaaccatgattttgattgcaacgtcaacatttaatttaatttttaatgtctacaactacaacgcaatcataattgtaatcacatcaaccatatttatttatttgtgttttttctcgatattaaaaaagtgacgaaactgatgtaattttaaaaagtatcaaatatcagttttttcaaaagttgtacgtgcatgttatgttggtgctgaagcgtgaaaagagtttgagtatctggtgtggtgcttgcgaagtatgatatagcggtggcagtcgtatatattagggtattaattctgagcaaagcttctggtattttttatttttattttcaggctgcataatttgataaataacaggttgtatgtgcctgatgcattttctgttgtgatcatggttataaattgtggtcatggttgcggttagccaaaaaaaattatattgcaagaaaatacaaatgatgcaaccacaattagggtcatgatgagattgcagaaataccttgatgttgcggctgcaattgcgattgcagaccgttgtttaaaacctttatgttgcaagaaaatacgaatgatgcaaccacaattagggtcaatatgcgattgcagaaataccttgacgtcgcagctgcaattgcgattgcggactgctgtttaaaaccttgtgcttgacgggggtatgtccagaatttcttgtgtcctcagtttgataatttggaacacatcctgtgtgtcaaatttttttattgcaataaaattgccttttcaaaagaaaaaaaacaatcttagatttaattatgaatgcacagtcaggtaagacaagttacgtaattttaattatgtgatggaaggaagacattaatttaccttctctttgcgtttactttcacgagtgaatgttttggagtcgagaaagatgatgagttctcgggcgtggcgcacgagctccactggtgtgttttgtgtaaacataaatctataatttctgattaaaacaaacacatcaaatcttatgaacaagatctttaaaattcatgagtttcacataaacataattttgtccatgattactgaagatcttttatggtagaatgttttctcatggtcttaaccctttcaattcttgtaacttcttttgataagggataagatacaactttcatggacagacaaatgaatgtattcagttttctaaatttcaatttatcattttatgcataattgcacctatcaacagttattcttttaataatttctctttgtaaccaattacccttatgtcctttattcattaaatcaaataacatttatttaaatgagtcacaatgataaatcttatattctcccacttggctcatgtcacaactttcatttcatgatttaatgaaaacaattataatgcgcatacataaggctaaagttttcatacactggtctcctcataaatcatgatcagaaataaaactaataaaaatcatgacggttctatgctatcaaatcgacgtaattccttccatgtaccactttattaactcttcttcctaatatgatactttaatgaaagtttacatcataatgtcccacaataatactattatatgtcttcattagggacaaatcttatttttcaaaataatcattcatacatgcatgtatatataaatttgaaaacagaataatatttaaaaacttaaacatcattaaattcagagtgtcaatagtcaataattacaataatgaccaacattcattagctgacataatgcacaaactacatacatgactaataaatgtcttggacgataatcctttcgtcaagggatcaactaacataaaattagtgctaacatgctctatagacactctatgtttatgaacctcttctttaacgacaaagtatttcaatgtcatatgcttaacaccttttgaatacttgtcgtttttagaaaagaagattgttgctgaattatcacaataaattttcagcggtctatcaatactgttgaccaattcaaaccttgaaataaatttttgcagccatttagcctgaacgatggcttcaaagcatgtcacaaattcagcttcaatagtggatgcaacaattactaagtaatttttcttgtatccacacatcatgcaaaatctgagtctgtgtatccaatcacttcaacattactagacctcctataagtaagcatgtgacctttagtgccttacaaatatctcataactttctttgcagctttccaatgatccataccaggattactctggtatcttcccaacattccaactgcaaagctaatatctggtctcgtacaagtttgagcatacattaggctcccaacaagtgatgcatacggaattgcttccattttctttcgttccaattcattcttaggacattgcatgagactaaacttgtctcctttctgaattggtactggagacgatgagcagttctgcatttcgaatctctaaaaatgtattaatatatgctttctgagacaaacccaataatccttgtgatctatcacataatattttttatcccaatcacataggattcctcactcatgtctttcatttcaaagttactaaagagaaacttcttagtttcatttaaaaaactaagatcattagttgcaatcaagatatcatcaacatacataatcagtaatataaacttactcccactgaccttcagatatatacactgatcaatagtgttttctttaaatccaaaggaaacaactgtatcattgaacttaaggtaccattgtcttgaagcttgtttaaatctgtatattgatttcttaagtttgcacaccatgtgctcttttcccttttcacgcatgcacaaacctgatttcatttaaaccttgatagataaagataagtgattgattgttgataattcttcttcatcttcaacaagtttcattatcattcgataataaagtaacctcattttgaagttggcgtaacatttctcaaatataatttgacctgaacaatttgttttgaaatatattatacactttcaagcatatttataaatattctctttatttttttttttgtacataaatatatactcttattctaatataaataatagtgttatatagaatacactatatgcgaagacaggaaagcctcgtagcttctagctagcaattgtgaccggcataagaacttttctttagtaaatagaaagtcagtcttatatatatatgctcttgcacaaggatttcgtattgaatgaatacccttagacattgacaacataagtatatacaaatgcttattcactatagacttcaaatagtcctcatcgtcaccttacgacgatgcttatgaatctacaaaagaaaaatctgatcaaggagaatgtgtcaacccaagtctcttaagctgtgcaagcaggagcttttccagtaactttgggcttgacattagcacatttagcaactactggagctccattgaatgtaagagcaacattatttagttccacaccctcacatggtacacctttgctacatataagagtcactccttccttggtttttgaagtgcccttaatattcttgaaggtaaccttgcttatctttatttttgatggagtctaatccattgaaagcatgcacaaaatagacaaaaacaaggtataagaaacctcacgatagtgcatactcaatcaagattaaaatactagtgatttaaataataacaactccagtatgattataaagagggtaacaaataaagacatttaaatttaagaatcgtgtctgattaaacatataagtacctgttttgagcactgattccaaggacaatactcttggtctatgatcactgggttcatgacatcaaccatggtaatatcttcaaaatgcatatcagtaataggagaagctcctggagaactaggccaagtcttgatcctcacaccattgtctgtttttgtcaaagtgcaattcttgactagaagttgttctaccggctcttcttttgggtacttgccaagacttccaacactaatgccatgaccaggtccacaattcacattctggacagttacttttctactgccatctcccaatgagacacagtcatctccggtggcaatgttggagttaagaattttcacatcagttgatcttccaatgtgaatcccgtcagtgttgatactggtacttggagcactgacgtggaagccatcaaatgtgaagttattgcatcctaaaacgttgacatggaagtttttgctatccttagaagttatgtcccgaaccatagaattattcaggaaattgaaaccaaaattctgtttacaagaaactcagctcattagaacgttttggtagaagtgcctgtgctagcaatttgagattaattgaaatggctatatagttatatagtttatttattaccttggaacgtgtcttgcaattcttgttagttccacaatcattttgtttccaagcagttgcaccttgaccatcaaaaacacctttacctgataaggtaaaaaagttaacatattgtactttgagccattcatcagccccgttgagtgcattcgggtcagccggtgcttgaagtgtgccatcaatttgaatttcaatgggagccatgcaaggaccttttaattcaactgcttccatcttgtatgacccacctggaatcacaattttgcttgcacttgttgctgcacatgcctctttccaagcttttgtcaaagccttgaggacaacatatatataaattacaaatcaaaacacaatagcaataataataatcagtggaatattcaatcctttttttagggaactcaactgctttttacctgtgttatatctgcacctccgccaaatttttttatattaatgtcaaccgattgagttgtactagaaatagctagcaataagaataaaacactgatagctggaatattcaacttcatatccatgttgttattgataaactttattttcttgtactctttagcgatgaatgttgttttcaaaatatgatggaactctatttatacttgagtctggaatcttcaaaaccattaacaatgtgaacagacttgtactatatcaaagtaattaattatgttcgtgcaattgtctggtttgagttagttactattaatggaaattcattagctaacactaacatataattactatatcaatgtaattaattatgtccgtgcagttgtctggtttgagcttgttactatttatggcaattcattagctaacactaacatatcattaataaagttctatatcaatgtaattaattatgtccgtgcagttgtctggtttgagcttgttactattaattaatggtaattcattagttaacactaacttataactgataaacttctaactgtaaaattccaatacttaaaaatcctttttcatcattgttataattggtcaaggttatcaaacttttttttaaggaaattaaagatgaaactcaatataagacatgtttaatttgaatataatcattaaacatataagtctaattttgtagcatataatcctaataatattggaagtgatgttatatttatataatttctcactcatatcataaatataatgtaaagaaaaaaaaatacaatcaaacttttattattatttattcttcaatgttaatatcattatatgctattttatttatcaacaattaataaacattttgtagcatatcttgataacaatattgcgagtgatttcacactcatatcacaaatacgaattaatgaagaagaaaaacatgataaaacatttattattattattattattattattattattattattattattattattaatattattaataatgaagtaaactagcaagctatatgcatttaagagttgaatgtttttttttttttgtctgttattcctctggtgctctacccctcccacttagagggcaatgtaagaagttttaccctcttgatgtttaatagttagtcaagagggctgatataacgccgagttctttgtaaaagagttaaatatgttctacatcattttcttctttatgatatgttatactatgttcaatttttttctaacaatgaatctcaatttctttagtcttggtaagttatggaagttctttatgatgtgaatttatctttgatcttttttcttttagcaaaacttgactacaattcacctatactctttctgttgtatgttcctttgtagtgctccattttttcacatcaacatataagttggatggaaataaatattgatgctttatacttgtgaagtgtccttttagtttttcattttcagttgtcttgtatgccaacactgataaacttgtatatttacttcaggaatcgctacataggaagatcgttttgatgacacgaacttgtaggtgaagataatccagtgaagcaggtgaattgtgaattttgcacaccactgttgttaccgaatttcgatttaagacgcaagatgtttgattttctagagctaactggagtacctgttttgagggttcagatatagagataggttacaagggaatgttaaggcttgagtttttgagttgctgtttaggttatgggatttgagtgagatgtaaaatctgattgcgggatatagcggaagtgtatcatgcatcacttgtgaggcagcaatataaaaaagatggacaaacaacatttcttttttcctttttcttttcggtagattttttgccttttatgtcttgcaaagttttggttcttctcaataattgtttgtttcttcatccgtcattttggtttgcttttagcatattgtatatgaggtttttgcattctttgttactagtgtgaaacattaaagggttacccatctagggtcccgtgaataagttaccgtatgttctgattctttttctaaaggggaatattttatgctacaaaatcaaaactatatgtgataaatggatttatttttccccatttgagtatttttacaaattttgtgaactatctagtattttattacacttgtttaccccattgccattcttaacacaaccaaatcgtttaacatagatttgtagaactttgtaagcatcactaataaaacaatgcacccgataaaaaatatcaaaaaaattaaatatagattaattcttttagagatacgagactatatttttttttcagtgggtgtttgatggctgaggtctactttaggatttttcacacaaacatataacaaaaatttaatatatacataaacatacatgtataatttttatttacagaaatatacatatttattgttcacagtatatcacccctgcacaaacatgatttcatttaaaccttaatagataaggataagtgattgattgttgataattcttcttcatcttcaacaagtttcattatcattcgataataaagtaacctcattttgaagttggcatacatttctcaaatataatttcacctgaacaatttgttttgaaatatattatacactttcaagcatatttataaatattctcttttttttttgtacataaatatatactcttattctaatataaataatagtgttatatagaatacactatatgcgaagacaggagagccccgtagcttctagctagcaattgtgaccggcatgagaacttttctttagtaaatagaaagtcagtcttatatatatatgctcttgcacaaggatttcgtattgaatgaatacccttagacattgacaacataagtatatacaaatgcttattcactatagacttcaaatagtcctcatcgtcaccttacgacgatgcttatgaatctacaaaagaaaaatctgatcaaggagaatgtgtcaacccaagtctcttaagctgtgcaagcaggagcttttccagtaactttgggcttgacattagcacatttagcaactactggagctccattgaatgtaagagcaacattatttagttccacaccctcacatggtacacctttgctacatataagagtcactccttccttggtttttgaagtgcccttaatattcttgaaggtaaccttgcttatctttatttttgatggagtctaagccattgcaagcatgcacaaaatagacaaaaacaaggtataagaaacctcacggtagtgcatattcaatcaagactaaaatactagtgatttaaataataacaactccagtatgattataaagagggtaacaaataaagacatttaaatttaagaatcgtgtctgattaaacatataagtacctgttttgagcactgattccaaggacaatactcttggtctatgatcactgggttcatgacatcaaccatggtaatatcttcaaaatgcatatcagtaataggagaagctcctggagaactaggccaagtcttgatcctcacaccattgtctgtttttgtcaaagtgcaattcttgactagaagttgttctaccggctcttcttttgggtacttgccaagacttccaacactaatgccatgaccaggtccacaattcacattctggacagttacttttctactgccatctcccaatgagacacagtcatctccggtggcaatgttggtgttaagaattttcacatcagttgatcttccaatgtgaatcccgtcagtgttgatactggtacttggagcactgacgtggaagccatcaaatgtgaagttattgcatcctaaaacgttgacatggaagtttttgctatccttagaagttatgtcccgaaccatagaattattcaggaaattgaaaccaaaattctgtttacaagaaactcagctcattagaacgttttggtagaagtgcctgtgctagcaatttgagattaattgaaatggctatatagttatatagtttatttattaccttggaacgtgtcttgcaattcttgttagttccacaatcattttgtttccaagcagttgcaccttgaccatcaaaaacacctttacctgataaggtaaaaaagttaacatattgtactttgagccattcatcagccccttgtagtgcattcgggtcagccggtgcttgaagtgtgccatcaatttgaatttcaatgggagccatgcaaggaccttttaattcaactgcttccatcttgtatgacccacctggaatcacaatcttgcttgcacttgttgctgcacatgcctctttccaagcttttgtcaaagccttgaggacaacatatatataaattacaaatcaaacacaataccaataataataattagtggaatattcaatcatttttttagggaattcaactgctttttacctgtgttatatctgcacctccgccaaatttttttatattaatgtcaaccgattgagttgtactagaaatagctagcaataagaataaaacattgatggctgaaatattcaacttcatatccatgttgttattgataaactgtattttcttgtactctttagcgatgaatgttgttttcaaaatatgatggaactctatttatacttgagtttggaagcttcaaaaccattaacaatgtgaacaaacttgtactatatcaaagtaattaattatgtccgtgcaattgtctggtttgagttagttactattaatggaaattcattagctaacactaacatatcattactatatcaatgtaattaattatgttcgtacagttgtctggtttgagcttgttactatttatggcaattcattagctaacactaacatatcattaataaagttctatatcaatgtaattaattatgtccgtacagttgtctggtttgagcttgttactatttatggcaattcattaacttacactaacatatcattaataaagttctatatcaatgtaattaattatgtttgtgccgttgtctggtttgagcttgttactattaattaatgataattcattagttaacactaactaatgattaataaagttgtatatcaatgtaaatttgtccgggcaattgtttggtttgagcttgttactattaattaatggtaattcattagttaacactaacttataaccgataaacttctaattgtaaaatttcaatacttaaaaattctttttcatcaatgttaaaagtgagtttgtttaaatttattttaaaaatattttttaataaaataagtattttttttctctcatatgtttatctaaattgtttttacttaaaatattttttttttattttgtttaggaatcaaatcttatcttcttaaaaaagcatttaaaaaaaaaaaacacacttgttgtaaacactactacaaaaaaagccttcaacattggttttggaagacttttaacaacgatgttgaatcgaccgtcattgaaagtgaacaactttcgacaacggttcaaatacaaatgttgacaacacttttttacatcggttgttcacaatcgatgttgtaaaacactttttacataagttgcaaccacaaccgatgttgaaattaagtacattttttaagagtaaattacactcacatcccttgtgtttattttcaagttgcaccccatgtttttttctcttggtgttattatgtctttaggagaatgagcaattccttctaatgtaatgacttccaaaaactagcacgaagaagatagaaatgagtaaatttcgaattgcaaaactattagttctattgcataattagtgacaatttattacctcttcatgctcaattatgtgtgctaggggcaatataacttgaccttcatccctcatcagtaaacccattgagtgcctcgttgaaacccctggcattacataaaatagatgagttgaaaatgccttataaagcagctcaatggttccaccatttgttgtgggtagcacattgaaaacatcaacagcttgacagtcgtgaaaccacaaaggccggtatttaaggatttctacaacctgggcagagtatgtttgaccatgtgactaataaactcaagcctgacaacagaattaaaactattgcaagaatcaaaattttgttggaactcaaaaagtaaagtaatcgtaaaaacggtgactttagttgaagggtaggtgatggaaatgaaggtttttttttgtgatgagaaagaggaagcaaacctatgaacaaaaaattatttactcaatatcttaattagacataacggatgctggtgttgcatttggatcaacttggcatgcatgagaacttaattagatagatgattgatttcagcttagattggtgagaaaaagcaaaaaataatttggtcagcagtattccgatagtgtttttgcattaaatgttagtaactattatacctgcttccaaaattaacataaaggctgcaaattgttctgtcttttttcatttgagaaattattttggatatagataattgatttcagctttgattggtgagaaaaggctaaaaaaaatttgtctggcctatactgatagtgtttttgcattaaatgttggtaactattatacctgcttccaatattaacataaaggctgcaaattattctgtcttcctcatctgagaaattattctggatatagataattgatttcatcttagattggtgagaaaatgctaaaactaatttgtatagataattaggtggaatagtttaactgtatagataattaagaggagagggatgccgaacgaaaaaggcaagaaaccagtaaagagcaagagagggtgcaagatctcttggatacactttgttagctatttcagtttcagtatatcagtatcagcagaagaagaatacagagtgttgactaaaatcattttttaagcatcagtgccaataagtctgaacctattccctgatgcaaactacccaaattctcaccactagcaaacacaagcaaaatgtgttaagataccttcaaaaagacattaggatctcaagcaacaaatattctcaattcatgatccaacttactagcaaaagttcatggagaattcaacaaaaataaagagaagcaaacaatgaaataaaacacacacatacaacaaccactaaccactaaccactaagttgggtcaattcttgagtattcttcaactctataccaacaaactaaacttgtaaactaccataacataaatgatactgaccactgtaaagacccattaacttgacaataccgataccattcttagtgctttctgcttccacatgagctcgttgtgcctcttcaacaacaatgtcaaaaccgaatgacttatcagaatcaggtaaaacatgattaaattaggtgattgtttaaaagcaaatcatttttacagtctcagcaaagtagcttcaattgtccaattcaagcatgcttactgggacatcactatcactatcaacgaattttgttccaagaaatcagacaaagcccctcagacatgggtccactctcatatttaaaaagttaaagcatctaaaaccgcaccagccaccaacaaatttcttcatcaattaacctttttccttcttgaaggaaagaaggcaaaccagaattgaagcaaatgcaaatagaatcaaacaacttgtctcccaattaaaaaataatagatgattaaaacaaccacattgaacaattcaccctagtgtatcactaccatacaaaacataaatagaaagggatagaagtcacaaaactgttacaattatatagtcttatagattttaatcctcacattagtatattaaagaaataccaaaagtaagtaaatatatatatatatatatatatatatatatatatatatattaagggatatcttcatcatcaaagatcactaccaaaccagtcacgaccttaacgccagacagcgaacccttgagctttagctccgatggcttccactctatcaccgctaaatatatatttccatgaagcctcaacgagtactattcaataattgaatataaaaacacaagaaacgaaggaaagaaggagtaagaataatacaatcacggattcttccttagagaattacgacaatggcgattgatggctgacgaagggtacaaacaacaaagagagttcacgccgtagacgtagatgccatcgcagcagcagcgtcgaaacgatgtagacgccatcgcagcggacttcagagatgagggaacggcgagcagtgtcgcaagtgagtgtcaagggtttgggaagggttgttttgggattttggaagtggactgagagtggtgagagtgagcgcgaaaataagagagtgaaacagattttgaattttttaatttggaaaaaaatacaatgccactttctataaaaatcaatgaaaataagcatcaaacaacattaaattttataataactgatattcacatcaattttttaaaaattgatgttaataaaatttattaacaaatatattatcacacttttttaacattaattttaataaaatcaatattaaaatgactacattaaaaatatattttctaatagtaaaaattatttcttttaagtttatacaaattcattcaaagcattatctcttatcactttgattctttggtgagatacctttgaaacattttatcttaatgcaaataaggatacttggtcttagtgaaaaatataattacttctccaaaaaaaagtgaaaaattaaattatgcctttaacattgtgtgtaagccaattttcctctaatttaaggaccaaataaaatgctaattatgaaattaagtttaattatcaattttaaaaaaataaattaactatattttagttgaaacaattgttcaaatttaatttctaaaatagctcgaacaatattttttttaagagtattgctattaagtacgaaaaaacagatgcacaaaacatacgaatcatcagatataagttgttagatctttttaaataattataaattaaaaactaaaaaaaaaagataaagttgtttgttttaactggaaacaactattcgtgtgattagtacgaaatcagtttccatttttctaaaaagcagcaagaatatattatttaattaagggattcatatattttgaataaatcattaaatttacctaataatccttttttatgtgtttggttgaagttatttcgaacaaataattatttttttatgttataagcatggtagtactattatttgagactatattcttcttttaaatatttaaaaatcgaattcacgattattcattaaccgtgaacaattacatgtcaattgatatacataaaaaaatttaaaaaaaaattacatctaattctctactattatttaacctaaaaaactctctaattattttcttactatttcttagaaattattcttttaaaattgaaaaattcaaatgtgtgttaataataataataaaaaaaaaatcatgatttttatttcactaagttgaatttcagtggcgatatcgtgatagtacaagtaataagttactagtatttaattaattttattaatatattagttaatacattattatacattatttaaagtaaaaaaaaaagctaataggtgcgaattattggataaattttaattaaccttatcaatatattatttaattaattattgagaaatatagggacaaaaaagttacgtaaaatatttgtataagaattaaaagaaaaaaattaaaaaggacagggaaaaagaaagaagatattagaaggacagcgtcttaaacatttatttgagaaagtggattgtgagggcagagcgagagcgagagggagagagccttggatcgtattcagctcaattcaggtatctatgtttccccctttcaccttctctctctgcctccttccatttcttatattcgtcattcttctttccttaacccgttaaatcaagcaatttgcctttcaactgtttgatcaaagttgccaatgaaacaaatcgttttttttttcatatttgcccaataattctaacttaactcatctttcgctttttgggttttttaatatacaattacatactcggtcattttgtatttttacattatgttgaatgttgaaatttatatttagttgatgttttgaaatttgcatttactaaacatgaaatgaacttacattttgtagatacattgaaatgcttggctgagagttgataatttcttgaagatagtcgttcatttcttgagttttatgtgtatgccaaaaatgacacacacaaaaagtttttttttttttttttataattatattgtaaaacagatatggttatcccacccccagtgaggcctcccaggattacacaatttctcaaaccttatgttctgaagatgcattttaccaataagtatgtgagtgcccaggtgattcacagcccaactgctactgtagcctcttctgcaagctcgcaggagaaagcgttgagatcaagcttggaaactagtcgcgatgtggctgcagctgcaaagattgggaagatactagcagaacgccttttgcttaagaacattcccgctgtttctgttcacttgaagagagagcagaagtatcatggtaaggttaaagcggttattgattctctcagggaagctggtgttaagctgctttgattatgattgtttaattgtaccttagagagaacatccttgttggatcttgtctaaatttatttttgagttttcgtcattacagcaagtcactcattgaacatatttctcaaataccttagttaattacgttactagaaataagttgagtgttgatggttgcttagagtgtggagtggagtgtgtttgttttactcatttcccattttccaatgcacttccaacagtttgcagttgaaaacttgcaaacccatgttcaacgtagatatggttgcttcctatttttgtgcattggaaagtgtgaatctactgtttgcatgatgtttgtgttcaactaaactaagggttttcaagcacacccttaatatattttgtctaagaccgtaaaattgcttgaaggaatagtttacataagatatcaactgtgatcagctcaccaaaatggtagatagactaacaggacagtgctctcttgcttggatcttaacaccgagatgttctgctgaaagatgatgtagaacgatgatgcagtgctcttctgctacttgatctactcaaacgcaaaggaaagtttattagaacacaatacagggacatttggaatgtaaaatgaaaagaaaaacaaaacaaaacagatagctacatgaaacagcaaggtgacagcactttggaattggttggtacttggaagcgtcccgtattattcttttcgggatgacttaacaataatgcttgcacaagtgcagtctaattcttagttttaaacaccagaggccgataagaaaaatatactcacaaagcgagaaaaagaaagggaataaccacgcaaggacccttcctttgatcaattctgccactttctacaaatccattgtgaattgaatcttgtaaaaaatgtgtttgattatcagtataggaatcataatgctaatcatagaaatggattggataaatcccgatcctcatagtaatgaactaataataagctattttggctgtatttaagatttgagacatgataactgctgaatgcctgaaccttaactgctaacattagtatagacatggctccttttcaactgcttattaaatgagcccatatacattacatttgctttatgtttagatttagcacaatagaatatttaatgccatgtccggagtattttccaatttccacactaagagagtaaaatagtaatacatgactgctctagaaagttttccttgcagcatgatcgggaccaactaattaaaatgactgtatacatgctttggtaaagccactgtagaacctcagtcaaagatgaacaaagaagaatgaagaagctatagaaaaaatgtccaatcatacagcagaagaagatgacatccaaagtatttctcacactcaaagttactatattgtccagaggaatcgatatcatatttcatagccaaccaccccttccccctattttcaagactacccttttattcaaaacagtaaattaataacaatttatttgtaaaaacattttaatgcagcggcaaattgttgtagcaactgaaattaattttctgttaaaagaataaattacaatcagataaattcaatttgaaatacctaatataattttgttataccatgatactcatatgaagtaactcgatcgaaaataatgattaatcttcgtcgaagatcgtaagcacacttagggtataattccttatataatataattaaataatctaataattttataattatataatatcaagtgcacgggttgattattgtattatttgataaagttacaaactgcatcatgaaattttaagttaataagattttattaggaaattaattgctactttgatttattttttaaaataattcaaattcattcatccgaaaataaaatgaaaattataaaatattggagttaaatttatttgtaaatacacaaaatcatgagtaaacttaatagcttagtattaaacacgagatgagaactaccctattatgcaacttctaataaatttcagcctatattaatcccacggtttgtcgcaaaatggttcctcccacttgctcaagtgataattaagaatagtagaatagtaaagataatttgcaaatatacccgctatatgatacatattttttattttttttatggaaggcactatatgatacatattggacatatcgatatgatatgcagatatgaaacgcatatcaaatacaatacatattaattattatttttatactgcaatacatattaattagagatgatacacaaatatcatacacatatcagatatagtatatattcactaccaaaaaaaaaggacatagatatagtatatttttgataaagcaaattgactattctcaaaatatataaaatacgttatgcgtaaatatgtgcagaaattcattaatcataataaatatataattacaacaaatccaaattaaaagtatactttctaaaaattaccataaataaaaaatataaatcattatcattaatacagtatcaatcttattcccgttttaagcatcatgaaagataactttatttttggtttattaaaaaatgaataatttaagatttattgaaagataagtttagtcatttttatgggttttattgtaaaatatatttttaaatgagttatcatatgaatgttatattagactttaaaaatatgtttatatcatataaacaagtataacttcattcttacaaagtctcaagttcctattttcacctctatcacaaggttaaattattataaaataaacttttaaacatacttataagaaagaaagagcgacccaaaaataaaataactaaaactctttctttaggcttcattcattgtttgatcaaccacgcttataaatcatgtcaaacttttatgtatgttaagacatgccttttaaaaagtcatttgagacgtaaacatgctaagcttagatctaacaaagcgtaacttgacctagtctattttcgttcctacttgcttctagtctcttgtctatagtattattaggttcatagttatttcgaaaggttcggatatttatagttatgtgaaatattcaagagtatattttcgtatatatgtattaaggattttgtgcttctaaaataatgaagagatatagagcataaatacactcaatttttttattagaaatcattgatttaaaactgtgataaaataaaataaatatacagtaaagtttacagttttttttatcaaaaaatgttagatgttagtattcgtaattttcgttatcatctcaaccatttatttcttaattagtggtttgggttttgtccccaaaaagatgtccaaactaaaaagtaaaaactataaagtgtttgaatcacataaaacaatttatgttcaacccattcaaatctgttatttcaaataaggttattaggatgcaaaaaaaaaaaaaaaaaaaaagaagcatttttgcagtgaatcccaaaattttgatttatgcaacacaacttcagcagcacaactcaattatatcaagacccagattgcgatctattcttgtagttcccgtatcttctagagatgccagaatcagataaggtgtcccatacctacaaattataacaagttacaacagtcaagtcaatttcacaccaagaatcagagaacgatcaagaacacgaaagtattgttcatctgaacttttcacttacttgcaatttaccctttgagcctcctatagccaacaagaaggggttgtcctcagagaaagaaattttaaagatagccccctaacaaacaaacaccataaaatagataccagtcatcagtgccaatttaacaaatatattatgattcgttgaagctttcccatttaaaaaataaaaaaagaaggaaacgtactgctctcggagatttagatgctacacaagagggtcggttgttcaacaaatcccaaagttttacctgtgagaaataatagcagccaaatgagatgaattccaatctgtaaagtacagtataccgaaaaataacaaaattgacttcactattaccgttttgtccatggatccagtggcaagaagctgcatgaagtcatgtcaacagggcacagcaggttaaactaaaatacataatcagttgatattctaaccaaactgttgaagatacatacattgggtgccgatggattataggatactgaggtaacagctttgtcatgtgcatgaagtgtaaaggtagaactcggatctgatgaggaatcagagttggcagtccgtatatcaaaacccttgacaataccatcttcaagactcacctaacagaacaattaaatcactattagtgaaccaatacctgtgcatccacgaaatcaaaattgaaatttgatcttacagaataagaattggttattattttgtcataaaaaagttagtagctgaaagaatgttggttattattttatcataaaaaagtgctagtatgttttatcaaaaaaatgtaaagaaaagaaaagaaatgttagtactcaggtcctagaaataactataacacaccacaaaagaatgctctgtgtgcggatcccatgccaagctctctacatcagctgtgactgaccacttgtagccagaatgtgatggcatccttccatccttctgcaaagtgtaaaagctataaatattagataactatatgaatttttaaacaaaaaagaaacaatttttttaattggaatgcctcttttagcacatcaatatacaaccaaagtgtacagattacagaataataagtaatcaatgacagcaaaatacagaaaagccgagtaacaaaggaatattggatcagatcattaccaagacgacagtatgatcaaatgaaccactaagaagagcctgtggtgcatgaagattccaagcaactgcttgaacctgtgagaatagatggacaagagataaatctgaaagacatcaggaaatgtattgactcaaatattttaaagtagaaacagaatttaaaaaaaaaaaaaaaaaaaaaaaaaaaaccattgcgtcaaatgattcaaccaaggaaggagaaattttttccattgtaaatttgtttctcacatacatatagattgaatatagattgaagaaagcatttaattcaaagctgaagattaaatgatttattatataaccgttccatcttggttcataatagtgcagcaaaaatcacctcaatctattgatgtttaaatcatatctccaaagttctaaattatataataattctaaggaagtgtgtcaacatgaagagaaaaaagtcggtttcatcaataaaatgaattaactcatgataaaaaaaataaaatgctctagctaatttcttgccttgtccgagtgatgctccattgtaatatcacacttcccagcaactacatcccaaatctttacttgcttatcagcactggcacttgctagtatgttccttttttttaagaaaatagaagtcaagataaacttttaggttccagaaagcacatccaacagagaaaataaaagcagaatccagttttaattcaacaaacctgtactccttgttccaagcaagaccaagtactgagtcagtgtgactgtcatctttgtatttgattgatttctgcaagaaaataattttaataagaaatggccaaacatatttacttcaaaaatctataagtattaaaaaaaaataaagatgaaagtctaataaaatagtacaagcaaaaatatggattttcacactagtagcttcaatgctcatatgcataagacatctgcaatttcagtttcatctaaagctattcacaatcccaaataaaaaagttacaaaattcagaaaacaccaaaagatatactcaattatgttagataaaccattagttagttgagttttgttagctaagccatcagttagtttaattggttagtagttatttattagttagttgcaatcagtgaagggtatcacttagaacagatgagaggaaagggtgccatttgtgagaggaaactagggccttttggcattgggtggtgtggactgataagaacagagaaaatggagtagaataaaaaagatgaaatagaaattttatagaagtaaattgagatagtttctaataacacaggttttcgagagcctgcctctccataattcagacttatccttctttgttttttcctccccttcctaatctggtttacttctatttatactgcatctaacatctattcctaatagacacaattgttcagaatggttgtgactgttctcatttgtaagtgctccagatctgatgttgttttggctccaagggttgcgccctttctccaccggttgcacccttctgagtcgcacttcctggtcccaaaaaatggtgtgtctcttcaccaagggtcatgtccccttgattcacatctcttgactttgcgccccttgggtggatggtgtcttttgggttgatcaccaagggtcatgtccccttgattcgcatctcttgaccttgccccttggatggatcatgtctgttaggtggttagcactccttgggtggtcaagaactgttgcttctcttactcgctgcttgcgagtgtacaccctagtgatgggtggcttatgcttatcacggacccccgaagttctgcaatgcagtaactaaccaggggagattttcattattatcttttgtagtaagagatcaactaacccatatattagtagttagttagctacgatcattgaagtgaattcacatgtacaactgaagagagcaaaggaaagcatcctaccattgtgagaggaaattagggcctgttggcattgggaggtgcacaccatcaacttctgcagtgctgtaaccaggggagattttccctattttttttctaataagatactaggtttctatcattttattgagttagaatgctaacaatggacaaaaatgtacatggatttacatgaatgattaagtttcataagtaaaaagctaagctaagggtatcgatttaagtgcacatgcatatatatacttgcacatgtacaataatactagaattatcaacaataatttgcaacttaactgcatttaaattttcaaagagcacaaacaaaccttacaaacagcacaacatatgcaatttccacaaataaatcataattaagtatgctgccattttgaggtaatcacatgattctaaggggattgaaattaacaaaaatgtagaacaaacctttttcccctttttctttttctcttcaaatccacccaaaaccacacatggctgcacctcatcaatctgagagcaaaggaaaattacaaggtattcagaaaaaaagatctctctttttgtatatgaaatttcagacagcacagttaaaatttatatactcaaaccacttacaacatcaaggtcccaaatttctatggaaggttccattgaaccaacagctatgaagttccctgtgatcataataaaattattttaagctaataagataaagcaaagatatatcaagtaggtatcaagtaaaattttaaacacaaattgcaatgatggtgatttcaggtagtccaaacctagacagttactcaaactttgaagaattttttttaatggtgtacacaacagaagtgaacagcatatactaatctcactttattttctaatgaaatgcaactttccattacaatttttccacttcacctctggatgatatatgaattttcatatttttcatttttggcaaactaaaatgaaggcagaaataatcagaggatataattaagacagtttacaagttttccttgagacttgttattttttcacttttctaggagcgcccttcaattcaattaaatggtgagtgctggggagggagaaaagttgaattgcacaaaacaaacaatcgagcaactcgatcaacacaaatacacacgcaagaggtatcgtgcaaagaacctctttctcctcctttaagggggcaatcgagccaagctgtgcagagtggaaatgctggaataatgatattatggtgaggatacacgttcatttcactagaatcggcatcctcgataacccaaacctggcattgcagaaagaaaggagtgataagtatatatctgtataatatacgaggacttgacaagtcacaaaacaactaactcactaacctcaagataactgacttcatcctcggtacatgcataaacaacgacagaatcagttgggttaatgatcatgtcttcgagttcttcagaatcatcatcctgaagcatcataaacaacgtaagataataagaagacacgcgccgcaaccgcaacgctaataaaatgacaacaagagctggaacttacgcttttatctttgagatagggatccatgtcgttactgggataataaagatcaccaattccagaactgaagacctcaattcctaaacaaatgacaaacttaagtttaagcagctgctgcattgcataaatataattacaagcaatgaatgatcatatagaatgcagacttacgtaccttcatcttcgtcatcataacggtccatatcaaggtccttcaacgcaagggttatttcgtcacaggttccagtggtggccttgccgactgcatctgctacggttaatgcttgtgccacaacttcatcgttgttagcgtcttcattgtcactatctccactgcacataaaaaaaaattggatgttagggttttactggtgaatgataatttttgttggaaccaaacaaaaggaccaccttttggttgagtggttggcgattatctcttgaatttcttcttcgggaggaggttcagccacgacaagttccgacttcgaaacccctttgggcacccacgaaatcgcagaaatcatttttattttgtttgttttgttagagagacgacgcaactcaaccaaaagaggcagcagcagcaagcaacaagcagagaagagggttttaaggaaaaaagaaaaatatgaagaagaagaaccaccctccctttagcgggggaattcatgggccttggcccaatacagcccaaatgtctttatgtcaggggtaattctatttgtaaggacacatgaacaattatatctaaagatcaaatgtagtacttagtatgtactatttaaatattcagagcttgttttgaaatatctacatgttgtaaagatgtgtttgacgaagacattaatcgtgtgtttggattgtcgtttgaagaacctcaaacagatacctctacttttcgggacagtgaacatagaagcaatccctatcattaagacaggcacaagattattgaagaattcatttgttttgggatgatatattattgattatatcaattcttaaccattaactttcagaaatatttcaaaaatagagtttataccttttataaataaataaaaaagatatattcttacttcttagtaatatatattttaagaaaaaaaagaagccaacggggagtagaaataacaatatggaaagtgtaaatactaaatacccattgtagatttgcccatctttgttgtagtattaaaactcggcccaacttcagttgtccttcccaaatcccgctaaaccactccgtctctcacagtctcactctcaccgtcctcgctcgctccagcgtcgttgcttgctgctccaccttaatgtgagttcatcttaagtattccaacttcagcctacttcatttcttttgttcttcttttttacgcactaagacgctacttaactctatgtatttggtttttcttttcgttttatttctacgcttctacatgctatgccgcactttcagtaagcttgatctgtataactgcttaatcaaatcatctttagttttcatattctcaaactcatatttattcattataaataaatacctctgttgtgtagtctagctatattgcatattttcttttcttttatcttctatcgttttattttaagttaacctaagaggtaaattgaaacctgtatattcctatcatttgcttgtttcgtggtgtttccatgcgataagatgcaacatccagttccccttgctggcatatgcgcttattttttatttttattttactgttttagagactacatcaaggaattgcggtcaaatttcaatgtgcagaacgcaacgcttcactttgacctagctttgtgatggaatgtgacgttggaggtgtctctgattcatgcattttgcacacttgcaagagaagaagggtttataaaggctgttttcatccatccattgatatcatgacagaaactgaagcttccctacctatcttcaactcgtccggttattacaccaaaccatctttgaaggaattagtggccagggagcttgttgaacctggttattgcagccgtgttcctgatttcactgttggaagatttggttatggatatgtcaggtatctcaatgaaactgatgtcagggggttacgtatagatgaaattgtgaagtttcataggcatgagatagttgtatacagtgatgaaaatgataagcctgctgttggccagggccttaacaaggcagctgaagtagttttggtattagacagtgaaatattgaagtctaaggaggggaaggaagatgttatagttagcaaattaaaacaaattacaaagaggcaggaagcacgatttatttcctttgatctagtgactggtgagtggaaattcttagttggacacttcagcaggtttgggtttggtgatgatgatgaggaagactttgttatggatgatgctgaggtatatgatgttgagaaagaatcaccatcaaataccaatgaacttgaactttctcattctcttccttctcatcttaggcttgatcctgttaaaatgagagaaatgagattattgatgtttcctgatgaagaagagatagaggacttaagctgcaaatcatcttctggtaagcagtatgtgcggcctttacaaagttcaactcaggcaatcaaccatcgatccaccccaccagttgctagaaaaactccatttccattacttgagtataaacatgggaattttgattcaaattctcctggaggcattttgatggttcagcagcataagggcatgcctcttaggacgataaaatcacaaggttttaagctagatctcaaacatgaaactccagtatctggaaactatgcccacaatatagttgatgctggtctgtttatgggtaagtcatttcgagttgggtggggaccaaatggcattcttgtacactccggtgcacccgtaggaagcagtggtaatcacaaactgttatcatctgttgtcaatttggagaaagtttctttcgacaatgtggttagggatgaaaataaaaaagtgaccgaggaacttattgatcatgctttggtatctccattaaattttcacaaaggaataaaccatgtgatgaaagaagttgaaattggtccctgcaagttgacacttcaaaagcttgaagctaatcgttcgactctatctgagatttctcatcactattgtgatcttattgagcggcaattgagtgttcctgggttatcttccactactcgtttgggtttgacacaccaagtaatgacctgggagttaattagagttcttttttctgacagagagcaaaaaggtcaagtagaatctttgggtgctgacaatgaggaagatatgatgcaggatttaaaggaaatttatcaagatgttgaccgagaagcactccctctaatgaggagggcagagtttagttattggttgcgagagagtgtttcctatcatgttcaaaatcaaataagctctctaaatgattctgattatctgcagcatatatttgtactcctgactgggcggcaactagatgaagcagtgcagctggctttgtccaaaggagatgtgaggttggctagtttgttaagtcaggctggtggttctactgtgaatcgctctgatattgcaaggcaacttgatatttggagaaataaagggctggattttagtttcattgaaaaggacagattgagactctatgaattgcttgcaggaaatattcatgatgcattgcatgacatcaaaattgactggaggaggttcttaggtttattaatgtggtacaaattaccaccaaacacttcattagccattgcttttcagacttataaacattttgttgatgagggaacagctccatatcctattcccctttttattgatgaaggaacatcagaggaggttatcagttggaacacggataaccactttgacatttcattttatttaatgcttcttcatgccagcaaagagacaaaattcagctttctgaaggctatgtttagtgcattctcttctacccctgatccacttgattatcatatgatttggcatcaacgagcagtcttggaagctgtgggtgttatcaattctaatgatcttcatattctagatatgtcatttgtgtctcagcttttgtgtgtagggaaatgtcactgggccctatatgtggtccttcacttgccccttcgtgaagattatccatatcttcatgtaaatctgattcgggaaatattgttccaatacagtgaaacttggagttcagatgaatctcagcaacagttcattgaggatttaggcattcccacagattggatgcatgaggctttggtatgcatcatatttttttaattttttattcatttttttgtaaaaagaaaaatatcaatggcattcataatttgttgcagtacccttttaacctcatctttctctcatactatgtttggatgatagataatgagaggaatggagagggaatcaggggaaggacaataagttcccttgtttgtgggagtttaaaaacagattggagtggaacagaacatcaggggaccattccccatcatttcccctccatatcacaaattttgtcccctaaaattagggtggagtggggggaactcaaagggtatcggagttctatctgttcctatattaatcttccaaataagcataatgatagttttgttccattcccttccctttactttctagtacatccctcttgttccattaatgaaaaaagaaaaaaaaatacaagcacactgtatattctgattatactattaattcagtttatataaatgattttttttcaattggcttgagttataaaacctatgagatttgttttttttttaaggacaaaaaccgcttattagattcatatgggcacacattatgatcaatttatgtctaaaactgaattaaattgttgtcctggtgttctttactgattaatgggctatattaatgcttgaaatgttgcaaagttttgtatttttctttaaatgactcttattgttgtttgaatgattttgttgtggcggtgcaggcaatttattataattataatggggatcactcaaaagcccttgagcaatttcttcagtgtgcaaattggcagaaagctcatgctatttttataacttcagttgctcataggttattcttgcaaggtaagtcgtgtgtgtatattgcttggtaaaaaacaccttgggagtaccgaataatatttgccaaagtcataactatggaaaaccaaaaaataaggaaaacgttggagtaccgaataatatttgccagaaaatacctgcgtctctcatgcaagcttgctcttttatggacatttataaaaaaatcttcaagaactttcattattcatatagtatcctaacagggccttaatttcatcataattatgatgaaataatctaaaataacccagtaaatcacaaaagaaaaactcttcaacaactacatgaaaattcaataaaatattgttgacccccccacaccccattttgtcctgtatcatcattactttaaattgctgaaagtcattttatcacaacttatttcttttcaatagaagaaaattactagattttttcttcttaattccagataagtgcatcatagataacttatttaatatctttggcagcaaaacacgctgagatatggaggatagcaacttccatggaggaccataaatctgaaattgaaaactgggagttgggagctgatatttatatttcattttatttgatgagaaactcacttcaggatgataccaatgctatgactgaattggtacgtgaatttatagaagaggatcatccctcatatcatcatttatgtgaaaaatggttgttacttgatcctgtcatagtatgattgtgaagtgtaactaaatattaaacaagtttgatcctgcttgaaacatggaattgtcatgttacaaatttatcacaaaatatgatgatattttgggggcacaaccacacacacatgcagtggtgcaaaagacaataatgcctgttacccaattatttgaaatgcttctagctggtgcaatctttccatgagataatcttttaatagacttaaaaatatgatttatgaagctaggtaacagttgcagtgtttgtttgctagatcagtagagtggatactcttcgttgtgatttcaattgttagagattaagggaatactcctttttccatttgattgatcaattaaaatcatgtaatttcttgtttcaggattctcttgaaagtaaaaatgctgcttgtcaggattttgtcagtcagctaaatgaatccctagctgtttggggttgcagattacctgttgatgcaaggtatgtgttgtcctttgcagtaacttcttgttgacctgttattaggttgtgcagctcgatttctgattttataggcctgctaatatacttatccaaaaccattttttatctggcagcggacttataaagaggcaaagaaaatttgataatacagtaatatattagtttagttgctagtgttattgaatctggttttgcagtttgtttactacatcaaaaccacacgtctttatcccaataatttaagcacctgtatgtttttgacatgttatttcattagttggccatatttactatgtgatgggtcacccgtttagagaagtttcatttgccatattcacggttattactgattttgcagggtggtgtattcaagaatggcaggcgagatatgtgatttgctactatcaggtgtaggtgatggtgctacccgtgatgagcagtttaactgctttgacacttctttcagtgctcccattccagaagaccaacgctctgttcacttgcaggatgcagtgtatctttttaccagctatctctcagagattgctacgtaattccacaatctgccatttactgtcatacgaagtcaaatagaatagaacttctatttgtttgcaaggcaggatttagatctgcatatgattcgtgagatttgtggctgttatttttttttttttgtatcttggtcttgtatgaaaagtatgagatgccgctaaaaaacattcattaattttgcctgataagtatgggataaggctttgttgttgttgtagttaactgaatttctacattacttgataaaagggaactgagttttgaaattgaataaattgggaattggatattctaaatttcaacttgcgtgccacttttaaaggaaaatcttgacacaagtcaaatatggtcgagtattgttcgctatcttgaattataaaattataccataatgcattacaaattacattacattaggggcgtttgtggtattggctaatcttgtcattttattttatattcagcgattatctttgtctttgttcggtttgaatttgaggatcaattagttgtagtatataattttgacctgattgaagcttgataatatattgggcaacattgggattatttgcatattttatcattcaatttttattattttattcactgaatttttttaatttgtatagtttgtaaatgatgatgtcactaaaaagatcaatttttttaaaaataatgtcgttttgttattaatataataataaaatacataaaaataaaaaatttaaatggtaaaatatacgaaaaacaaacttgaatactaaaatacataaaattaaaaacttgaatgataaaatttgtaaaaaagaaaaatttgtaacatgatgataattaagtcataaaatatacaattaagttatgtattgttaaatcttattaaatatattttatgatttatttatttatatatatatataagtatagtataatgttatatcatattatttattaagtaaagttttataactaattcataaatgttgaaaaaagtatatcttcaaaaagaacatgagatattgaattgagttgagacttgaggcaatattatgaacattattgttttaatatataagaattaaagataaatattaataaatatatattatgttcaattaattaattgagttaaatctcttaatatgtttgtatcttattaaaattttaatgattaattattgtacgtttctattatttgttatgggtattcattctgaacttttaacactgtccaagttcatatcatatgcgaatcaattcgtggaagtctcaagtcagtctacagagggttaatatgatatatagctcactcactgaatattgtccaataataaatggacaagttgttaaaatgatagctccttgaaaccccatttacttcaaaatatatcccttggcttcggtggtggtgtaatggtgttgagccaatttgttctcacgcagagaccacggacaaggcaataggtgtcacgtggaggggtaaggttaagaatgattaggtgactcagggatatggtgcctacaaaactgtgaaatttggagaacaagtagaaaactctaaggagagaatgggatttggagatatatattatatctggtctttaatttctaatattcttttttaaattcatttatctttttttataagattatatttttaatttttggatatattaatttttttacatatttttatttgattattttctttaaatataaacgagaaataattaagcaaatagagagataataaaagataattttagaatgataatataattaatttacagatttaatatgatttattaaattaattattttttaagggatgcaaattagttaaaatgattttctaaatagggatggagggagacataacattaattgtttttttgaattttttgtattgttatttttgtttttatattatatttctgattgtaaatttctattttattcatttcgttcatttttgtaattttgttatttttgtttattcttttagggagaaaaaaaagatcaagatgtcacaaaaagaaaatgaatgctgaaagatttgagttatgtattaaatgttgaatgaaaaaaaaaattatctaattgtttatattatatggacatattaaatggaaattatttttacttattatcataaaaatgataaaatgataatttttaatcatataattattcataaatgattgatattaattttataactcaattattaataactatgattatgtagttggtgtttattattgtcacgattagaagctgagaacagttctcaaacttaaaatgcttgaagttaggttttcttgttaggtcatctaagatttatattgataccatgtatgttgcacactagatttgttctcacctccgatccctctgcagaccttctccgccgtgcgccggcgtcaccttcctcatctttgctgccaccgagatccgcaacacgcagtggtactagagttggaagtaaatctacgccccgtgcctggaactttttctcagatgcaaggaggaagcaaaggagccactggaaggaggttttggcgtgccgccacaagcaccgcatgttgcgaatctcgtggacagcggagatgaggattccggccaagaaagtgtgagaaattgttttcaatcctcaaattgtttctataagtttttatgcagtgatcagagccactcttgaccgcaatattccaagttgtttgttaatactcaatggtttccattaacctctcttgagaaaggaaagtttgcaagaactatgcagagagatgaggattccggtgaatctaggaagaaaaggaagaagttgattttaaaaataaaaaagaaaatcgtcgctgctgcgctggaaatcgccttctccagtaacatatacgacaaagagggattgtagaggttgtaaacctgaaatgaatctaacgattattaaatgtggtccataatagactatctaaaggtgacccagagtagtcatggctttttgtggtagctagataaaaagaaacgaaggcacgtgcgtgagtataaaactctaaaaacatgtatgtggaatttacatgatttttatttttataacttgtcattaatttcgttggcaatctctttcactcgcccttttactagttttttctgtttaatttcaccaattaagagagaatgtacgcttagtttcagatatgtaagttttattctaaacgaattaatggagtcatgcaaattattcaaaattttgaaacgggtgtcttttgtgtcttttactatcatttcactggcagcggtcccttatttgttactacatagctagaaaatcaaaacttttcaaaaaaaacgaaaagatgattgaataagtcagaggaacatatgttattcatctatcaaagaattaattaaaatgaaagctcattatagcaaaatttgtttaccctgcctaatactttcctatccactgaaatggcaaatctaaagagtcgacgcattatatttacaggaataaaaaaaattaaataataagagtatgttttaacctataaaaatattattataataactttcaattttttttttctttttccttcctcagatcacatgtgtcgaaacaatgttgctcatgcatatagcaacaaatgactaattaattgttgggaaaacaaatctttcggacatgaaacccaagttggtaacgaaaccttttttgtcaagtagttttcacctgtaatttgcccgcggtcaacaagcaacgtaaggaattaagaaaatgatagacatccatccgaatttgcatgtccaaaaaaagagtcaaataattatgtagaaaaggcttctctagagtccaattattttcaaaataatcaaatacgaacattttagtatgaggatccgtgataaatattttttataaattaaattttataataaatacgtccgtactactatatatgtagtatactttaggtttacaatgaataatttaaattctgaatctgatataagaatttttttaaattattaatattttttaaaaatttattaaaatgcaattaagacttgaaagagataagcatgaaagattcggccaagaaaagttcacggatcagttgacgacttgacgtacgtacttgatgacaaaggttaaagtttatattattatatgttaagcgagtttcaacaaccaagaaggtgtcgtaggggaaaaaatattacatgattgaaaatagggtgtgaatttggatatgtaaatggagatgttggcggggacggtcctatatgaaatcttgcatatgaaagatttttctcccatggggatggggatcagataaatattctctcgtgactacggtgggggatgggatcacacctccgttttaagaaaattaaataattatttttatattaattattattttatattttaaatattaaaatattaaagattgattttatatgttacttgtattaaaatttaaaattaatgttttaaactgttggtgaaactttttaagtattttttaaatttacttgtattaaaatttaaaggtaatgttttttaaaagttcatatccttcaaaaatcgtggagatctatagagacggagactcaaaaaattctatttcataacctgactttcgaaagtcttagagaaaactattataatttcaaataatcactgcatatagttaaatattattaatttgctaataaaatgagaaacaaattcttttacatctcataatataagatatcgttaagttcatatgtattggaataatctatttagagagaatctgtatttaattctctattttatatatccatacaattgagtcctttagtttccaaaatagtgtaaaatgtttcgaatcattgttattggactcggacctattcttcatgtgtaaaatttctttgaatcatcacactcatgcatagcaaacaaaattaatttttaacttaattaggaaaatgtgtgatccctaacccaagaaaaaatatatatctcttaatgatataaattcgatttcgattacccatatacaaatcttgttagtaaaaaatctaaaaatatttgtataaatattcatttaaccttaagatcgaaccctaataaatctcatataccaactcacctcaacttttaatgataattttaagtgtgtcccagagaaattgattaaaacaacaagcgatgctccgaaagtatctaatgagccacctcgatcacatctgaccaagcttcctggttagtagtacctttgaattgaataatataaaaaaagaacatgatggatgggggtagagctcactataacccacctacctccaattgctgacttttcaaagctagactgcccaaacccaaacaattggaattacatgaagaaatgttgcactataaaaaggggtgcccttcagctatgtccatcaacaaatattggaatactactcttgcattgcatactacactatacttgttaaccctttgagagttacaatggctgctgctattgaaatccccacaatagtgtttccaaactcctcttcccaacagagggtgccagtggttggaatgggatctgcccctgacttcacatgcaagaaagacacaaaggaggctatcattgaggccgtgaaacagggttacagacactttgacactgctgctgcttatggctctgaacaggctctcggtgaagctctcaaggaagctatcgatcttggcctcgtctcccgccaagacctctttgtcacttccaagctttgggtcaccgaaaatcatcctcatcttgtcgtcccagctttgcgcaaatcacttaagtgagcattttttcacacaaaaactagttataattcataattaaacttcttttatgagtttgtgcatctttgattttacctttgatagttaattctaagtacaaaattaattttaaatatgattttacatgtttaatatcctgttagagaaaagttcaaaattgattatgaattaaacaattttaagtaatatttgcattagatccaaaaatttcactaaatttaactcctaatttgattttataataaaaacatttaaacataaatcatatcatttcaaaatcaatttcattcaaaattttgtcaacgtttcaaacaagtttattctgacttctataaatgctctcttgtaaaagtttatatacatatataacttaattatatgctataactccgtctgattcattttacttcaaatatgtatatcaatgcttttacttacatcaatttttgtcgtgcagaactcttcaactagagtacttggacctgtatctcatccactggcccctgagttctcagccagggaagttctcatttccaattgaagtagaagatctcttgccttttgacgtgaagggtgtgtgggaagccatggaagagtgccagaaacttggcctcaccaaagccattggagtcagcaacttctctgtcaagaagcttcagaatctgctctctgttgcgaccatccgtcctgtggtcgatcaagtaagtctctctctctctctctctctctctctctctctctctctctctctctctctctctctctctctatctctgtatgttgtactttgttttgtttatgggaatgattaatgataagattaattaatactgttacaggtggagatgaaccttgcatggcaacagaagaagctaagagagttctgcaaagaaaatgggatagtgataactgcgttctctccactgaggaaaggtgcgagcaggggcccaaatgaagtgatggagaatgatgtgctgaaggagattgcagaggctcatgggaaatccatagcccaggttagtctgagatggttgtacgaacaaggtgtgacatttgtgccaaagagctacgataaggagaggatgaaccagaatctgcagatctttgactgggcattgacagaagaagatcatcagaaaataagtcaaatcagccagagccgtttgatcagcggacccaccaaaccccaactcagtgatctctgggatgatgaaatataaactatttactatgcagctcggagtctatttttataatccatgtttctttctttttaccaacccagctctgtctacttgtttgatttgaggtttaaataattgatgcgatgtcacttcttattttagtatttcgcaccacttcttttccccttttactcaagcccacctgcattgactatttattaatgacccatctttcgtcttcgatttgacgaggttattacttacacctttaaaagaacactataaatcatcaaatttaatgaatcatatcatgcaaggattgcaatctaaatctagcctaactaaaagaatcgtacgtcgcgtgtttgtagctccaataagccaaactgtaccacatacaaggaataaactagggacgtgctgcacatgatatgaataacctatgtttcattttttttcttcttaatactcctatttatgtgaagaaaagaattttgactaatattaaattccgttgaaaaataaattaaatatgataaaaatttattttcgtaaaaacccaaactaaaatattattcaaacgatttaattttaattcaatatattaatcacttatttaacccatttgtaattttttcttaagaaagtttgattacagtgacaaatacttgggaagtcaaatttcttttaaccaattaaaagtaaataattactactagatgatagtgaaagatgattttacactaacattaagttaaatttatattaatctaattatacaatctatacactttcctgcaagtttctgtggtaaaggcccagtcttcaaattttgcgataaggtatgaccaattattaaaaggagtggttgatcagctctactatttctagctagtgtcgttttatcaataaaaaattcagtcaatcttgtttgttaagaatcggctacaccatttacaccatatatattagtatttgtttttaaaattcaacatattaagctatatgttttcttaaatacatgcaataaatccagctgcacataaacatgatgacaataatattagatggaaaagtagaatctaaaatgagctatgtataaatggacagaaggttaacatcatgatagctgactaagattaactccaataataatggacgagataaaataatagctccctgaaatctctattatttaagaaaaatgttaatcagtattttaaatatattgattaaaaaatttaaagtaaaaatatttttatcaaaaaataaaaattatgatatctaaaatcttttttacgttatcttataatttatataataaataatttatttttttaatatcttaattaatattttaaaaatacttattaacaagacccattatttaaaaaactttgctcaaacttctttttaagctgttgaaaaattgtcttttattgaaattaaagcgttcaattttttgggctatgattaatgatttatcgtggttgtgagctagctcttagcccatgactttcaacgaaaaatcttgcactgaacaggtcaagtgagtgccatccatgtgagaaggaatcaaaacaaaactccaagtccagtccggcggcgtatctgtcactcatgactcatcatctgttaaagaggcaaagacaacaaagccaaactatactattaattactatttctgaggatgaaatagtcaacccttcttcttggtaggctatgtttatttatttaaaccttcaaatgtaattaccaaaattgtggatcaactcataattattttaacttaattaatgataggttatgttatatatttaaaagaaagaattttgtcacacgtataattttatcctatttgaataaaatcatcccatgtaaaattagtttgatcctatctttcatgttaaatacacaattaaaaaatgggagttggttctaatatattatcttacattactcataatacaccatactaatataacatgtattcaaataacattaactaaagtcaaacttaaaaaatcatgtgataagtatagtaagtattatgaaattcagttccattattgattaggtcaagataataaattattgtatcaatgatccaataagtaaactaataattactctaattttatttaatatatattaaaaaaattaaaattatatatgacaccatgataactgtagctccttctcttgatgccaaagaggtgtctaccccaaaaactgatcaaaacaaagtttgtgattcccaaactagccatgtcttcaaatcaaaattactagttataccaatctccaaccacctccctctccacgtctactgcttcgagaacgtctctgaattcgccgaccgcccatgcctcatcgttggacccgccgccaaaaccttcactacgccgagacgcaccttatttcccgcaaaattgccgctggattgtccaacctcggaatccacaagggcgacgtcgtcatgatcctcttccaaaactccgctgagttcggcttctccttcctcgccgcctccatgatcagcgccatcgccaccatcttcgcatgccaaccgccgctttgggacgttcagggtgccctgaaccacgggtacgagaaggtctcttagggggtctgtggggtccttgagggtgcagggggaggccacgtggaagacgccggagcaggcggagatggagcaggagagggcggcggcgtcgaggagatcggcggggaagagggtgaggcgggtggcagcggaggggtggaggttgaagaggtgggaagcgtcgaagtcggggaagatggtggcgtggatggtccattttttttttttttttgcataacccggtccgggtttgtagaatcagtcggattgccagattttttcaaaatgggtctgatttggtcgggttatcctgaattaaatgcatgaacattcaatagtaaaactgatcaagttaggttattagattctgattagttggacccgaccaacagagctaaaccggattttataacattcattgtagcccaagtcaactcatgatcgtggtagttggtttcttgcataacgtcgtggactcgtggtggtgttgatggtgatattttgatgtgacaccctttaaccttttcttactacttaacccaactaactcagacatgtctacttataaataaatttatttatttacctttcttcttttcttaatattatattatttataaatttcatttttatatgtatatttataaaatatacagtatatatctatttttacacttaatagaggtatttaattttaaaattaaaatacatatatttaaatatattaggagaaaaaatattttgacataattgtgaaataaaatttaaaattatttatttgcaaataaaattaaaagtaggatttatatgttattttaaaacttaatatcaacatgctagtgcatagataattttgtcattgtaggtgattgattgtcaaaaactgtattcattatgttttcagaatactttttttgttatatatgttatgttttatgaaaaaattgtatttatgttattttaaaaaaatctatatgttattataaatttatataaaaaaaatatttttttccgatgtgataattaatctcaaagacacctacacttgaatgtgcgcttttaagtctattatattaaaataaaatataagttgtctctaatatttatccaaattaatatactgttctagtaattgagtcaacccgtgaaaagtatacatttcgggtcaacatatacctaaaataaaaattaaaagcacatccatatccatggtttgaaaacataaagctatctaataagacctatggacttacgttttactgattgagtgaacccataaaaagttcagtgcatgtagacatttcgggtcaaaatatacccaaaataaaaatcaaaaccatatctatggtttgaaaacataaatctgtctaagatccagagacttaccttaagtatatctttcactttctttttaagaagaactgatcatcattaaactttcagatacggcttatttaaattgagtaacttattttagaaaataatataaataattttgagtttagtttatttaaaatgagcaattcatgtaagaagataaaatgagtagttttggtaattaatgagaaaatcaataattaatattatatatacatgtataacaaattttgcatgtgttgaaacattactcattaattggtaaaattgtttactttgcttttctttattttagaacagtcaaaattgtaaattttatggtatgtttggataagaaaatttaaatgagcaattcaacgtaagagagaattttataattaaaatatgttgtttggatattatatttaaaaaatatttgaaattctagtaatttgtggaagtattttaattacctaaaactgtagaatttcaaatttcaaattcttcgtgctcatttttgtaggaatattcacgggttgaattaatttaggtttagggtgagattgaatacaaaataatgatgcatattggattgcgttgctttgatttgggttttgaaactttgtttttccaatcctattaaagttgggaatggtttggatcatcggattatggaaaaaaaattattatatttttcaagtttgtatctctaattcttgattattttatattcttaattttcacaattacgaaaatatcaaccaattataatagtttattgttaaaatatttaaatagtaatagaatgataattgtgtaataatagaattaaaatcacacaatttactaaggatatgatttagtttttagagttccttcgtttaattcttaatatttatttgaataaaaatatacttaatatacaataaatactttctatcaaggaagagaaaaatcaaggaagagaaaagtccagcgattagttaaataaaagtgtgtgagatattataaatctagtaacaatgtcttttattctcacgaattaaaaaaaaaaaaaaaaaaaacctcactagtgccttattgttacctcacaaatctataattgttgtattgtatggtctcacattttattacttgctagaagaaagctcattaaggtgtaatgtaaaggaacatgaagccatgaattataaaatgcaaaccgaggcaaatgaaacatttgaggtagtagtagtagtttaggagtttaattatatttcatcatcccaaagatcattgagttggggcttggtgggtccactgattaaacggctctgatatatttcatctattttgtgatgatcttcttctgtcaatgcccaatcaaatatctgcaaattttggttcatcctccccttatcgtagctctttggcacgaatgtcacaccttgttcatacagccatctcagacaaacctgagctatggatttgccatgagcctctgcaatctctttcagcacatcattctccatcacttcatttgggcccctgctcgcacctttcctcagtggagagaacgcagttatcactatcccattttctttgcagaactctcttagcttcttctgttgccatgcaaggttcatctccacctgtaacagtagtaattaatcttatcattaatcattcccataaacaaaacaaaatacaacacacggaaaaagagagagagagagacttacttgatcgaccacagggcggatggtagcaacagagagcagattctgaagcttcttgacagagaagttgctgactccaatggctttggtgaggccaagtttctggcactcttccatggcttcccacacacccttcacgtcaaaaggcaagagatcttctacttcaattggaaatgagaacttccctggctgagaactcaggggccagtggatgagatacaggtccaagtactctagttgaagagttctgcacgacaaaaattgatgtaagtaaaagcattgatatatatatatatatatatatatatatatatatatatatatatttgaagtaaaatgaatcagacagagttataagttaaacataagttgtatataaatctttacaagtggggaattagaaggttgatttagtggtgaagaaagaaggaaaggggggagaggcgtgggttcgaacttcgaatctcagctccactaataaaaaaactaataaactaacaagtaacatttatcggtaaaaaaaaaaaaaaaaaaaaaagttgtgcttaaatgaagttgctcacttgagtgatttgcgcaatgctgagacaacaagatgaggttgattatcagtgacccaaagcttggaggtgacgaagaggtcttggcgggagacgagaccaaggtcgatagcttctttgagagcttcaccgagagcctgttcagagccataagcagcagcagtgtcaaagtgtctgtaaccctgtttcacggcctcaatgatagcctcctttgtgtctttcttgcatgtgaagtcaggggcagaccccattccaaccactggcaccctctgttgggaagaggagtttggaaacaccattgtggggatttcaatagcagcagccattgtaagtacgtagcttcttattgtattactgttaatgcagttgatggatggacaaagcccctttttatacaacaacaacattgcttcatgtaatgtattctattctattcaaattccaattacaattccagctatttgggcataccaactttgactatggaattggaggttaggtgcattatgcctctaccgacccattatattattttttaataacaatatataaacatctcattattttaaatatatatatctaatctttttatttacttttgtctttttttttcttgtgatatgaatagttttattatataatttttttctctaagtgttaaataatttttttcttgtcatatatttttttctttttttattgaataaagaagccatttcaacgttattctttgactctttctctttttttctgaggagggaggatttgtttgcaatttttttaattccgaatgttttgttgggaaatcgagggggtaaatatcggggagatttacacgagcaatcatataagtgaattaaacatcacactttaaatcaaaaccttaagtctcaagttcatggatcttctctttatttatatgatatttaacttttctatttttatctgatgttggactttaactcatattccatcatgtttgttgttgctttttttagtcacaggcatggtttttcattacgaaaattttgcttcagacgtttgaaaacgtaatatttttggcttttagctttcaacaaaaaataccgtgatttttgtttttttatctctctaaatagtagtttgtttttttattaacaggacatgatgattattaatcacttaagcaaatttcgacctactctatatcacaccaggaaataaaataattgatgacaaactttataaaatagtgggtaggctgcattcttcaaaactgctgcatgatcatttcaggacgcgattgttgactgcaattatcttaaaagaatcaattatatatgtgtgtgtatgtgtgcgcctcctaaaatagaattgactatttttatcttgttggccttatggaaaagtttgcgtaagaattgcagtattttccatgcatatagtttaggattgaaaagctagtgtgtaaagttagatagcagacgatacttcacacaaaatagaaaaaaaaaaaaaaaatcaccatctaattacgataacgattaatatttgtgagaatgagttaatatctatgctttgtatattcaacaagccctttctatcaagtttacgagtgatgatacatgaatattcaatgttttttattcatctaacaaatatttctcatttctccccacattatctataaaacttacttttttcacttttatttttttcactaggtgttcataagcataggatgatctataatttctctaagttggcaatgcttatttgtcacatccaattttcaaatcaactctttaaaaatgcatttgaaggactggaaagtcagcagctgagctgactctttaatttttctaaactatatccctatagctcgcctatttagacttttgtgttgttgtatagctcttcatccattaagataaactaacagagaaattagttcatgtaatcttttatactattatttaattataagttaatttatatgatacgcttgataatttttataataattattttaaaaatatacttattataatttttaattgattgccagtgtaaaatatttggcactaactatatattaaaattaaactcaaattgaaaacaattctcataaattttctcacctctaataatggaaatcgaggatattgactataagttttcttctttcttgagtgatttggccggggttcaaagaaaaatgacttttacttgtactcttagaatttgatacttgaatatctcacggattaccttataattgactaatatattttactagaatatcttagaactaaggtgtaatatatttagattttttttttttactgaaaaaaaaatgatctacttgattgagtacttatagttaagactcttttaaaaaaatatatattgaatatatgatgcatcaatatcatgataatttatttcaaaggatctaattgaatcttttaataataaagggctaaattgaaagaaaaaaatagacaaaaaaagtaattaaaccaatttcaaaatccatctctcatttttgtctcaacggtctcttttaactcttgccatttttatcaacataagttacccatcaatactttatcggtgacaaaacaaatctgaactaagcgtttgcatattatgttacgatccatctcatatattatattattatgttactcttgccatttttatcaacataagttaccatgaaatgctggaaatcccagaaactgagggagcttactggggtggtccctttgtagcccttcgaggcattgctgccacatacatttcatctcttcctcttaccattgctgagttccaaaacaaagataccatttttctctcacaaagccaaattctatatagattaaagacgcacacaacacagcacagcactaaactcaactctatccgcttcagcttttgtatgacagagacagacaactggctcaaattgcatgttcatatatatggggaagaacatatccaatattcaaataccagttactgaagttaagacacctaaaaacaatcagttatttaactttaaaataatatttaaaattgatttttttgctaagaataaataacttgcattttgcattttttatcgaaaaaattacttgcatttttatttatttaaattaattgtatacattttttataaatttttaattccatattttaaagttttatttaaattaaaaaaatacccgtatgataagaatatttgttagtttattattttttaattctaagattcttagcaagggatattgttattttcctgggccactactctaaactcacctcagcccatacagtttaaagagataaagcaaggcatgctcatgctatctgtactcttattttgctctttgcatgctcgcccctattttgattcttatattgggaattacagtgagactactagcaactgtatggttagaaagggaaatatccacagggatacaataacacattgaacctgaatccaaaataatatttgtaatttattataaaaaaatatttttggaaactataatcatatactagaacatacttttattatgaaaattaattcctgtaaaatctattaaaaaaaagtgaagttgtgaagataagaaaaaagggtattttgggaaaatgccaaaaatagaaggtgtgaagaacaaaaaggaaggtgtaaataacatgataaatatgttgtccaaaagacagtaggccctacatacaacatatttaaaagtccacttgtttgaatgtgtttgaattttggttaggagagatccaaaaatatgtttgagagtaaaattagtcatgtttggttgtcctataaaaatatgtttaagaataaaattttgctctaaggttacaaaacatgcttttaaataaattaatcctaaatgtgtttgagtagtaagttagagtgaagaagcctcatactatttttactatttttttaagcgtacaatgataacaataaaatttaaatctctaacatattatgtgaattattcaaactcttcactattagacggattcatattagataaaaataaattaaacatatatatgtgagaaggacttgcatgtcttgatcttacattgaatgttgtgtgaaggtacatatgtttccctcatgtcataataatcgatggagatctatttgcactttgcagcctgctttatttttatccctaagtggcagtcactaagtagtagttgttacctctacttttaatctcgcatttatgcattccattactactatgaaagagaaatttacaggcaaataagttaaagcgccagtacaacagatccatatccagttttatggtaaaactcgcaaaccagtattagatgcacctcattatattggatgtatcttctaaacctgattcatatacctatatggactatggtgcccgcgaccgaggttcattcgaatctttagtacgggcgggtggccaacgacatggaacacaaagttctaagtgacgtgaacaaatcatataaataatctacatatttatttgaacaaagaaagttaccctgcatgcagaatcacacaataaggaccataacatacttcaattcattggatcagagctcacagtacataaacagatcgaaatagtacatgccatgtggtccttgtactgatggttggctttcgtaaacttaagtgggtcatcactcattcctagctagacattttattagatcactaatcaaagaaaagaaaagacatggagcaacaacacattatggcatgatgcaactaaaacagtcacataaactgcacatttcccctcttcacattctttactcagtcttctcagttggagcctctgtgcctgtgactgtgacctcctcactcttctcagcttctgcttctgcaatcacttcctcgtctttcttttcagctgacccttctttcacctcctcacttttctctgccggggcttctgtgttagcctcttccttagcttcagcctcagcttctttctcttccttagcaacatcttctttctgtgtttctatcactacttctgcagcttctggtgtcttaacctcagcaggatcagcattttcttttgcttccacagcagcttcttgcttcaaagtttcctcttctgtcttctcaactgttggctcttctgtgacagtttcaggcacaacttcaaccgagggcttgtcttctgaagctgcaggttgtggggcctcagtactttcctccttggtttgctcagtgacgacagtttctggtgttggtgctggtgttggagtctcaaaaacttcttctgtgttcttctcctcatcagccttcagtgatgcctcttttgtgtcctcagggagggcaaactttgctgacacaacctacaatttcgaattccaacagacaaagacatattcagatgaaaattcatattttgtttattagaattccaacttgaactctgctgagataaaaacttaataaggtggtggacatgcagtttaatttaaacacttcttactcttctttgtaactattggttaatgtatcacttctcatagttgttgcaatatatattatataaggataaagtttcaaagctgtcagattaatttagatttaatacgtcttttaatactctaacaaatatgactgatggaaaaggcatatgattcgtgtggcttctctgtctgatgacaaactaattgaaatttgcattcagctactttgtacatttctatataattttctgaggaaaacaagtatatgaactctttttgacaaagctatatatatattgataagatgccaagtgcctgctgtcattttactgaatttaattaattaggtgacaagaatttcaggaaaaaaaatgacggttggagtattgaagctaaagaaatgaataacttcctgtctaagataacacagaagcaagggtatgatcatcaatatcatcaacatcaacagcacctttaacccaaattaattagggtcggtgaagggtatgatgatatatattaaaaaaaaaaaaaaacccgaagcaagtatatggttgagatcaaactgaaaataaaagaaattgatgccaaattaaaattaacataagggaatttatttgcgggttctgaactgagctaccatgtgaactagagtagcaagtattttagtagagttacctctacagtggccattggaataccaaagaaaatgtaactgattgaaaagaagcaaagttgagagtgatatagaaagctaaaagcttttgatgaaaagaaatgagcattaagagtggtttataaagaggtaaaggcctcaagttgatcagagaaacggagaggtggggacacttcaagaatcttgggatttgacgcatccttcactgaatgttaataagcatgtttggcaataatggtgacaaaggcttagagatgaggttatattattattttataatggttatttcagatctcctctactgggaggctgaataatggagcacgatttttcattgagatcatcattcttttggttctaacattctgtgctttgtgcagtcggatttacagggggatttaccaaattcaatgcatggttattcaatcatgatttagtggtaaaataataaaaattgcaatgtccttaaaacaaacggttctttaagctaatttaacagtaaataatactgtagtacatttcttatgtacaactcaaattcatctttgagaaatttaatgacaggatactcaaattataacgggtagatagataatttttcttcttgtgtaagtctcctagatgatctcctttcttcttcaaataatgttcggcaatccaaatgatagggtatttacaaaagacactttaaagtttaagtaagaggtcttggttgataccaataattatgagtaataaataagaattaacagtaattttacctatacttcaatattcatgtaactatttatacacactttagtggggcttgaacctatgtaccatttctcaatattacctttttagctaatgtatctttaattatcattaaagagttgaatttttcaataatgcttgtttattagctaatttagatagttttacctttaaataaggtgaggtgagagtgttctgtgttcaatcatgtcgaatactcgcatactatcctatagaaatagtgtgtgatacagtacccgattattcagcatggccgaatacttcagagtgatatgagtagagaaagtaacctttgggaatcagggtaacaaaagtgtttgggtattcaacatggccgaatacttgacacaccatgaacagaaaacaacctttgaaggttaggatactaatagtgatcgggtagcaatcatgaatataacaatctttgaataacatggaaacaacaatgtctcgatattcaatatggttgaatacctaacacttctagaggatatacttcaatgtactataaaagttttatcaaatatatttttgaatattcgactaggccaaatacttatctgatatccaatataataagattgatctcttattataattgaagactaaatttttatttgcacaaagttacttgtcataactttctcaattgataacaattattataagggcgacaagatgacaacatgaatgaatatctttaaaaaattactaaaaaaattaatggcagaaaaaattcatacgaaagtagtacaaatcatgtatagaaagatttgattggatatcaatttgtaactttcacttataataaaatatttattatgtgccatcatattcacaaaccggtgaaatcaaaagcgtcataatattcgtaacaaaaaactattatgcttttaaaaaataaatgaacaagaattataataattgtaaggaaatgataataatcatttaattattgattatgttcaataaaattatttgaaaatttagtcaaaagcttaaagttgataactgaaatgttaacttattaaagatatggtcgatagaacatttcaactcatttctaaaaaaaaaaaaaaaaaaatattagctaaaaaatttattggattatccaataattaaacttagtagcttctaacattttttgaaagattacttgaagtagcattttttaaaatattatcttctaatttttagttttttatattttctttcatttttatccttaatatatatatcaaatttcttagttacatttgaaaaaaaaatatgattttattgtttattgttattttacactttttatttataagaatttataagaatttggtaaaactaactattgaagtaactcaaatgtataaaataacataaaaataaaaataattatttatttgaaaatgtaataggaaattagataaatatatggaagagaataaaaatataaaaaaagttaaaagttaggatttaaaaaatgctacttcaaataaaaactcaataaacactaaaaattattaaaaagttattaaaaaatttatttactaaatagttaaacaattttttcaatcaataaaaacatataaaaattaattgaaatatcttttcgaatataatataatcattattagctatgaaaattaaatttacatatgtgagatgggagtattagattattatgtggatcttctcctgccaatatcctctctctagttccgtctagtctttctatctctctactttctatttactttttcatcatttattttcctctcttcattctttttgagcttctaattttattttttgtgctggagagacaataggagcaagagaggatccaatttcattatgttagggtagggatggcaaaatgggcttggcccgtcgggccggcccgcgtagcccgcaaaaaaacgcgggctgggttgataatatcaacccgcaaatcaaaagtgggccgggctggcccgccccgcaaaattgcgggccaaacgcggggcgaggcgggccagcccgctgggcctatattatttaaatattaaatattaaaattaaataaatatatttaacatattttgaaataggtatatttttttaatttatactcttttgcactctcataattaacttctaagttttaatattaaaatggttatgataatgatactttcaaatagtttttcattactagcatattacacttttggacagtttataaccgtaaattccatttgcaaatggtataattttatgaattatcacatgacatcatttatttagcattaattttaaattatttacttttatttaactttgtgttttttttaattatcatatttgtatttttttataatttttttgtattttattttttaaattgactttttttatttttttttaatttttgatgcgggctggcccgctagcccgctggcccgcattaaagcggggcgggctggcatttgtagcccactttacaaaagcgggccgggccagcccgccccgcatttttcgcgggccgggccggcccgccccatttttttgcgggccggcccgtttgccatccctatgttagggtcgatccttgagcctaagtcaatggagtgataaccttgtattcaaaattgagaggtttaaaataattttagtttgggaagtcttaaattataatcatagtttgaataaaaacttatctttaattcaaatcacgattctaggtttccaatctgaaaataactacgacttaccagatatttattataaattattttattaacattatgaatatatataaattgtaaatattttagcatcgctgtaaagtgtaaactgtaaatttataggttagcaataattttatatttttattttttgggtgtgcattggaatgaaatctttcatcgatcccaaacaaacaaacaaacaaacaaataaattaatgaagaagaaaccgtacggtagcaggtagtagtccagatcagaccctgacgaaaataaagcaacaaaccgtcgttcacctaaactatctatctgggccttgtcggctggtgggccattggacccatagtgggccctgcaaggatattcatatctgggcccattcagattacacctaccacgtagtagtggttttgtggctgctttctctttttgattctgatgtgattacgagaatgagactataatggcaaaatcaaaatagatgaataatcatgccgccattgaaatgttgtgtgtgctatttgccaacgggtaaagttttgtcacacactactatttatacaattgtgatggcatggcactcgcgtgggaagggaatagagtgtgtctctctgctccccatcctcatttatcttcattcttaagctaattttgtttcttattatccattctccgatttcccatgcattcccacaaggatctcaacattgtaattataataaattgccaattatcttttaacacaatttaaattataaaaatatgaattaagttattaagttattatattgaaagcctaaaaacattatgtttgtccaaattgaactaagttttgattttttaaataaaatcttagaattgaatcctataaatatatataaaaaaattattgaaaaaaatatctcactaaaaaattttctcacataaaaattaatcataaacaaaattgatgaatttttgcacatataatataataaataaaaacattaaaaactaagagtacatttatatattatatgttaagggaaaaaattatatatatatatatatatatatatatatatttgaatttagaattaagatctaattcaattccatcaaactaacaatcaacatataaaaatgagaactacccgaactttattaaattaaaaaaaattatttacatttatgtcctaaattcgagatcttaagcataacaatcgtaacaagaatccttaagaccttaacccacagcacagaattgccgatcattgtttgcctccaactccaaaatagaatgatgaggcctaagaataacaatttgtgtatcacatcaccattcacattggaattatttacctaacaaccacacacataacagtaactctggtagctgtaaatctggaaacagacaaaaaaaattcttgcaaaatgtgtttgtccgaggtttgaaaaggtgcaaataatgccttagtaaaaaacactaggcaacaataccatctttcttaatatgttgctgacatcatgactgcatttttgcaatccgagagtaacaaaaaatgaaacaaaaaaaaattccaatgtttattttattagcaaaataaggcccgtaagtaaccttttacttttatgctccacaagtaaataattttaatgaaattatcatctatactttttatgatagagtatatgagaatcggtgacacaagtacttttaggtctcatttcatatgatacctttgataaattttgaatgtagtttagtgggctgtctgctatcttgcgtggaaatgcccatgatattgacaccctctttttgctctttactctctccactcttttcttttatattctcaaaatatccatatttcctctcaccttctcaaaatatccctattacactagctattaggttcatctatctacatacatacataactaaacttcaattgaaactttgagagtagtcgaatcaaaattttaactcataatgatgattgttaatctaattcagttatatagtctttatttcaatatttttacatcatcagatcgaaactttaacttcaacaatcattgatatgattcaatttatgatgcgattaatttaatcaattgaaatcttcattaatatcacataattaaaattaatatctttaaaatcattaaaaatattattttaaaacaattaactatatatatatataaaataaaaattatactatgtcaacaaatttaaaataaattttaattttgataataaatacatttgaaaattacatattaacatcatatcaacaataaattaaataattttttaacaattacatagtattatatattcctgtttattatttttatattatttttgaatttatatttttcatataagaaaaatagacttgaaaataaaaaataaatgtttgatcatgatttttctctcttaatatttattttatatattatttgaataaaaatatactcttaacatacaataaatagcaacacaagtgatttcgataaaaataaaaagataaaaagaagatttacaaaaatattttaagagcattttttttactgtatttttcattgactcatgtatatcatcttagttaaaaagattatattttcaaagtgatgcttatttgtcagtaaatagtaagatatataattttttaatcctaaaatttacaaaattgaaatgaaaattcaccaaaacatttttggtctccttatcagatgagtcaatatatataaccatgtcatgatgtcagtaacatttacaaagatttcggatcaccacatgaccatttccgaaaattagccataaatttatgtctcttcctaaaacattgccaacaagacaaacaagccatttttcctttgccatcccttgcctttttttgcttctggttattggtcgttgttaggttttgtgagacacaaactattattgtttttttttttcagtttcactaatcccttcaaaacattatttttacccattgttgccttacttagtcttcgttgcttaattatattccatttgtttgtttgttgggattttttggtcatattattgttgttccctgtgacggttgatgagttaaccaccttccctgttggagctgtttcaagttccaagaagatggggttcgatgaaaacaaagaaactggagagaaaagtgatcatgcaaatgaagaacattataaaagtgaaggcgagcccttgagcaggcacgtgagtgagtcctctatctatgcaactgaagatgaggaggatgaagttggatccaaattacaattgggtcctcagtgcactcttaaagagcaccttgagaaagataaggtttgtttctctgtgtctgctgaaatttatcgtcaggtcatgtttcatgcttcattccttattgattaattttcttttccatttctttttttgaattttgggattaatataggatgatgagagtttaagaagatggaaggaacaactccttggaagtgtggatgtgaacaatgctgcaggtttatatatcacttaattaatttttcccttaattataagcattctttttttattgtattcagaagaatcagaacacattagacatttgacttattctgttcaagttggtcggactattgcgcaagcatgaaagcttataatattcaaatttacattatattttatttctaaaattaatataaggctatgttattagttattactgcttaattaataataataataataataataataataataataataataataataaatgtaagtgttgacttatgcaactacaggaagattaacatgaggaacatgcaaattggcattttctgttcatgtaattaacagtttgagaaatcataatattcactataatccattaaaacttcaaaactagtagttgggatttttgttttgtgaacaataatcagaagatttcttttatttcttttatatgttctttttttctaaacctgtatcaattattacgttaatctttttatttccagaaattctggaccctgaagtgaatattacttgtttgtctatcatctctcctgatagagatgacattgttctttccattcctgaaaatgggaatccaaagggtttatggtttactcttaaagaaggtagtcattaccgcttgaaattcaccttccatgtgagcaataatattgtgtctggcttgaaatacaccaatactgtttggaagactggtgtcaaaggtaagttttttttttttgtgccaaatctatttcaaattaattaaacttataaacatgcaaaacttgatcaagcactctcttacaacaattctaatttcagtggatagctcaaaagagatgctaggaactttcagccctcaggcagagccttacacacatgagatgccagaagaaaccactccctctgggctatttgcaagaggatcatattctgcaagatcaaaggtaatattacttctaaatacgttgaacttgattgtacaaatatacacatgcactcacacacacaggttcataattggattatatatattcctcttaaatgttgcatagaatagtcacgacggctcactatctgcctggggtgtggggctacctattattcattcgtccctttaatcactactatacttgattcaaagggttctcaatcattttattcgaagtttatcatggttttgtcatttcagtttatcacttccataattttccatttacttctttcattatttcctcattttttgtaatgtttctttattagaagtaccatattgtctggctttaatttaatatattctggtgttagtttccttgtaaatggattacggtcagtagtggaatcgaggtttgttggtcaccaacttcttgtgttgttcttaatagtatatattgcatatcatcatagtagtaaaatttgaagcggtgcttcactgcatactatgggatagaataacatttgtattttcttctattgttgtatgataatgaattaatgatacaaccatatactatcatattttttctttttgcagtttcttgatgatgacaacaaatgctacttggagattaactatacttttgatattaggaaggaatgggcttgaacgaagatggcaatatacccaatttgcatctgcaatagtaattcttattcattttgtcaaatttctattgtattgacttgagaaattcagatatatgttaggtactaaattcatgtttgtactaaaatattttttttttggtattgactaaaatagacagaggcaaagaagactcttttgtaactttcccaataaaagttccctagttgtcaacttctttagtttttatatctcttcttagctgcattacttttgccaatctaaatttgggacacaataatctttgtgctagtccggttgcttgagttttgaatgtaatttgaagtatgtgggccgggcttttcaaccaatgaaaaatggaaaaataatctattttattgggctactaaaattccggataagcaaattcataagagaaaaaaagttatattacagattaacaaatccgcaaattagatctgataaaaaaaagtgcaagaaggaggaagacacaagaagggaatgaagggtgagatataatgggggtttaaagtcgaatgtgcaggaaataaggtttaagagaaaaagaagggtaatttgggaatactcaaaattatgagggcgcaagatgtaaaaaacgagaaattgaaactaagtaagaagaccaaaattgtattaagtttttcttgatgggttaggttggaccatcaactcttttaaaaaataaaattaaataaataaattattttatttgtcttaacttttttccaaatttgattttcaaatataattaaaaaaacatgttattaaactagtaaatcaaataaataattaaccaataatcataaaaaaatataaatgttaaatgtaatttaaaagattgatggattaaatgggttgggttatacgagttacgaaaatcccagtcgaactcaacctatttgaacttattatataagtcaaattattggatttaactcgttttaacaccataatgttggtctcttatgaccgatgtcttattttttaggctagcagtactcgccttatccatcggtagttaccgttttctaaccacttttgttacatttgctgattaaacttgaatacataattttttctaacattattacagtccgtttttttatagggaaacattgctacagtccgttagaattgcatctaatgatgattttctagacaggttagtgtcttggaaaatcaaaacgtggtcctatatatgccttgatggttacacaagcctaatcaatcaatttaataaatcttgagcactaagcctattacaagtcttgaattgacaacctacaaaagattattcaatatgattttgcccagcatccataatgtccgtaattatatacatatggtatacggaaattatgagtaatgaactttaaccataagcataagttttaatttaatattatggaacaaaatttagttagttaaacttaacacaatttttttcctacatcacatatatcttacaaaaagtaattttatttgagttgaataatatcattataaatgataaaactcttccgtaatttcatatttaaaaatttaacttgaggttttttattaaattgaaacaaatcctcaccagttaattcatgtgttccatggtgacacaaaaaaaaataattattgtgaaacaatatagtttgaggacttaaagagttaaagagaaatgcaaggaagagattatcaaaaaacttgatctatcattcatttttcatagttatggaagctccgtgcattttttatatagagaaaacaagtttattttatttcatgctagtcaccacatctttgattgtagtcatgtgcacttaatagttcatatcaaaggtaaatgattattttgctccctagatatataaattaatgacaatttagttttcaaaagaataaattaaatatgtaaaaaatataataattatgtattattatataatataatgttaaattgattcttaaaaaatataaattaatatcaaattaatcttttaacgttaaaaaagttaacgacatagagttacacaatttcaagaattaaacgataatttaatttagaaaaaaaatacttttccattgtaggttttggggcatgtgaacagcatggtcggatattagcattgccgcattggtatggagggctaaacgtcagcttcatttttggtgatgaaaataaataaactagaaatgaagtagaaaccatttatgtatgtcggttagctagatgataaaatggggagatggaaaatggtggggtagagtgcaaggttggtctatgatgggttaaagaagtaatttagttaaagcggatatggaaaggccaccatacaaggagagaaaaaagtgtgttccagagaagcattttccattaaagtataatatgtcttcaccaaagaaccaccctcaagttagaagcatctctttgctgtagctgtagccaatactaatacccttccagctggtatacgtaccctccattctatctttatataccctccttccattctcattcctcgtccttcacattctccttctctctctctgaattcctcttattcatgtctgtgtgctcttctatctcaatatctttcctttcctttaatttacttttgttctgaatgtcactcaatttatggttaggtgcaaacttttagcttttcttgccttttcacatttgaatatcatttttgtctcatgggtgcttgtgattttggatcagctagtctagatctgtctcatttcattatggggttcatgaaatcatgtgaattctgtcactgtgtacttgactggtctaagtctaactcacctacgtttggcttgggtttgacaacaagttagaaactttgtgaggaaaatgaactagtaatggattcattccattggcactggttgggggtggatgattgatagtttcaaaaaagaaaatagaaaatctttcaacattcatttcattaggtgtctgtctgatctcgaatttagcatttggaaatttagtcttctgggagttctgaatttaacatttttcagtagtgtgaagcaaaagtagtacattttaagtgttattcgcttctatcaaattgttatagtgttcatatcatactcggatctgcatttccttctgcttgctctggttcaattcgcattcatagatcttaccttgtgcatttcatattctgttgaatatcttattatttttcttttgttcctctatgttaacttttgtaagatctggttccagccattatgttagtctattattagtaagatgttgacaactttttactgagatgtaaagaaggttaggtaaaaaaaaaaaattgaggggtttatgattttttatttattggagattgagtttgaactgggagttcattttttattcccgcattatttaactttttcacaggttggtaggttttgttatgatgagatctaaccactgtggagctcttttcatacaggaatttggagagactgttgatatagcaaggtaggataaaccagtggccaaggaagatatggagttttctatgattttcattgttagcaacattatgctgcttttcagttcagcatttgccaaaactgctagtcctccctctctgagcccaactccagcaccagccccggcaccggacttcgtgaacctcactgagttactcagtgttgctggtccatttcacaccttccttggataccttgagtccactaaagtgattgacactttccaaaaccaagccaacaacactgaagaaggaattaccatctttgttcctaaggacagtgcattcaatgctgtaaagaaaactaccctatccaacctcacctctaaccagctaaagcaagtgatcctcttccatgccttgccacatttctattctctggcggagttcacaagccttagccaaaccagctctactcccacatttgccggaggggattacactttgaatttcactgataattctgggacggtgcacattagttcaggatggtccaagaccagggtgagcagtgctgttcatgccacagatcctgttgcaatatatcaagttgacaaggtgctactccctgaggccatttttggcactgatattcctcctgcacctgctcctgcaccaactcctgatattgcccctgctgctgattctccaactgaacacagtgcagatagcaaagcatcatctccatcatccactcatgatggctccccttctcacaagctcatcagctatggaatctgggccaaccttgtcttggcaacttttggtgtgctggtgctcttctgatggcactcttccaattgaatatttaatttagattatgtttatgtatctacatttggtgccacttgctttgatttgaatccatttttttgaacataagtgttattcaatgtatgtatgaatgtgatttcttctattatactatttttttgttaaatctcatagcatgcggatgtgatgttatgtggttgtcatgttatgactttatctacctttttttgagagttttaatgccgtcacttaaagttaaagtctattccgaaagttgattttattctctaaagggatgtttccggaaatcaaatgatttacaagctctttttacggtagctgaaattaaattaaagatgctgattttatattggaccttttaacgttccagctcctgaagacccggtattttccctatcctagtggcatgtgaaaggagatgccgtttagaaaaaaaaataatcaaggatatatttttttcaatccagatcttgtaagtattattaacatttttttttgggtctttgacagctttttgggtgcctagcgatttcataattcaaactctaatatttacaaaaagttttttggtccttgtaagtaaaactcgcacggtgttgaagtcttgaactcaatttccaatgctaccttgctctgttgggtttataaagcctactgtatttgattgatacttcctcgacgaaaaagaaatgttgataattgtgagttgctacagtaattttggccaacaaatctttgcaatgtcgttttcaaaataactacaaagataattgaaaattggttcaagtatgagctagacgactttgtttcacctaatcagtacagtttcactcaggcaggcacaattccaataacagttatagtggagacagaagtgtatattaaggtttttatggtatctaagattgatcattaaaatctatagcattatggtaattaaggttgatcatgattcatgaaaggctatagctttatgttatgcgttgagcttttttcaatgatacgcttcttgagatggaattaaatctggctttttgctgagttaattttgaagtgtatatattcctttgctctttacgtatgccttaactcttaagagggttgcacaaacgccactgcatcaaagcattaatattaaagggttattatggatgcctataaaattagccaaagttggtcttccggtctcctcccatcttttctttgcttgctaatgctcactgttttattctttttggagaactggatgcatctatcagtcaaatgcaaatggggtttggagtttggacctttactgttccagttggactccaggccagaagctgagtaaagtaaaaacaagattatttcagaagtatttgtttcagagggatcggacctagggaaaataataaaatttattcaaatgaaagtgacatttttgtaattaaaaaataataataaacaagattattatcaaattggtatagtttagtggggaagatcatggatcaatttccacataatacttttttgggaaggagtgatgatgagcttgtaattaagtctcggatcgaaaattagtcttatatcatactcaaaatgtcaaagtttgtgaaatgcctggggattctaacaaaatgatttttttttctaattatcatgattacaaaaaaaaaatgaacaactccttgtttgattagtttgtaaataaaaaaaaaaaaaaaactaagttaagaatatataaggttagtccaacggttgaagaataatgaaggaaggggggacatatctcggattcgaatcctcaaactgacatttttgaaaaaactaacaaattaatatttattgataaaaaaataaacaaagttattattatgtccttcaaatcatgaataggatttcaagtattaatgtggtgtccatttccaacaatgaaacaattttgagaggatagaaattagtgtttttggtttgatagggactataaaggtgagaaataattttaaaaataatgagattcatttttattattattttacctatttttactcatctctttatctctttcatatttctttttaatcaaacaactttatttcttacatattttttcttttcttttttatttctatctacactatttctctcctttcaactcaacataacctaaaccatgatggcttttttatcaatatattttaaaaaaattaagtctgctttctttttgttgagatttattttatctgttatggtttgcttttgttttgttaataagtccctatttgatttgttaggaagtatttttataaatatagccgataaatttatgtgcatgattttgaaggaaaaaaataagagaaaaaagcaaaataaatattgaaatcttagaaaaatagatagaaactagtagaatttgagtttgcaccaaatttttttttttgtaaatattgagttttaagtagttttgttaacttttgtataaaaataacaatacattgtctttgttttggaatcaagaatttctaataatgttttcaactttaatcgtgtaagaaaacaaatttttggtgtttaaaaatgctgaaaaggttaaacgatgcactgttctagcatcactattcactagtatatcaattcccaaatgccagttaacatcctagacgcttgaccaactcctcgaactctaattgcaaaaaaatgttgaacatcgatagcgttccagggtccctgatgctagcctgtgtgggagacactagactactagcaaaatcacaagggactaaatatgttattagagaaaaaatatagagaccaaaaatattattaaaaaaatgtttagagacttaaaaacaattttttttaaaagtttaaggaccaaaaatattaaatcttactttgtaattgaactgttgttcatttaatgaaagttttattcatgagattgagtaatgtactctgttctcaatgctttcttgcaactaaccattgatgagatttgtcttaaacgtgtgcatgatgagaaatcatatatgtgtgatttggatatgtccttatattcttaacaactaaatatttaatacatattgtgtctctttggaggaacctttataacttaactgttgtaatatctttttgcaggaacctaccatttttcactaaaaatctcgtccatgctagaagacacatcgcttaaaatctcaaattgtagtccactcaaaagtccatcttggctaacattaatcagaattcaatttcgttcagtgtcatcccaagcatctaatccatcttatatattagacaaattaatagtataagtgactagtaaagaagttaaatacttgtacaacttcgtgtgaaaaacttaacattgaagtaacatttgaaaataaaaggtgtttttaatgtcagttagatagatattaaaggtcaactagagtaaatgtcaaagcggttgcatgtgatagttaagggattggaccatacatgaatggacctagagctctcacgaggttggctatatttcatttagaaaagagttgaccttcctttttatgatgcacaccgttctatttgtgtgcaatttcaactttttaactatcttcgtcgtctaagtataacatgcttcatattcaacatgacatttaaaaataagaaagttttggaaatgatggttcacatttatataaaaacataccattaatgaacttaaagtaaaaatatttttattaaaaaataaaaaattatgttattcataatatttctgtgttttactataatttttatactaaatgttttttccttttaattccaccaatattataagaacactaattaactagattattaattaataatacatgcataataacttataatttaatgtgacattgtcttgcaaatcttccatataaaaattcttattattttataaattatatgaaataaaaaaaatgtatttaatatcttgaaaacttagaaagtattcaatagttttttatctaataaataagaagattaataggattttcttagataagaattaaaattgttattttctttaaatcttgtatttggtttgattgcgatgaaaatgaactttctttttattgtttttggataaacagatacttaaatatcttcatcttaaagataaacgtgcgaaggttaggtatggatgtatataaaggaaagcggaaataaatgtcgttactgagtctgagttcggaattttttttaaatgaattcattggattgcccttgaaccgaaccttactttatggtaaaatatagcacgagattaagaacattacatatatataattttatataataacgacgaaaaaattgtagaaggcgatgagatattttttggcttgtgaaaaagcaacaaaatagataaaaacaatacgaaagcgaaggaaagaggagtgtggggattctgaattgatgccacatgtcattcttgtttaatatatatatatatatatatatatatatatatatatatcatttagcaattagcaattggcacttgcaatagcatagaacaaaaatttaattgatgtatcttaattgataatatacgataaatttataagaaaaaatttgaatttgattttcataaaatacacttttatatagagattatgaactttgactaagtcttaatgaaaaattaatttcataactaaaaaaaaaacaaaatttatagaaataacttaaaagtatcattagagagtctaacgagtgaaagaaagaaaagcattgtattggtaccgtttgattcgatagtatttgcgttgcattccctttcttcgcgggtcctttcgtttttttctctccaccccatttcctctttcgcacaatcaaataacacaagcctctctctctctctctctctctctgaagaagaagaagaagctccacgcaaatacaatgacgaatccttttgatctcgctctccttttctgactttcttagggacgttttctcaatactcctttctcaatcgcttcgtgccagccttgtcgcaatctactgttggatcggtgtaatttaaatattcacgcatcgttgatttgatttcaaaacaaatgtgttatctctattggcttataaacatttgatttccgtgtgttgttccgagtgtttgttgtttttctccaaccgagtcgaacatgtctagtttcgtcggtgtccttgtttctgatcaatggcttcagagccagttcacccaagtcgaacttcgaaccctcaaatccaaggtatgtttctttcttcctctcttctgatgttttttttttctcttcgacaccacaatctcggactcagaacacgcattgtgtatgtttgttacgttctttctagtatgtgtcggaaaggactcaatcgggacgtgttactgtcggaaatttgccacctatttttaagaaattgaagggtttctctgaactgttcaccgaggatgagattaaggatgccttggcagagtcatatcagaacatggatgaagagattgattttgagtccttccttagggtgagtttttgtttttttatttttattttaccccctgagaagttaaggcatggtttctgaattcctcctatgtgttcatgtgtttcttaatttaacttttactgtatgtatttagaatggtctgtttattgctttctcaaagaaattattggaaaatatacactacaatgtcatttgatgttcatattgcctggactcttcacatatatatgcacctaacatgaaaccgcgatttgtgagtacttttgtaggtattaattatatttatattggacctagcaacttattcagtgacattggatggcaggcacatttgaatcttcaatcccgagcaatagctaaagatggtggttcaaaaagttcttcttcattcctgaaggcagctacaacaactgttcatcatgcaattaatgaatctgagaaagcttcttatgttgcacatattaacaactacttggctgaagataaattcatgagtcagtttcttccaattgatccatcaacaaatgcattgtttgatcttgcaaaagatggagtccttctttggtagatgttcaggactcaatatcagctaattaaaaaatattgtctcccctttttcctccctgactttgttgtttattttattgctgcagcaagcttattaatattgctgttcctgggaccatagatgatcgagctattaacacaaaaaaggttcttaatccatgggaaaggaatgagaaccatacccttggcctcaattcggccaaggctattgggtgcacggtggttaatattggtacacaggatttaattgaaggaagagtaggttcaatccttgtttttcccctctccatgtttccagtttcctttttttttttatttgaccgactttgactcatttttgaaaattttcctgtttggttatttgtagccccatctggtacttggtttgatttcgcaagtaatcaaggtaaactacggaaacttcccccccttttcttgcttaatatggaactcagatgaggaagttgacaccattttcattggtaagacatgtaaacttttgctgtcttttttgtttgtttaactttttattatggtggcaacattagattcaattgttagctgatctcaatctgaagaaaactcctcaacttgtggaattagtggaagatgacaaggtgatattggataatattattcctcttatttgtaatttacatgtacaatggttttctttcctttacatatgtcagaaacgtgattgaaataaacctctatattatatttaacatgctggcaggatgtggaggagcttatcagtttagcacctgataagctcttactgaaatggatgaatttccacttgaagaaagctggatatgagaaacaagttacaaacttctcttctgacctaaaggtgagggaaattcttactaactttgtatgctgacttactctaatagaaataattctggacatggatgaaatattatccagtattccttattaacaaccttttattatacacaccactgccttgatttttgtgccttttaaatcagtaaagaaactgtggatcttcgtgttatattctgctggccttgacaaccatctacaagtttcaaaggaaaagattcactatatttccctacatcatgccaattgctgaatcattgtgtattcgaatccctccactaacaaaaaggttggttgggtggtaaaaggaaaagaagggaaggaagggaaggagggagaggtcgtgggttcgaatccctccactaacaaaaaaactaacatttaacaactaacattggccgatcaaaaaaaaaataagttgtgtggctagttttttatgtgcatggcatttgttaagagatatagtataattctaagttgcatgagtctattatatctacaataatcttcttttcgcaggatggagaggcttatgcttacttgcttaatgctcttgccccagaagtggcaggtccatctgccctaaccacaagtgatccaacagaaagggcaaacatggttcttgagcaggcagagaaattagattgcaagagataccttactccaaaggacatagtggaggggtcacctaatcttaatcttgcatttgttgctcaaattttccagcataggtatggttctttttaaggggttgcaaatgtgctaattatttcattgtaaattcatacaatataacaataagaatcttttgggatatgcttccaagaacccatgctgttttctgcccttctatgaatttggataggtgtggctcctatatcatataacattgccacttaagcttatgcattttatttgttatgattatccttaaataggcctctgagtaataactaataagtaatggatctcactggtttgattcatttgttaggtacaagtaagtagggttagtgaaagttattaagttagaaatgtatacagtacagggtggatcttgagctgatttagattgtgagtttcatttatatttatccaaaaatctctgttacttgtacttttgtaggaatggccttacaacagttgacagccagaaaatgtcctttgctgagatgatgactgatgatgcagagacatctcgggaagaacgatgctttagactatggattaacagtcttggaattgccacttatgtcaataatgtttttgaggatgtcagaaatgggtaagttttccactgttcagttggctcatcatctgtgtcttccattttcttatcatttttgtttttaagttacatcttcttttgaaattttccttgatcttaactactggttatgattttcctttaccgcagatgggttctattagaagttcttgacaaggtttcacctggatctgtcaattggaagctggccacaaagcctcctataaagatgccatttcggaaagttgagaactgcaaccaagttataaagattgggaaggaactaaacttttcattagtgaatgttgctggtaatgatattgtacaagggaataagaagctcttattgggtgagtttcattttttccctgctttgtgatgatttgttagtgctagaaatttgttatgattgtgtggttggtaccctctcatttaacatctgctttaaattctgttttgtcctcattcattggatattttgatgggtcaacacattattttatgcttctacactatagttaaatctgccatctgaagataatcaatagccaggatatgttcttgagatttattaccgaggaatatcagaatattctctgtggtgcatattcatgttatacaaatcaagatatataatatatgtggtacaaaacataaagctctaacccttatttataataatacaatgactggatgctactgaggattagtctcatggctttcgactatagagataccttgctttcagcaaaaaaaaaatagtaatacaatgatcatggtcctaattaaacaaggaaacaaatcttgaaatataaggaaatagggaaatgttgagaattgagataatctaagactctaaattactcagatatacagtgaaaataggtttttaaatatgtttttagttcaatatttttgcaagtttttttttggtcccaataatacaaattttcatatttctttggtcccccaatgttccaaactgatgacatttggtcctcgacatcaattggggtctgttaaatgttgattgatatatttgtctcgtgtggctatagaagatgcatcatcagttttattgtgccacgcctctccatcccaccctcttgcccttcgcatgtgaactttgaacaaatccctcacttgtcaatgtatgaaaaacagtcctcttaaagaaatcttcacaacaatggcctcctttttttactgtatggaatgcagttccaacctaagtcttaactccaccaaacttctacttcgaggtcagcaagaagggtgccatttcattttttgtggtggacgccaccaatttcaagttcgaaaaggaggacaagatctgaactttcttcaagactgtctcagtgtctctcctttctccccaccccaataggaagatcgattatcttatcagattgataggattcaacatttatttctgatccttcaatgaacgaaatagttgaaaaaaaattggaagatgaagtgtaaaatatggaggatgggcagttggataaaataaagccatgtggcaacacaatggatattggataaaataaagccatgtggcagttatggcttggctcactgttagccacatcatcttgatagttgattcacttaagttggggactaaaactacacactctagaataatgagggaccaacacatcaacatcaacatcaacatcaacaacacctttaacccaagttaattagggttggtggtagatgaatgagggaccaacacgatagaaaaaaaattatgactaaaagcaaaaacatatattattggatatttctcttatattctaacatttttatttgtcattattttgttaaaaatatgccccattatatgtaggaaatattcatctctgttttttctctgtcctcagcatttttgtggcagctgatgaggtttactatgcttcaacttctgagaaatttgagatcgcactcacaaggtaaagagattactgatgctgatattctaaactgggcaaacaataaagtgaaaagagcaggaagaacttctcaaatggatagtttcaaggtatcaaaccacctattgagagttgtgtgtgtgtgcgtgtgtgcttatatagttcttgctactcttaattttacatttatttataacagttatcagtcttaaatatttgtactgctcatattgggagaaaaatcacaggcatctgttatcaatagtactaaaagtaattttatttaggcttttgaatgaagaaaaggacttttcagtgttcatgatgattgctttgatgttggactacaactcattgttgatatttatgtattgtgcttcatcaggataagaatctttctggtggcgttttcttccttgagcttttgagtgcagtggagccaagggttgtcaactggagtcttgttactaaaggggagactggtatgtcaactctgtcattctattgagaaattgtgctggctagaattctgcttgcaactctttaatttcacattacgcattattatatttgacaattgacattaatatgatgagaatatgttatcttatgagcaacaattgaaatggtcaaatttatgtcatatgaattgcagatgaggataagaagttgaatgcaacatacataatcagtgttgcccgaaaactagggtgttccattttcctgttacctgaggacataattgaggtatgtttgtcgatgttaaacataattttgttggtaattatgccaattgtctatgaaaaggggagtatggacttaattggttgaagtttgtttccaatagatatgcttttataggattagaaattgatgatgtttctgaaatcttaaaattggaatggtacgttttaacaattgatctggtggatataacggagagtttgtcatttattaaacataaataatgtacatggaaaagcatttttcttctattatctaaatatatttgttcattgagcttcctgcccacatacttcactaatcttgcatttatttggctgagaaattttgtgtgactctaagcttattatgcatttaaccttaacaggtcaaccagaagatgatactcattttaactgctagcatcatgtattggagcctgaagaaacctgaagaaaacatcacccctgaagcatcgcctaaagcttcagtagatggtgaaagcgatacagatgtagttgacgaggtatccaatttagcaattgatgatacaacttcggagaatgctagctcttctttaagttagtaaggttgaagcaaaccatactcaatggagaatgagcgggggaaaacacatttttgtttatagggcaaaaggaagatgtcaacctcttggttcccagttcgaaagaaagcttattgttatgagaaaccacagataatagaaggatcttgtaaattctttagaatttttttgtacttaggcatattctttgatgaaaattgcatgcaaaatttcccaataataatgtgggaggaagacatcgttttattttccgtctgattgttaagattattcttaatgcgtgcatacagatacgggttgaagtataatacatgtagttgatgctatggcaattggagatcttcatgccaacttttttgttttcctcgaaatgcagatttattcttggtttcttttcttaacttggttgtcagtatagccagcagaatagtaaaattatacatccactcgcataaaacaacgcaacaacaatagcaaagcattttcttgctagttggagttaactatgtagcgtaatgttttgttaatcatgtttataaacaaattattgaccacatctttgaattgttttattttatcatttttcttgatctcatctttagtgattcgactatccttcatttgatttactttcctcattagaacttttacaagtcttattcacacattcaaataattaaggcaagtttctagtgttctttatgtaataagtgctatcccgactttttattgcctaaaattgacctgtgtattacaatttctttcgggtaacacctttttattaaagataacatctcaagtagttattcatttcatccatttcacttaaatcatttgattgacatctcctatataatatgtttttggatatttttaaaatcacagtgattatctcaaaactacctgaaaacaagatttttccaaagcaacaatttgttgcttcatatttatagtcaaatcaaaattgattttgattcatcttacaaccattccaaacacactgttgatgagaaatgttgacacatgtcgaacaagtatcatataggaaaaaagtctttaaacatccaaaatcaattgacagtttgagagaaatagagagaagaaagagaaatattgatatcataaataatataatatgataagaagagagagataagaaaaattaatgttattaataaggtgtttaatatttaaaaatataaaaattcaaataagtcaaaagagttgtacttgcttcatatatctgtaacagtaattatctaatattattataaaaatacaaatattttacccttttgttgatctttgcaactttcttcgtccgtcattattgagcagaagtactgaaccgatgtagatggttggtccaaacacatcaacatacaaattcacgtttcaagaactgataacaaaataattggaaactcacgtataaacaaaaaaataacaaattaacatatatatatatatatatatatatatatatatatatatatatatatatagcaaactacactcagaaattaatgtcatcatctaaactcatttcatatcattgtaatcaacgttgtcgttagatgaaaagtagtaattaagtccactatatgattttttttttattattattatgatcatgctagtgaatattttaaatatattggttaagaaattaatgaataaaaaggttttattagaaatcataatattaatatgttggtaatattaaatattataatttttttaataaaagattcatttttcattctttaaccagagcattattgaagtaggtttttttttttttttgttattgaaacttgaaatactggttagcattacttgttatgataattaagacaagaatttaaaaaatcatagcatctttgaagtaggcaatttgattgccccaaagtaaaaaaaaaaaaaaaaaaaaaaaaaaaaaaaaaaaaagaaagaaaaaagagaggggggtgcgggggaggaattgcaccagaacatgagtacatgactagtgaaagaaggacgcaatggcaccgccttgaaatccagctcagctgtcatgacgcgttaaacagcaaaataaaagttaaaacataattttaaaaactctaatacacaattcaaatttcaagatacaaaagaagaaagaattattagttaaaattattatcattgacctttgcgctggtttggttgggggattaggcttacaccaagctgtaactttggctagatagcaattctattaatatcaacaatataaatagaattacaactaacaatgccacaaatttttaagctatatatgttgaaaataaatactaggaataaatatagtgatatataaataggtcatcacttccaagttttgtggctgttatgcaataaaccaaaaccaaaactgactcatgctttgatattggccagtgactctagcagggttttgctcatcccaagcttcaatccaactaaaaatttattagttaaaaattatcagtcaaaaatactttgaaattagttattccgcctcaccgcttacaactcatgaacccatcacaacattttcaattttccttccatgctcaaccaaccatacaccacgtgatcgcatttattcatacacaccgtaatacgtcattttgatatttcattaatttcctattcagccttggtaaagcaatagcgatttgatattcgttatgatcttcttcttgtcattgaacttaccaaatggcaaatgcaaatgattcctgtgtaagaaaatgcatttaagttgatgtttccctttcatctttaaccaaacattccaattaaactaatcccttgaatcaagaatacctattgaataaagcacctaagtggcgacttgcaaccaaccaattaccaatattaagtccattatccattagttgatgtttcaaaattttacaagcacttggcattcttaattttaataattaaacaattaaaattatgagttttgccagaacttcaaaaattcatggtccaaaggcactaagcaagagaatgtaattgaacaggctaaaaatgagttgggcattgaagtaccacagcagtgaattttgatgttgatacacattataacattaaattaataagtttatgatgtgtccatatccaaatttacactttatgacctacaaacatcctgccccgagggagataagaatttaaggtaatgcataaattctgcattctgctcgaggcagcagaggacgacatttagagagagcaacgtaccaccccccccaccaccaaaaaaaaaaaaagtaaaaaaaaggacaaaagagcaaaatgctatttgtcctccattctaagggaatttagccgtctgatcctctgatccagctccttcatcacttcaggctcttgcttcttcctttgctttgatatggtatttgttgtcatggaacctatcttatcaaatgccacctgcaaacataaggaaagtttaattcaacaaatgcatcaaaacttcttgtgacaacatggaaaggatgatagtgcaaatgacaaagatatgaaatagtgaaagttgtcttactgtcaatagatcatctggatcaaataggtgatgagtggtaatctgcagaatattgattacttcgccaacgtgatgggttataactaattcatcttccttcatctgcaattggggcgacaattgttgaaacatcccttccaatgtagcaaactctttctatattttgtgtgtttatcaaaaaacaagaaagatcaaaaaggctacactagtggtaccttaaagattgccaaggccacgttaaatataaccttagcaccctcatagaagataacatcccacacgcgaagagttgtctgattcatggaagaagtattagtatgtggaacaatttagcttttcaatgaataatttattccagcactactctaacctcagaaggcaggcttttcgaaaagaggcaaaggaaccactcagtggtaacaagggaaacatcaaattccaaagcttccaaatgagtagcaatcctgaatttccatttctacaattttcagaagatactaagaaacaaacatatgatacacagttaacacatcaaataaaattaccttggacactttttagcaagtaaatctttaaacactctttgttccacgtggcatccagacaaattgtttgtgtaacagtcgttaaccaggacgttttccaacaagacagcaagcatccaaaatgcatcttcttctgtcttcatgacaagcaacaacaatgctgcaacgtaatttaatccctggagcaatattatagtagagtcaatatttaagaaaatatgttcccaagtatgcatttaattttttttaattttcaagtaaaacacatattattgtcaaactttgtggcgctatattttacctgccttaaaaaatttaaaacatcaaatatagtggctgaagcaattgagaaaaacaaaatgtaggtacaacataaaaactaatccccgctttagtcacaccatgttgttaattagttagaaaggaagcattcagaggcctgcatgttactaatagaagacagaatatctaattgcagaagaaaaagaatagaagcagagttgattgaatcaaagagtaagccacatcgtctcaaaaaaaagacacaagatatttcccttcaaatacctaatacctaatacctaatacaagacataggtagtatcaaatttcaatttaataacaaatcagaacattgtctttcatgtactgagcagggagtcaaaactacaaatgaaaggccagagcaaacccacctgacaatacccaacatcagaatcacggaaagaataggcaacaagaacacgcctgagagcagcatgtccctcgggagtgtccagccatgggtgaccagggaaggttctgggtagatcctgcaaaaatgcttatagaatgattagaagcaaaataaatatatataatgaacaatgtaacatgtagacaagttcaaattattctcgaacaaaaataaaaaaccaatcaccattttaaggatcacatcaaacaccctgatgtcaaaccgtatcaaataccaccccaatttacaatttctttctaatcagcatttactcaaagattcgttttgcctaacctaaattccatgcaatcaagaacaaataaattatttaaatgggatacgttaatatggctaacagaacttatgattgtaaaggttacaaacacagggataaaaaatgcttcaactcttagatcttccttaactctccgaatcattcataaataataagtattgctcattggaagaaaaacaaaaaaaaaaaacacccacaatcatccatcaaaatctgcagcaaaattttgtctgaaaatcttttcacaggtcacacaatgtaaagtctagacaaagtaattcctgcatcaaattcatttgaaaatgatccacacacctgcaagcactagtcaaataaagggtgatgcccacaaccacaattatgaaaattgtaatcaaattcaaaagcaaacccaatgtgtgatgatcatgaaaaaaaaagggggtgagttgctcacatgatctatctgccgggtagcaggggtgaccttcccgtccactgctttggtcaaatcatcataataactgtcaggcacggtggactttttcttggctgcccctgacaaggaaaaccaaatcttaggcctaagaactgggggtatccccttccttatcaacttcttcaaagttattgcattagccagtgctgagaatttcaatgaagatgtgagggcactgccttgccctatggttgtgtgcaaataccaatttgcccctttgctggcctccaatgcccaccaaacccttccctgttgcctcaccttctcccttacctcattcaacacattcacatcatccacattcccttccactgtgaacccataaaggtcttggaatttcacagtcagatttgctcttctggaatggatactgggcctcaaaactgcaacttgggattggtattcaaaggcaaggtctattttgcttttggttccatacattttttcttgtgtcagatcaagaacgaatggaagatagccacaacgaaagggggtttggcgtggcttcggttttcagacaaggttgtcttttgaattggaaaaggaaagaccttgtcaaataagaaaacttacccactagtctgaaaccgtgaaatggtccattttgtggacctgggtgcttgagattaggtgaggagaggctgcaaacaaaatgggtgaaacaagatttggtgaaacaagggttggattcaaaacatataacaaaaggggaattttttttaaagaccctttacgaatccccaggaagcttgagactttgatgtattaagctcaaaaaatctcttctgtgagtctaatgaaaacaattaataaatgtgaaatgggggagggaggggtagggggttgaatattcaggtacagagagataatatgagacccaggaaaacaaaagtgccaagaaaatggggaaaaaagaaaaagaaaacaggaaaattacagatccttcaagatggatgtaaaatacagagaggaatgatgaggaaaagtgaagtcctgaaatgggtaataagagtgttctaacaaaagaatggactagaaagagagggacaagaataaaacccagaaatttagggggcaattttgcatggaaagagtgtaaaaacagaacggagaaataggctgatctgagctggtgggtggctttcgctttgctacatacactcggctttttatgtggtttgatttttcggggactcgtttaaatttcacctttttcatatattaaaaaattaaaagaattagaacgttaaagaagatattcatgatgtttattaagttcatgactgtctagtcaatcaattaaactgcataattgattattttgtttaatatgttaaatgacttaaatgtactttttacatttctactttttaagataatgtcttattcttgaaacttctattttgcataattgcatattctattatttatatcaatatttattaaataattaaaaattaaacatataactctgcataaatattaagagtagctcaattagttgattaagatatgtaaattattgtaatttttctcatacctatctttaattcttacatatttaaaaaaatttaagtaatgatagtttataattagatgatcttataaacaaaattacattatttatacatatattatttattcaaaagataaatattcttataaattaaaaaattaaaaaattaaaagaatttaaagtgaaattctatacaaagcatcattcacaaaaatatcgccaacaataaaaataataggtgcttgtttttacacaaaaatgacaagtattttatagatgttacttcacctgtcttattaaaattgtcatataaaaagaatattaaaataataattattttaatttttaatataatatttattatatatttttcatttatatatggacaacaaaaaaaaaaagattattttataaaattattaaacaatactctgtcttgttaaacaatacttgaatatcaaataattgtttaataagccaacaattaattatagagatgttttcttttatttgatattcaagtaacaattattaatttttaactatggttttttaaaatcaaaataacaaaaagaaatttgatgatccgttcagatgatatacaagccttgcacaagcgtaaaaaactaattttgtgcaatgtttatttaggcattaatgtaatcattaaatctaaatcgacagatgtaaataagaaaattcatatcttaaattcatgttttaaatttaatttattataatagaatttgagctattaattttttttattttaacgattctgatttgttaactgcacgttatgcataaaaatgaaccagaaaattcagatgccacaatttcacaaagaaaatgattgttttgattattctattcatcaacaaccttttcatgcaccgtctcatttcaaattggaaaaaaaaaagtgttttactctcaatagcttatatataaaaataaataaaataaaataaaataaaaacgtgctggtatagtggtactaagttatagcatattagaagaagaagaaaaaaaaaaaaaaaaaaaatatatatatatatatatagcatgattagaagggaaaaaaaatatatagcatgattagaagcaaaaagaaagatatagcatgatttataaatgaaatgtaagtaaatgccattactgtacacgatgttgaaaatagttaaaaatatttcatttgtaggtatacatgtaaatgtcgataaggatattttaattatacaatttatgatgagatttagtatttttatagtgatgtaatttttttgtacagtggtgatgtgatgtaagtgtatatttgtgaatataatgtttttaaagtatagtaaagatttatgtaaaaatatatatatagtgcagaattatagattatatttagtcatgacaaataaattggtatctgtgggtatcatcctattctcgttctgagtttgccagagaatctttgtgggatggatacagatgtaggtaatatttgatttttgaaaaacgataatgaatatgtaatatcccgtattcatattgtgtgataaattatttcatttatgtaaaatatatattacttaattaacatttgttatcgtttgtctttgtaattaatatgtcattctaagatttttattacaataattaataggtgatgattgattcttaaattcatttagtaataggaatagaaatttgagatcatatatatatatatatatatatatatatatatataataaagtaataaaaaaattattggatatacgggtgacactattttatagaaaatgttattattttttctttcttaaattattttttatgttttttattttatttttaaaattctagggcgaatataaataaggaacaaatatattcaatagtcgatgagaacattaaataaaaaatcatctctattgaaaatagaggttgggatggattttgggagacgaaaacaagaaaccatatacattctaatttcattttgttatcatgtctaattatattgtatatattttttaaatcacatatatattttttagagtttcatacccatttttattttattttaatgcataagactcactctgtataataataaattttaggaaagtttgaagaagaatctgtaagaggtgttttcaatgtcatcaatatcaatagacttacgttatattgcaaaaggtgttttgaatgtcatgaatatccttgttagattgtgtagattatttgttactcaccatgttttttttttattcctccatgtgttgaattttcagttacgaataaaatagatactcttcttaaaaattagacttgacattataacaaaaataagtaataacaatatttctcttgttctagagtatgtttggtgagtatttttacttaatttttaacttttttatattagagacaaaagtatatttgataaacattttttttagtattttgtaatattttttttttagatattaacttctagcttataatttattttattttattcttaaaatatttattaactttctcctttacttacattggataaaattttattatttctttgtgctatttttattttttggatatttttacattatatattttatttcaatcattatattatttattttattattttagcactgtacttcaagatattcgtaatcaattagtatgagaatactaataagtgatgatatttaaaagaatgcagtactattattttttattggtgaatgcttattttattgaaaatattagtgaaagaatttgaatgtactatctctctttcctctattttcttttcatttttcttcaactattggatcaattttatacctccactcagtagtattatcatagtaatcaacagaataaatgtataaggtctaattaagtatttattttttattttaaatttggttaaaaatatttaagatataatataaaaattaataatagaatccatagcatgaaaaaatatgataaattttttattatgcgcatatgagcaccaatcaccaggacttttaaactcatactcaatttttaagacgaagtgaaagtttaataataacaattttgagttaagcgtaaagaaaaatttcccaaaattacttgtcttaactactgcatcaatataaaattttccaaacacgcattgggttgttcaaatgaaagttaagtaaacacatatcctaatagttttgacatgaaattttcatcataatttttgttgtgatataatctctctagttacttatgtattttttctgtaaaaagtacttattatagaattctctttatatatatatataataaaattcattatttcattttaatttattattcaaatattaataaacatgggagattaataattaatttaaagttttcatgagagtaacatttgactttaaaaataaccgatgaacttgtccgcaattagttttacaaagtcaaaatcaagagcaagaaggaatagttcaaatcttcagaatcaaggatggtagtctccgattgcccataacgtgcaagcagagtgttaagaaaattttccaatatttaaatatagttacataataagtcgtgtcaaagacttcatgctgatagtcaaataagaaaaataataaaattattttcaccgatatagcaaaacacgattttaagaatccccaacataagcaaaaatacttttttttttcaataataaactgacataattgtgtaatctacttatgttattgaatgtatatatattttatttcatatagcaataaatactttttattaaagaatgtagcaataaacattaaaaagtattttactcttatattatacttctttacggctttacggtttaattttatgaactgtaaatcaaatctgaaacagaatattattacttatattaattttatttgatttaagagaattatttttttataaaatatatattatatattagtatgtgcaaaaaaagaaatgataaaattaaattaaattctcatttcacctcatgatgatttttttggcaaaaagaaatatttaaaaaaaataaaaattcccgtatatttctcagattttatttctttcttaaaccatactaattagttgttggttaattactaaaagtaaagtgaaatatagaaaaggagaaaggtgaggacccgttgttttgttgacatatatttttgcactcatgtgacccacaaaatgattgtttggatttgagcaaaactgtaataatgtggggcttgtttggtaggctcgtcatttcactagcgccaaacggaagaaatcacgtgtggcgtttgtgatatggataagcctctgcaaaagtttcaactttcaaccaacctgtttcattatcataatgcttttttttatcggatccaattctatttacatcaccatgtaaagataattatgatgccagacggagaattcgattgattatatgtaacatattttatataaacaaaaataaaattatttaatttgactaatcttaagttaaaaattaaattatttttattaacatttattataacaaataatacagaatcatagaaaatagaattataattagaatttaatgaaatattattttaataataataacattaaatataaaaaatagttaaatttatttatatttaagtccaatatacgaaattacttttttttatatatgaatttagaagaaatattactcaaaatattttttctctcttgaataattgctatgatttgttagtttgttttacttatatttagatgataatataaaaatcctataaatcaaaattaaacttataaatattatctaaaaagtacatatcactgacttctaatgcactttagttaattttttggtgggggaaattaacagttatttaaaactgaatgctgtagttatgttgccattaatactgtttaaacaaaagaagaagaagaaaaaggctattaatcgttttattggtccagtcaatatgaataatttgggggggttaatttgtttattaagaaacgaggcattagatattgcctcagcggttgttcttgtggcatgggccggcttcgtttctacattgggctggaccggccggttgatgtcgacgtgggtcccaaattcttctggaatcgacaaatttaagccgttcttcatcggtccgtcactatttcatttcatccatataacttttaaatatatttataaaatatactattatatatatatatatatgtatatatatatataacagtatacgattaattagcatgaatcaattctccttttttttaaaaaaaaatcatgaatcaatcaattcatgtaggattatttcaatctaagaattcaaattcgatttttaaagatataatttgtaaacaatagttataaattttggtccaacaattatatataaatgaatggtcaatgattaaaagttattttttattttctgaataaacgaaaagttagtttgtgatcccgtgattattttaaaaaaatcatgtacatttttcttaaaatcttgattatttaaatacagtctaatagtctatatttataaggacaaaacttataaacaggttttgtttttatagttatctaacctaacaagtgtattaattagccggaaaaaaaaacaagtgtattaatttgtccacgcaaactaaaagacttcacgaagctaacctttaagtttttaacaccgtaagtgccattgattattcacacacagacacactgatcattcattgagtggagaaattaattttaaataggttaaaaaattcaaactaaaaattaagaattttcaaacaacttttactttgttaatttaaacccttattttaagcttttacattaaaagcgcttattttgtgaaggataaattgggagaagaggggcagatacaaattactagttggattgttttgtaaaaaaaaagttaaataaaaaatgattttaaaaattatgaaattcaatgtactatttatctcctattcctattaatctctctttctctttttctcatctctttcctatttcctttttactaaatatcttttatttatcacctatttcagagaggacataaacaaggatgaatccataaacttgttaaaggagttgattttttcccctttatttgaaattgtttaaatatctaacttttaataagtaataatatgtcaaatttttttttactattttcacaaatgaaattagaactaatttttattttaaataataaccaccttaaccattatcataaaaataacaaacagataattaattttacataattttactctagttatcaccttaaacattacaatgataataataaacacaactaattttacatgattttacactaactaatcttaattgttattatacaattttatattaactaacttaaaaatatatatctatatatataagaagtgtcaaaggagggagggagtctaccttgctggcccctctttgcattcatccttggacgtaaagtagcttcattagtgatttttaattcttcttttgagtatgtaattattttaaatagtagtacttgtaaataaaaatttgttatctatgataaattttatcccataaaacatacctatagtttataccaaaaactttaaaaaagttggacttaacgcaaccttaaaatgagatacctccaatatctataaaaattataagattatttctctcaatcttatttcgtacaaacaaacattattttgatatttgttaactctgaacttataaaagattctcatgtattaatttgttagattaatattttgctatcgtgggaatattaaatcgtggaaataacaaaacatgttatagaaaaggaataaataaataaaaggaaacaataagtgcacatcacactgatgagaccaacctacttcctttggtacaaagataaagaccattcacgtggtatgtcattattatgatatttttatttaaggaaaaactcgctatgaaagtggtctcgtgcaaggcttataaaaaaagctacgaggaagagaaaattaaaaataaagaacgttgtatatttcacaatttcaccaatttattcctaaagaaaaaaaaaaaactccacccaagtttattagaatgaatatcaagttgatctatgaaatgaatgtgtatcatttaattgatgtctatcgtcaaagaccggtgaattggcttactaaagtaaaaaaagttaaaccaatctagttaataatactgacaacatttttaaagcgggtgattaaatgagttgattaaagttacatattgttgtttaataaaaaaatttattggagatgatgatttgataatgtgttgtttaaaagagttacttatacaattaattgattattactaaaaaaaaataacgtttttttcaatccaaaatttaatgtaactaaaaaatttagttatcgtagtaactttagtattaaagtaattttttgtgtaaaatttttaaatttacgtgatattataaatcttataaatttaagatggataaacaatttatttaaacaatcatatatataataaattctttaagaaataatctaatcaatatcattaattacatagaccaaattaattgactattacttaaatacaagaatatcttacttttgatttttattttttttataatataaagtatcaattaacaaataatacaaattaaaaagaactaaattaatacttactcttataatatccaaatactgcattgttaaagcaaaggttatgaataaagtttccctttagacttttttctcggatcttagatcctttacttgtacactagttatctagtaaggcttaataatattaacaatttctacaacaagaacaatcataggaagaataggaagaaaagtgtaaaataagataaaatgatgtgataatgagtgatagagaaaaaatgtataaaagttaaagtattgtgaaaatatagtgaaaataatattattcagatcatatgactttggatgtggtggttatatagtatgtttggtgatctgtccaatgatatttggacgtagatccatgaaataacttttatttgtttttaggttgctttagagtgaatttggattaaacgtggatcacaaaagctaaaacaatcacgtacatgtacatagtatgattgttatttattaaaattttatttcatattagatttaatttataggttaaatgtaactcaattacgatgtactaattaaattatcgttcaggttattttttaaaataataaaacagaaatttcatataattatttaactaaaaattatatttttgtattttggttttgtaattgtcacgaaataaataaaataaaataaattacaataaaattaaatgacaataaaataattaagtaaaaatataaatattagactttgatggtgacattgatcctgatgaatgaatatctaagtttggacttgaaatttattcgatccaccgtaatttcacaattttctagtaatctctcatgttcatccccggttcactaacgtattctacccagctcttgaatggtcacatattctaaactacttgcccaatactcaatcccttagacatatggatacaaacaatcaacatcaatggtcgagaattagcgagatttaatccagattattctatccctcgagataatcttaattaagtacttaattcataatcgagtttcaaccagactcgttaaagcgcaagtcaattcttgaatttatttataagatgaccaatcaaataaaaacattaagtatgaaaacaaataaaaaaacttaagatgaagtgttgaattgataaaattaaagtgaaacaagattcatcatttcctttcctagatggaagaaattgcactcataaaaataatacaatgaaatctaaagtgtctaatagaataatgaatgtgtctagtaggtgtaagtctaaaatataattctaaaaactgttcgggactttactattttacaatggatactttaaccttctatttatagaattgtaattaggtttaataaggaaaagaattacaaaaaattacaaacaaataatatctctaattatttcaagtaattatcttattcttcatctgatttatcattgaaaaatatcttacttttgattttcctagttttatctttattcttcacaatttctccttacataattttctactgattttgaacctctggaactcttgtcagaattacccattattttgctgaaaaatataaaaaaatttattaaaaataactaaaacataaaattcttcctaagacaaaataaaaactgaatttaaaacaaagtctaaagttaactaaaatgtcaaataaatatcacaatatatatatatatatatatatatatatataaattcaataaattttacatttatcattatcaccattaattttatttcgattatgctattcctttttgtcatttatagcttgtttttcaaccaatggtggatctgaaggctacattgctgtgtacaacactacaacgtactcgaagtagctcacgagagaaataaataaaaatcattgtaaaacatgctacacttttcatagccacccaaatatgtgctacactagtatcattactattactgaaatagtgaaatttctatttcgttcgtaagtgaaatgtgacgtataaagtccttcaccaaaaacataaaataaagtcaaacacaattttttgatattgatttacacaatactaatgggactgaagcaggtaatttatattaaataataataataataatattacttgcctacctggtatgtttggtaaacaaaaatagctggcatgaaatgattcagtgaaacagtttgacgttaatccattgcatattcccaaaattttctttttaatcagtaggaatcgatgctcataccaaaaggtgaacaaattgcttgtatttcaaaatcaaaattaacgcatatctgctaatatttattgacatttgacagtgttgcaccctagggcccagcatatgttcaaagccaaggcccaaggaataacgaaatatcaagtgagttgtaattattctccaaaattgagcccattgttggtcttatttattcgatatctttattttttatgtttctgtttatattgaccaaaaacacgctttctttttagaataatgatatataatttggttgttctgtttatatatttgttcggatactggatacattatgtgtgattttggtgtttgaacttgttttaagcaatttttttttaaaataaagtaaatcaagttaaaactttttaatcattatttggggtgtgaaataaatttaagaatttggaacctaaaagctaaaatttgattaaattctctctctctctctctctctctctctcacacacacacacactatatatatatatatatctatagattagattttaagtagaaaatacattttatgtagatttatgttggtagaaaattgtgctaccatactggtatgattctaaacatttatcaaatgaaacaatttatttggtttgaacaccaaaacatttgttttcttgttcttctaaaagaggaagcaacccgcctgctgtggcggggcagctttttttttttcacaataagacctggacgattttaaagatttgaatataaacaaattgtaattagatacactgtcgttaatatgggtattaagtcaagggatagtaaaattaaaaagggtaaaaatcaaactataaaaagtttttatatctcaatgaaattgaaaacaagagtacatttgaactattaagaaaatgttagataggataatcatgagaatttcatttaccaacaatggtgtctcctttagactttatgacgtatggagaaaagttgaaaccaagtgtttgtacgagacaatttctaaatatgtggcagtggtagaacaacattgaggaagcagttatgggagtgaatcagaagcagcaggtaagtgtagaggatgaagaagccttgttgttttgcaatggaagagcaggtccttatatgagttttttaaagttatttactcatctttttgtggtcctacattgtcatgtcacttataaaagctctaatcaaattttgttccaatgcaaaaaattacaataaactccaaaaaatcctcttgattggtgatgtttgaaaagtaagaaactctagaaagagtttcttatattagaaacccaaatttttttaaaggaactctcaggccacctaaatactctctcataaataattacttctaaaaaataattttttatccttagaaattcactaaacatctcccattagagatggcgggtgcaaagaagaatgaagtgttcgataaataatttgcaccacacgcaatgcataccctcgctggcgcgccagcggccacaccctttaatgttggcaaggataagtacgttagcaaaatgtggaaggggttgaaaaaaacggccttatgttgtcaattgatgttgatcgatcattttcagtgtcatagatttaggtagacagcaaagtagtacttaatttcaagtgcatacgatagtctcaggtttactactagtagttacatcttaattcattcacgactttggagggcacacctattgccttacgaaatcattaattgcaactaactcagttaagctaaatggccataacagcagcaaatagcttaattgcaatatcccagatttagatagacttccaagtgcatacgatattcactggttttggtgttggaaaatatttttcattatgatatatggagtttgagatttgttgttttaaactatcaagatttggtgttggaaaatatttgtgctttaagatttattgttatgtttgttattagtttgttaggtgtgatatttggaccgcatattggtgattttttcttcttatatataactttctcttacaaaaaataagaagaagaaaaaaattcagacgcacacagttacatcaaaataccatttgcttatttctcatttttattaaattatattatattattacaattatatgttttggagtccaatgttctttggttcaagatcatttcgttgcactccattgaattaatggattgtcgtatcttcaaagaggagtgcatgcatattaatttattataccaatgcagtggagacgtttactctctaaagacagcgcatagcgcgcttcaagtcagatatttttctagactctcctttgttaaattttttttgtattaagtattattataaaaattgtctgtgtattacaaacattttttctcgttgtatatatgcagcatcaaaattcttccttatcactcagtttctatcatcaatatgttgttatagtattccatgaatatattttcttttaacacttcaaaatagtagaattaaaaaaaattgtatgtctataattgcttgattttgatcaaaggcttttaaccgtgagacatgtatgtatttacattggtagtttgtgtaccaggacttaaattattgaatccttcatgacataatatcattatttatcataatgaaatctttcgtgtcttgtgtttcataatcatatatatgtttttgataatgtgatattgctttaagttgatttgaagtttgatagattttaattggttcaaaaatatcctccaattcaatagatggtgctatctatgatttagttttttgagatttaactgtaagtattgagtttatattgcttgacaataaaaactaccaaattacaataaaattgaatttttgggctttgtatgacgtgaactatttttatttgattaatcatgttaacaaattatggcgttgagttattaagttaaaatattgtatattcttttctttgattacggttatggcttgatcctctgctcaagttttataggctatcatcatttgcatagatgttttagccatgcctaattttgttagtgattattaccagtgtgaaatgatgcagtaatttagtttcaacttgttattactttttatccatcttattatgtttgaatttacaatttgggaaacatgagttcatcttagtcttgtgttcatgaattaaagtgtatttgaatatcttaaaatatttgattatttttattgattgattaatgatcacaaaatgaaggtaatgattatccattagatgacctttagtttaatacgttatgatgatatcaagattgtgaaatgagtacttatccatttggttttataaggacaattcttattgtcatttttttttcaatcgatttgacatttttttaatttaataatatgtttaaaaagcataataaaatttatacatcaataaagttattaccttcaattctataatcaatttatttataaacataatataatttataaattggtgagcatatcaaactgtaagttcacatgattgaaatattataattcaagttttagaaatcgatctttcaccctctcaactcgatcttgaacctctctcaggttcaatctcactttcaccctctcaactcgatcttgaatctctctcaggttcaatctcactttcatcgatctctcaccctctctcgggtttttcattgtgtttcaattcaagcagcataaaaactttaaatacttttagtacctctttatgttaattttgtactactaattttataggcaaaaatttaaaaataatattatttaattaattaattagcaaaagggggctgtttggggaatatttaggcatttggggcagccaaacacgccctgcctgggcgtgtttaaacacgccctagctaggcgtgtttaaacacgccctggcagggcgtgtttggccccccaaatgcctatatattccccttgaaaatgacatttgccatttcgcgccttctctctagaattaggtctgccttctctctagatttcgggtgctgaattgtctgaagcgaagccctgccgaaatcgtagtgctgccgacaagtaagtccatttaactgattgtgcttgatatttactttgttatatttgaaattagaaaatggttaggattatatgaacttggtagcgacatatatattaggttagttactagggttttaggtctttcaggttagttttagggtttacaatgggataagggtttagggtgtggggtagtgattagggttacgtagtttaggttagtattagggttaacatcgttagttactagggttttaggtatttcaggttagttttagggtttacaatgggataagggttgagggtgtggggtagtgattagggttacataatttaggttagtattagggttaacatcgttagttactagggttttaggtatttcaggttagttttagggtttacaatgggataagggtttagggtgtggggtagtgattagggttacgtaatttaggttagtattagggttaacatcgttagttactagggttttaggtatttcaggttagttttagggtttacaatgggataagggtttagggtgtggggtagtgattagggttacgtaatttaggttagtattagggttaacatcgttagtagggtttacattgtgataagggtttatggcttgcgaaacacacttagggtttagttatgttgttgttgttattacgatgtatgtgttgggttacagacctagggtgtatggatcccgatttaggtttaggaaattacatacacttgactaataatattgagtaattagttttccaattaaagtctttgacgttaatattttgtttgatgtggttttaaatttttgtacatgaatatattgaatagatggctgattcatcgtctacatcatcgcgatctgcatccgatcatgaggctgagcccatggatcccactgcatatgttgttccaaccccatacaagtggggcgttctgcgaaggcgtattcagcgcacacacgtttcacaagttgtgtggaacgggggaagcacacctcgagtactgaagactcgacgtggtaccgtgaaaggtggaccagatgcggactagatacccgatgttgtatctgacatgttgcgcgcagctgggtttcttcatgtcgcacgcatgcgaaatctccaggtacacaaccacgcaattatgaaatgagttaagcctgcttaatttgataattgtttaataatttttatgtatttcagatggattctgcgcttatcagtgctctggttgaacgatggagaccagagactcacaccttccacacgccgcagggtgagatgaccatcacgttggaagacgtggctggtattctaggattgcccaccgaaggtgatgcggttactggagtgacggttgacgagtgggagaccgtcattgaggaggtgtttggtcacgaacctgaggataccgagcttagaggtggatatttgcgtctgtcttactttgatagacattttgcgcactggggtgaggtggtccccgagcctgttcacatgacgcggttcacaaaggcccacattgcacgacttatcggatcatggctgctgtgcgacagatcgggaggtagcatggtcgcagcacgatatatgtcgttgcttgcaggggattttatggacatcgaccgatatagctggggctcagctgtcctttcacatttgttcagacaaatgtgtgagtgtacagatccagacaggagtgacatcggtgggtgtcatatgcttctccaggtgtgggcgtggctcagattccccccaattgctccagctattccgctgcctacacagccggactggcatttcggtcatcggtatgtgtgattatatgttgttgttgtttacaattgtaacaatgaagtgttatattatactaacattgattattttgaaatcaggtttaacgctgtaggtcgacttaaaccgcatgaactggtcgtgtataggatggcattggacttccttacccgaaacgaggtatttacaattatagtatttttcaattactgtacgtttgcatttgtggaacatgctgttaactaataaagtgttattttgttatgtgcaggtcgtatggcaaccatatggggactacgacttccttggtgcttctgagcgtgagcggctgctgtggatggcaactacgcctatcatatgcttccatacggtcgaatattgtcagtcggatcgatgcatgcggcaattcggcagggatcagccaatcccacgcgctcccaggaagctgaagggtgtgcatgacctttcgcttcgggggaaacgagaagacaattgggctcgtaaactcagaccgtttattgagcgatgggatgcgagggaccagcacattcagcttccccccttgattcaggggttgctgtcaccgcaccatgagtacatggtctggtacagagaacacgggaagcggttcatcacaaagaagggcgcgaagatggctcgtggcgtaagtttttgtttcatcatgatttgtctatttcatttaattatcgtgcatgacacacctgacatttatctggatatgtttacaacagcttgatgggctggaggcgttgtacttcgcggcaactagcccgaacagtgaggaggccttcgacttggattgggcgggtgaggagctcggtcgattaatgtctgtgttcgccgagagctgtcgcgtggaggaagcaggcccacatgctcctgaatcccagcctgaggccgatccagagatttcacttccagttcgccgacggagaaaagagggtcgtgggctagaacgtcggcggataccggtgcagcaggttcctgagcccattgtacgaccgaggccgcgcactgatggttactataggcctcctgctattgaatcgacatatagggcacaacccctatattacgaggctactgtgccgagggggcattcgggcatggactacgccgagttcagtacccaagcccagatgcatacccagggtgcagatgtagagggcgtgttcggttgtggaacgaacatgcagcccgagtggaccgaggcacaggtcgacgacatgctcgaccatatggattatagtgcagaagcctgtgctgcttggcaaccacattcaccatatggcaccgaagcttctgagtttcctatgccggtgtatgcagagcagggcacgccatgtccatctccttatgtgcatccgtatgaggcaggcccttctcagccaggaccttcacagccagccccgtcccagccaggcagttctcggcgaccacgaagacgagtacaacctgatcgacaggcacgtcatttgccgtggccaccgccgtcactctgatttattcgcagttattgttttatatttctttattatattgtagtcgactgtattttgtaaactacgtttatttgtgacatttatgttaaccatgttcggtctaactattagttgatcacgttaaccccgcaaatcataacaataacatacgccggcaaaaccattaattcataacagacacgattacaatataaaacaggcgggggaaaatgcatttttaattaaagtcataattagaaaacaacatcttcggcgtagatgtcttattccatatggatttgtggcttgctgaaaatggctaaaatttcaatcggacaaaaacgtttccagtagttggattccgctagcatccttaacacgtcttcatcgctcagcaactctcttatgtcatactggattgtggtgtctgagtattgggcatgtgccggatgacggaaaaacatttttcttaccacctgtgatatgtgaattccattaggaggaaccccaacaggcgcaacttgcttgatgacggcctttagtgtatcaatggtgcatgcagaaggaatttcaaatcggattgggtttgttccagtaaaggcataacccacaaaaccgcctcttcgtgctatgttccaacttccgttgtaatataacattgcatcgtgtgtggggacgatggttgactgaagtaggttcattatgccgtcggctgttctgtttatggtgcataatatttctataggaccagcagtggacatttgttcgtgacaccttaacattctgcaaacatcatcatcgtttgttagtgcgatagaatggaaaaaatagtgttgacctgcgactagggatggttgtcggtagtatatgttatccacgaaatggtcatcggttagtaaaagggtgtgctgaatcctacttttaagcgtctgaaacgaacactcgttaggaactcgcatggctatcggactggcaccctgaaaacaaacacccgtgtcgttgtgattcgtacatccatttggataaacgaatgctaatttggagttactaatgttttgactgcttgtttctcctaagaatgtcattgtatgcaaaatcaaatttacggggcgaggcatgttgtgtgccacggtgtagcttatatagctgtaatcgcgcctaagttgggcgtgtgtagtcacgcccttgttaggcgtgttcaaagacgtggtcggtgggcgtgtctagtcacgcctttgttaggcgccggcaaagaggtggtcggtgggcgtgttcaatcacgcccttgttaggcgtgttcaaagacgtgatcggtgggcgtcttcaatcaaaccatagtcacaacgtgcttcaaccaaggcaaaacttgaattggaaaactaattacttaatattggtgtttcatgtatatgtcattagtgaagtgtatgtaccacagcgcctaaaccctaatcgcatcataatccgtgcaccctaaaccataatctatcatccctgttaggcgtgttcagttaggtgtattcaattaacggtgaacgggtaacatatagtatcataaataaatagttaatgacaaaatgcaaattcatgtccatcacaagcaaaacattatcatcatacatgttacacaacatgtcttataaataaaatacatttaacaaagcattcataaaacacacataacaacaaaatcatgaaacaccaccaccccgagtaggacaggtcgtacgagtatgtccaacttgcttgcacagaccgcatctacgagctctctgacccgtttcaacttcgtccatctcgttacggattctggtcgaccttggacgacccttcgcacgcaacatttcgctgtcagggatgataactggatcttcactagggggaacggcaagttcatcgccaataggctgccaaggtaaagaataagcctcaaccaagttggatacgaggaacacatcatccacatattgcaaaggattccgacggatgtataaagcagcagctgcggcatggctacaagggtatttgaaggtcttaaacttcccacactgacaaaaacgttcagttaggttaactgaatatgacctgtcccagccatctgccacctcaaacgacgtatcctcaacgttatagctgcgtacatggtggcctgtagcaacgttctgattatgcctcatagcatcaaccagatttttacaatgtagttgtgattgctgcatttgtgcagtggccgtcttaccccttctcacaaagtattcaaccaatcgactgtatgtgtgcttcaccaaagcagtaataggcatgttccttgctcccttgaacaccctgttgactgattcagacaaatttgttgtcatatggccgtatcttctcccctcggcgtcatatgcacgagtccacttttccttaggaatgctgtcaatccattctgcaacctcaggactggtattgcggaatcgttcatacgctatgtcaaattcggccttacagggagtataacctgcacaattataaaggcatgaacgttagctgggtaagacatttttaaacctgactaaattacaaataattttgaacatacctaaggtcatgaggctcttcttcaatcttgcactcctgaatcgttgattgaaattactggcaatatgacgaaggcagaaaacgtgatgcgcaaagggtggttgccaaccggcatgattctgcactgcagatataatgctccggtgccgatctgaaatgaggcatatattttgcatctgggttacgtggaagcgaatgttagcaaggaaatattcccaagcttccaacgtctccccgtcgacaatggcaaatgccagtggcacgcattcattattcccgtcctgactcgtggcgatcagcaattttcctttgtacttgccatataagtgagttccatcaatttgaatgacgggtttgcaaaatttaaaagcctcgcagcactgtctgaaagtccaaaatatgcgctgaaacacacgcttccctcggaccagtcgatttgccacaaaataatcattggtttgaatatcaaaaaaagaaccaggtgaaaaacgaagcatgtagttgcaccacctcggcaaatatgcgtaagattcttcccaatctccataaatcattgccatggctctctgcttcgcataccatgccttacaatacgaaactttaaatccaaagctggtggtgatcctctcctgaaccaacgcaatgcacacgcccggttcctccttaatcattcctgaaaatgacatagtgagatacagattaacaacaaaccttaacacaaattaacttctttctaataaagcaaaaattctcaggtcataccgactacaagtgaagcaatgacatcaacatcaagttgtctatgatcctgtgatagacggtcgttgaggcaattgtgctttccaccccatctggaaaccacccacttctcaccgtacactggttttatcaccctaaccctccaagggcaaccatccttgtgagcaacacacttcattgcaaacttgtcaggcttgctctcaaccacaaatgcttcttgatgctccctcattaggttccgcttaacagcaacttgtgcctcctttttcgatgggaattcctgttcaacatacaaatcgtcccctatttgccaaggaccctgcactgaacccgatcctgaagctgagccgctaaaagaagattcttcgcttgggtgattccaatcgatatatgtgtaatgtggaatcccgtcccaaaaaggaacaaccgcaccgcctttaaatacaatacacaataataagcattggtttgcaaaatatatacatgaacaacagttatacgaaatcacttagggtttaagtcatgtaacttaccttcaactggttgttctgattgtgtcggtcgaacacccgcacggttccgcatttcagacggccccgcatcagtgtgttgctggaatgcatttgcatccaccccaacatcttcatcattatcggacgcactggcattctcctgaagaagacgatcttccatcgctatattttcatcatcatcatcttcttcatcgtcatccataacccaagttgggtcatgtgaatcttcctgagacatgtttgcaccaacagcatcatatgatgctgcaccatcatatgatgctgcactcctgggcaaaacaactgacctcctgggcaaaacagcttcctcaactacagtgtaatccacatacaattctaaaaatttcttccgtccctgattaaaatattcttcaatggccatttgcaattcttcatcatcctgtattggaaaccccatgtattcatcttgctgccatattcttgccgtcagcaatgtgatacaagtgtttccgtccacacccaattttggatgtatcttctgatgcagatcactcaatgttgcatttcggttgattcgtgtcatcctttggtccccttcgaagacaacacctcttcccccttgaattttccttccgttgaaaaaaaatttaacacgaacaacgtccgcatcacttgaactcatttcctgcaatcaacataaataaacgtcaaaaacacacaaacacccgaaaccgtcaattatgaaacacccgaaaccataccgctttaacacaaagtagacaacctaacacttctacagatgtagttactcccagtaaatcaccaaatggtgaaagaaagtcaatattgtcaaagacacaaagtcataaagaagtggtcttgtttacacaacaacctagaccctaggtctagtcacgccaacccatacaccctaaccaccacatacgccttaaaccctaccacagatcccctaaaccctagttgtgttccccctatcctaacccctcatcaccatataaaccataaacacttaagctgaatccctaaaccctagctgtgacaccaaaccctacaccctaatcaacacgcgcaccataaaccataaagcggtaacacttaaaccctaggtgtgtaccccgatacctacaccctcagccagaacacttaaaccatactcaccccataaaccctaatcacagtatcaacactaaacgtaaaccttaaccaaaccctaaatccattagcctgacgtctataacagaagatcttaaccctaatcagagccaacgaactacaccctaaactaacacccacaaaccccctccctttgtacccgtagtcataaaccctaatccccatgtacaccccaaaccctaacacaataaaccctaatgacaatgtaaacccctaacctaaactgcaagccatcaaccacacgtatgtacctgcaaccctaaaccctaatcacgacatatgccctaaaccctaaacctagatatgtcccccaggccgtaaaccctactaacgatgttaaccctaatactaacctaaattacgtaaccctaatccctagttatgttccccctatcctaacccctcatcaccatataaaccataaacacttaagctgaatccctaaaccctagctgtgacaccgaaccctacaccctaatcaacacacgcaccataaaccataaagcggtaacacttaaaccctaggtgtgtaccccggttcctacaccctcaggcagaacacttaaaccctactcaccccataaaccctaatcacagtattaacactaaccctaaatcctaaaacgtcaacacaacaaaccatgaatctaaaccctaaactaaactacaatacctaaaacattagtcactaacctaatatatatgtcgctaacaagttcgtatgatccaaacaattttcttatttgataatacaacaaactaaatacaaagcacagtcagttaaatcgacttacttgtcagcaacgcttcgaattcgacagggcttcgcttcagaggatatcaagacccaagctttagagagaaggcagaccgatttttagagagaaggcggaatggatcaaatgccatttgcaggggcaatatatagggatttgggggaccaaacacgccttgccagggcgtgtttaaacacgcctagctagggcgtgtttaaacacgcccaggcagggcgtgtttggctgccccaaatccctaattattgcccaaacaacccccttttgctaattaattaattaaataatattatttttaaatttttgcctaattttatacgttgtattgtagacgtgttgtgtgatgatgattttagaatttattgtatccccatattcaagttgtattctattgcatctgtgtttgtcaggaataaggggcctattactgaagtgtattccagaggaaatatgaagataacaaacccaactgattcacaagtcaattaattttgcgtttacatgggtcagctaggaagttaagagttaattgctataaatagtaatttataaaaactactcactgtttatgatgtagttgcagggtataatggcttttagtctgaaacttttcttaatttctgcttgtcgaaaggactaaagggttcatcataaacttttttgcatcattccttttcatgaggactagctcctttttagttattactttaccttacaactgaaagtgagaaggggttgcacacacacgcagatagtgttttaagccaattcccatgtagccaaagtttccttaccaagaaaagtatacctggtttttctgttcacaggttttcctgtaggttgacagtgaactgaatactgctcatgtataattatattagggactgacttacataatgttgtaatcagaactaatatttactcaatgcagtttcttttaaactatctaagattactcaatcattaaacttatattgctgtctgagatatcaaatagtattattcacttttttttcttctgaaaactttgttttctcctgttcaggtgtttctaaaccaaaaggaggagttccagtggcaaaagctttcacagttctttgactaaagtatattggtcaagtaaaatatcatttgaaggagcaatttaattaaggttagtaagtgtcggtaagataaatcaagcaaatttatacttcaacataaagcaaattttcaccgcctaaaaaaaatgcaaccgcctcactagatgaatgaagtcgtcactgaattgaattgtccaagatacggcaattgcggcacctccatagttgcaccatttttcattcttagccatttagtttataatattttattgtattaactttgcctataaaaaggccacccatgtaacattttaaaaatatgcagtgagtgaaggaattagtgagtaaaagttaagctgaatttctctcttcctcctagtgtgtgtgtgcgttagataactctctctcggtttatattttttccgctgcgtgtgagtctttgtgagttgtgagaatctgtgagattataattttgttagttcattgataacagtaagactaatgtgtgactttagattctgagtcattctgaagtttacctgttgaaagtgattataaggtagcacagaatggaggtagtatcagatgaagaagccttcttgtttggcatggaactagcgggtggcactgctgtctccatggttctcaagtcagctttggagctatagccaaggcaggtcctggagcttacctttccccttctcatatagctgctgagatcccagcaataaagaaccctcacgcaccttctatgctggaccgcatgttgcgcctcttggctagctacaacatacttacacactccatcaactgcctcatggtaaggctgaaaggcactatggtcttcacccaaaagccaaataccttgtcaacaatgaagatggtgtctctgtggctgcttactttctcatggaacaggacaaagtccttaaagacatgtggtattgtgtttcactattcctcaacactttttttaatttttttctctctttcttctggcccttttgattttattgtattagcaaagttagagttagaggtataagttaactcccattaattgatataaaatgttaagtatgaataattcaataactataatcacctttgcccatatgactaaaacggcatagatagaacgcttaggattttttttttgcgatttttgccaaaataattgaagaaagaggccaacaaaattttagccaatgaacttagatgtcaaaggtaacttcactataaagaagagagtttaatttgtaatacaacaagaaagccttatccaactaagtgaaattgactatataaatcacatgatatctttcaacacgtttaaaaatcaaaacttgaaatctttcttgataacttgctccaatgtccttcttggtctcctcctgtttttcacaatactaaaatcaatgcaatctacttttttaagtgacatctcttgtgattttctttacatgtcaaaattatcttaacagattttgtcattttttccttaattggtgctatactagccttttatatgttctttcgtataatcttacctctaaagaaaagattctcacctaaaaatgagaatttgtaatgatatttatagttttatatgtcactataaagtaaagattgtcagcaacataaatcaaatatacttgcaacgaaactttttatatatataattagtggttagtgattagtgattagtgattagtgaagtcttagatatagagtttaaaggactgtattcttgtaggtaccacttgacagattcagttaaggagggtgggcatccattcagcaatgcttatggaatgactgcctttgaattccatgacacaaatcctagattcaacaagcttttcaataagggattgtctgatatctctagcatcacaatgaagaaaattcttgagatctataatggctttgagggtgttggatctgtggttgatgttggcggtgggactggagctattattaatatggttgcctctaagtatcccaccacaaagtgtgttaattttgacttaccccacgtcatcaaagaagctccagcttatacaggtgctttttagttcatatcttacgagtttggattgactctactgactataaaaaaattaaaaaataagctaagcgagtgttctaacttggatctttcttacattctcattcctgtgataattaatttggtaatagtagcatcatttgtatataataattgtatttattgctgggcctgggatgttaatttgaagtgttgtttggttttcctacttggatccagactattgcttcctgcatctttctgcaggaatgttttattttctttcgaattggtcagttcgtaaatcaaaatgtattactaatttggaatgtaattttacatttcggattgattagtcgaaagccaacaaagcgtgcagaaagcaacgaccttgaacccttaaaaatcggaatttgaccaaatggcaagtctcttaactcaaaattatcaatgggaactggtcattttaaaattttaaaattcttttactcaccaagttttgtttaatcaaattaaggccttataaggtttattgatgaattgctatcacttttattaagattttttttatcttacacaatttataatatggtgtttttatgttaatttaaaattaacctaactttattttttatgactttgttaatatggtatttcatgtcacctaatattttaatgattggttggatttttaaaagatgagttaaataatttatcacattttttgttgtacgtgatattatagaactaatatgggtgtttggtgcaggtgtggaacatattggtggagacatgtttgtgagtgttccaaaaggtgacgccatttttatgaaggtatgttattaatatgatgttcattcgctaaacagtccattttcaagtttttatattgattatatttggaaagagccaaaccaagttaaaatgttatatttcaataatatcatgacaatactatttttgtatgtagtgggtatgccatgactggaatgacgagcaatgcttgaaattgttgaagaattgttatgattcccttcctgacgacactggaaaagtgattttggctgaaggtatttgtccagaaaccccagattctaacttagctgcaaggtgtgagtttcaaatggatgttatcatgttgtgtcatagcccaagtggaaaagagagaacagaaaaagagtacaaggccttggctaaaggagctggattccatggtttccgaatagcatgttgtgttctcaacacacatgttatggaatttcttaaaaaggcttaagttcttacatctgctagttgtattttatttttgagacttatttgttggctacagaggtatgatgctatatatccttgtttttttttataatgacaaattaataattgtaatgatgaagaagtttatgcaaatttagcgacaattttttatttaaagaaaattatgcacagtcataatgatataatgataattataatttataaaacattaataggcatgtacttgaaaagaatatcgaattcttgttattacctcaaaataaactgtgaacagaagtatctaacagtaatggtctaacccattataggttcaattcgtttaaaaatcatacgttcaaaaaattaatatctataattataatatcataaatcttattttcataattaatattaatagtctaaatacatgtaattttaaaatttctatggtgtcccagtaatttggaattttgatattgttaatttttaactaattaaattacatgtcattttttatttcaaattagtctttgattattaacttttaaaattctaaacttttaaaattaaaaaatatgattaaagataattttaaaagtttgaaccttaaaaaatatttttagttactttcaacactttttataaaaaatattttgggtttaggatttaattttattattattattgtttcttaagcatactttttataaaaaggtgtttcttaaaaataattatttatcatattaaaaatataaaatcgtaaatatattttaaataattacaaatttatttatatgcactatatttttgaactagaagtgccttaaccataatcgttaacatatcatgattcttttactttttacgtaaataaaaaatgaattttggataacaatatgagaaagttatacaccactacattcaactattttttttccgcatttacacagataaaaattattattattattatttgattaaaaaatatctgatctgaatcaaattgctatacgagacgagattctgaactcagcttacgtgtgttagtttgcacttcgcacacgaagacaaggagagttatttgttgtttttgaaacatatcctacgtgtgaacttgttattggatcgatgacttacaccgtccaatcaaaaacccacacattagaaaagccgaagttagggcaacgacgccgtttttccagtttcgagtttccagcaaaacacttttaaagtctgaaccaaacacacgttgaaattaaaaaccacaactgcgtgtgtcgtgttgtgttgtgttttcttgtttcatctccatccttttcttcaaatttccgagaagagaaacttaccaaggtatctatatatcttttgattttgtggatccgtgtttttgagacgtgtgtgaatttaatcgattgttttgcagatgaggttatcattgaggcatgctttggtgtttgcgttaattggggcgttgtggaacttgcaaagggcagagggtatccgatttgtgatagacagagacgagtgtttctcccatgatgtaaagtacgagggtgacactgttcatgtctcttttgttgttattaaggctgattctccctggcattacggcgacgaaggtgtcgatctcgtggtatgttctttttcactccatctcattctatgttaccgcttttattttcagctttatcactttcaaggggtatcacaattactcaagctattaatattatcatatatattattgacaggaagtttagggaagggaatagaaccatagggtacatgaatacaaagagaaccaacaataattgctttctcttacgcctacctgttggctattggtttagggtttaatattggaacaaaccctcaatttcatctttgaaatactaccctttctcataagtaatccctaatgtaaaaaacctatataagtaatttctcatgtatttgaaatcatgctaattagtcccccaagtattaaaaggcccttcaaattggtctctgaattttactaaaatgcatcacctttgagactaattaaattgatgaatattcaatacttgagggattatttatatagtttttttattattccagagactactctcataatagacaggataatacttgagggacaaaattaatagtttattcttttatattgtgaagctaaagctattatgtagctctctgggctgaagaagctttctgtgctattcttcactataaccatgaaactgttatttgtttctagatcttgggatccgttgttaagcttaaagccttgaaccccattctggaaattttaattcattgaccatgaagcaaaaagtatgtttgtcaaacacctaatgaagccacggttaggagataactacactgtgcaaaacagttcacagtttttataggaaaaacaaatgcttgtcaaacacctaatgaagcaaaaagttttatcaatggtttaggagataacttcattgttcaaaacagtagttctttaatttagagaaggatgagtggtcatagagatgttgtgcattatatgtagcaatttacatgtatcaccttttacatttacaattacatataaatggtacttacacaattgttaggaataccctttctttgaaatgcttttttctttctttttccttaatacctacccaatcatatgttggaatctcattacaccacaatgtaagaatttcaggtaaagggaccttctggcgagcaaatacaagattttcgggacaaggccactgagaaattcgattttgtggctcacaaatctggggtccataaattctgcttcaccaacaagtctccttatcatgaaactgttgattttgatgtacatgttggtcacttctcttactttgagcaacatgcaaaagatggtaatgccccttctatgaggtccacttgtatttcctgttttttttttaaaaaaaaaaaaatgtaaaacactgctcttttaagttacatggaagtctaaaaaataagagaactttcattgaaactttttgtgactgtctgcagagcatttcacccctttgctggagcagattgggaagttggaggaagctctatacaacatccagtttgaacaacattggttagaggctcagactgaccgccaagcaataggtattatttaaggtttactttgctgtttatcgcacaatttacatttttctgtgcataaaatcttttatacctatcaattatacatattactcgtgttaaagataaaaacccaagtttatgtatgccctcttgttttctattcttgataccatttaatatgaacaaatgtcccaacatgtgatcatcctaatttatttagataccataccaaaagagacctccctgttgagaacattgctccctatctctttgacaatgttcactgttcactgttgattatggtgaaatgtccatttactgaacaaatacactaagcatcgtagttgataaagctacaaactggtttcttccttctattaacacttcttgactgcggatgcaatatcatgttcacttatgtctggaatgcagtgaacgatgcaatgagcaaaagagcagtacacaaggcaatttttgaatcagcagcactgattggggctagtgcgctgcaagtctaccttctgcagcgattgtttgaacgaaagttgggtacctcgagagtttagagctacgaaatgttctgagaatctgtaacagtacaaatgagaatgttattttaaacttttttccgttgtcatcacatggatatttatataactagttgttcaatcctactcataatacatgtggaaatatgttatttaatgttgtttatagttgatttctttttccggtaaactaaaaaatgacaggccatttctacgctcccaccatgtcctattcatctttttttcgtttaatttacttctgccagtttttctaatcggtaaatgttaattgttagaatgatagatttgtttttctccttcttttcttatccggtaagtatccaatccaccttcccttcactctatttcagctgcttaagttgttacggctcttatctctctcagatattgaatgtaagttgcagtggtaacctacattctcgagtcgtgccatatttaacaggaatctctaactctatcagcggcttctttaccaaacacgtatttttttttttataaaaaataccaaaatgtgtacttttctttttaaaaaaaaggtaaatcgtgttataaaacgtaactttgaacaaaaaaagtcatgttttgactttgtatattttgtaaaatttaatttactaaaatcaacacgacttattcatttttataatttatacccatttcagtaatttaaaataattgctgctgtatataaaaaaagagacctctatcagcatttaagaacttattatagcttaaaaataaacaagataaagaataggattgaggattggctcataactaagcttaggtatagatggtaacaggaaaaattcacgaagtacaatgcaccggtaaaggaataatttacctcgacaaaggtatgtaagggtacgtgcattaacccttaaatttgaatcaaattattatgtaaattaaatatcaaattttcaattagggatagatacatatccattttctcactttacagtttatacacttgaatatcaaatccttaaacttaagaataaattctttggcccaggagagtgactggcatctccttagtaacattgcaatcaactttctgtaattatgattttgttttttttccgtgtgactcgaccgagggtcgagagagatgaattagtataaaacagttaatccaacaagaaatatataaaatagtacgcacgtcgaccgaataagtaagtataaagtttatacacaaatatcaaactctactgtaaagaatagagagagaagtataccagtatatgatgcaataaatactactgattccaaataaagcccaagtacatacaccacatatgcagcaaaaccattttttctgcaatgatggatttgaaaaaaacgtagcgtaagggccgggattgagcatgaagcaagaagaaggtaattaagttacatgttattagcaccattccttctctcattcctggcattgttgaagattaccgagaactcccgagtccccaaacttaggtaatgctctacctctacccctctcctgacagagccatccatcaacaaatattaattaattgcatgcgtacgtacgtacgtaccgccatggttcatcactagctcctaacttctagctgcaagatcgtagatcgaggaattgaatgatgtggctttggctccttaactgttagattcttctaatatatatttatattatgtaatgatgtttgttaattgatccttctccttttccttgattttcagttcccgagggcaaggccaaggaggaagatcgaaaaacacagacaaacacagagaagcgggccaatgtcaatgactatcaaatttatgagacatacactttctcttttttcatgctttctttacggctgattttattataagtgaacaaaatattaaataaataaaattatttattgtataacagacatatataaaaaagggcaaattattaaaaataatgcttttttaataaatatttcgaaatttgggactgttttgaaactatttagaaatttggggcagtcaaatatgtctaatttaggcgtgttacagtccgtcgctaatttggtcgttaatatttttaaaatttgaggtttttaaaatccgtctctaattcggtcgcaacacattttaaaaaaccacaatattttttgaaagtgttagagaccgaattagtaacagaattacaacctcaatattccataaaaagtgttagcaacggactggaacacgcccaaattgaacttgtttgactgctccaaatttgaaataatttcaaaatagatccaaatttcaaaatatttattaaaaaaatattatttatttaaatttgtctaaaaaaagagtttaatttttatatacaatcaatcaaatattatgataaaactattttctcgtataaaagtacaatattaaactttttagtcttagttgtttgaaattagttttaaagatttatgttaacaaaatcttaatttagatttattgttccatattaaagttaaataaagggaatattaattattaattatttttaataactattaattataaggagaatatgttttcaacgttgattttacatgttcacaaaacaaaaggttaatttcttattttctaaatatttttcaagaaaataacaataacaacaaagtaaactttatttttataaaaaagtaatataaaaaatacgtaaatataacatctaattttttttcctgtaaaaaaaagaaagaacttaaccgagaatttgtttggttttaaaattcccaacatcgtaaagactaatgactgattgatggtattttgtgaaactaagcaaaggccagtgacactatggaatgctcggctctataaacacaacttgagcaaaattgaattcagacaataaaaatgtataaaagttgattgaactttcaaccaaaaaacaagggatagtacataaaagacaaaaaataaatagaggctatggaaatgaataaaatgggggagagatcttaatattattggagtgaattactaaaaggaccaaataattacaacaaaagaaacccaatatgtatttgaaaattgaaatcaaacattatgagtattgtctggcttggagtggggccggggtggtgaaggtgaagcagctgggggtggagttggcatcccataaacttgtgggttggtttgaacctctctccttcctctggctcttccaaagaagtaacatccaaaaccaagaagtaagcagaagattatgaaaggaagagaaatcaccacaaccatccccatcttctagtttttgagtgaatgaaagatactcagaaatgggagtatttatatcagtattggattctctgtcatcggcttaacgttcaagtttctaacggccacttttctgtccccacccacattagctgtctttattacctcacttcactattgcctctggctagcttggaattattccttttattctactatttatttcttgtttttttacattttccttttccattttctcatgcatattgcatgtgcacggtatcgacttagctgccactgccactgccactctcatcaaagtttttactattattaattaattaactacaataatttttcatagaaaatagtatttgtaatgctattgtttaacatattttatataaagactaaaatagaactttggcatctcattttaattttctaagtttaagaattatcactttggtctcctaatttatgtgacctaagtcaacccccatttattagatctatctctgagaaatgtagaagttcatagacaggaagtagcaaaaggttctggaacgtctccatgtctcagtgataaaatctgtaactatttttttgagaaggaattaaatctaagtaaattagatttttatttttatcaatcttttataactatgaaaataatgcatttagattcaaatgcaatgatggcatatgtaacttttaaaaatcaaaccgagttttctctaaaagtattaatcccaatacatacttttatgaatgtcataatttatcgaagtttgatcccatttgaaagagagaatgattgtatggttgaacacgatattaacgaacttgtgttttaattttcaaaattgagcgatgatttattttatgaaagttatgttgcaataccctctctattctcgtcactcccgtaattgctatttgtttagtacacagagtaaaaaataatttctatcacattttaatataatactcttcaacatgtcttaagacacttgatgtcagagcagaaccatagcaacaagtttttttttttttttaaaaaaaaaaacaattgaggtattaatatattgatttgaatttgtggtatatatttggtgataatcaagaaagtgggcgaggaataattgtaagtatactgtttgaaaacggaaaggaagaaataattcttaagtttctaactgcataacgtccaacgggggaaaagaacaatgcggttgcaagaggataacgtttaaataaatttgatagaaaagcactatggtaaagtacggcagaactaaaaagtcataaattagaaacaaagaatgaccttatttatctaaaattaattttattgtccaccaatggttacctcaaaagctcatcaatccttgacaaataattttttgtcaaattttattgaactttcagccaaactccaaattagttaggatctttttcccctgataaactgaggggttaagacctaaaaaaaagctcatcaatccctttctaaacaaagcagattgaccacaaaataaagactctgcaaagtattaaaatttacgcttccttgggaagaaaggaatccaaggaagcaacaactaataatatcgtagacatagctcccaggttgctaaccgcaaaagaaaatacaatacacttgaattacattggaggcctcccagacccaagcagctgaccaactagattagtcacctagcaaaaaaaatataaaaaaaatctgcttagacaataagacaatcaccatttgcagtttcccaatatttcaaaagcaaaaaccatattgaagtcaggacttctgtaatccacatatacttagtttgccttggctttcatgaaattatcaagacaccacttaaagtctaaccaggaattttcgaagggagcacacatttaaccaagtactaaaacccaactaagatttcatcctaaaacatctatgtgagaaactatcttaaagcataataaagagtttgatgagagaaaaataaggataactaatagcaactcgaataagtgccagtgatagatccaaagtaaacttaagcaacatcttacatgccagtattttgaaacacagcggtcaatgcaactattttcacccatatttagctcagactccttgtacctgagaagaaaaagtgataaacagatattatcataacattcacattgagccattatcaaaataatgcaacagcagataactctgagaaataagaaactaatttccaaattgactggactggatgacatttgaagggcatcaaacatgacactttctcaggcagattatgcaatcataagagtttccctacctattgtcaacacacttcttgaaacaggtctgggtcatcctgaatggtagaaacaacagaaggttagcaaaatgaattattatggcaccaacaaatctcataaaaatatgcagtcagattgtacagtatacttgtttacaacagcaaacaatatcaaggcaagcaagagcagggaaacctacttgttgaataattcgaccctatattccatctccttttcagccattccaaatatctgctccatgaccacatgaattattgaaacacatccacaactaaataatcaaataacaccgagaaaagcaaatttaaacttgaaatcacattggggtatcaaattcaccacatcaaccaccagatcagttttaccaaagttggaggaagagaaaagaatgcctacctgttctttatcaaaggcagtgggcgagatgttggaagccattgtaccctgaaaatcccctaaaaaaataaaatgatgaattcatatcacggaaattttatgaatattcagaactaaaatatacgattgaagattgatgagaggtttttgtgtaacttaataggtattaggttagtaaacaataatgtgtgtgtataatatcaaattctttaaatgaatttttatactattcgatatttctatatatcatagtcttctctcattatcttaggttcttgattattttgtacaaaaataattgttgcttagggagatgggatgtgttgaggatattgaagttgtaccatgacacaattggactataagacaacgtcagtaagatgataggctattagaattggaatagtgctgaagggttgacataatttggataagatgaagagcatcaccatgtagattttcattattttctaatagattaaaccaaataagagaacacgaacaactaaacatgtagaatttcttaataaactccaaaaatatcacttcgaacaaaatgattgagaagcaaatgagtcatagcagtaatttattgcttgggtgattcaccatttcacctaacactttttctttgtatctcccatgcttctcacttgaacacgacattccaccaatgaagtcccaaatttttcccattatgtgaaatttaggccaatagaaacaatgtgaactgaataggttttcaaaaaaggtcatttactaaagttcaggtcagtataccaatatatcctacaacctaaaatagaggctaaaatccacaactgacttgaaattgacttggggaaagcattcaactccattctcatagacacaatcttttcaaccttaaatgcttgaaatcctaacaagtttttaagtacatgcagaggtagtaacactgcaagagagagcttagaaagggtgaacatcacaaaatcagcagcaagatggttgaaaactatagaacagaacaaagattttgttgtaacagacaaacattaaaactaaaactcactaacgattcggtcttcaatcccaaaaaactttacgatttgaagaaagcggagctgaggaaagaaggaaaagaatgaggttaggaagcaaaataaaatcgaaagcaaacgaacatgagaaagagaaacgtacaatgggccgagtttaagtgatgaatctcgattcacaacagagagagagagagagagagagcgcgaaaacgtaagaagctgaggcaagctaggctagggttcataaaagaaatttcataaataggccagctagtattatgcgtacaaatataatttcaataaaaatttattcaataaaaaattaaaaataaaactataaaagtgaaagaatgaagtgaggacatagtagaaaatagctccattttttatgggaatgtaagatggacctttccatttccaaaaaaaataatttctatttcaccatgaaaataaaatgacaagtataaataattcatattgcataaattaataattttttttatagaacttatatcaaacatgaaaatacgatgttctcagtcactttctcgataatctttttcgataccataaaacaaatacaacttttaaataaaacttattctcatgtaaaatagtttaaaaaaacagtataaggtaatttgcttttgtttaccattctaaaaaatattttttttaagaaataactgattttatgaaaaacttttcaaactaacttctgattttagtcatatttttttttagtttccagtaattttgaaaaattgaaacaaaatcatgcaaaacggaaaaaaaatatttcataaaagaaactataacaatcggcctaatatttaaaattttaaattctcttacaaattaaattttctatttaaaatctctcacctaaatattcattctttacacaaaaactagtgtgataaaagtacagaaattaagcaggtatatattaagtttaccatttatgattctttttatattattatagttttaattttacgattttatatatttacgtatttggttggataaccatcttttattcctccttcatgttagttatcaaaagttcaagaaatattcgtcgttcacttgaccactaatcttccaaactaaaaatcttttaccaaatggagtagaaagtatgcgctaacattactcttttatataagtaactggaagaaaaataaagggaataagaataagtagaatagattctatctaaagctagcattaattatcaagatcttattaattcgaataaaattaaacttgatctcaaatttaaattttatatatgaaaaaaatataattaaaaaaactctaatagaaataattagtcaaattttttaatagatatttatcattgataaatattttacttcaataacaataataacccaaaaacttaatgtagacggtgcattgtaaatttctcatattaatcttaggaacaaaaaaatatcttggaatgcttagtcaatcctactgcgtgttgtgaatctttttaaccaaccccctaagaaagagaaaatactttgacgtgcttggcgtgcgagaatattcagaataaaatgttagatctaaattagcagacgcaagaccaactacaacttcattatttccacttttttggcaatttcagttctggaacacattttgcaaaccacgggaatctgtaatcttgtgcttggaataacaggttttataatgattcattccaaaccaaagtaccccaataaaatttcggtgaaaactaaaatttggataatattgtttcatgttctactttgatgctaagaaaatttcactttcacaagatgcgacttaaacctaacaactatgtagctaaatttctctctcgttcggtcttgtccttgtaataaatttgaaacttgtatgttcgcttgctaaagagggaggcaagatcttttgagctttgcagcaaacgctggctcttaaaagtacatctacggaacatgaaataggtcttacagaagctcaacaacaagggcagatgcaccacctcctccattgcaaatgccaccaactccgtacttcccattcttctgcttcagtacctgcaggtgatgacttttagattaactgaatcgaaaaagaacacattcaatattggggaaagatccatacatagttagtcaaattcataaacaacaacaacaaagccttatcccaacaacaacttatagtcagaattataagttacttaaaatatcagatgatcactttaaaaatcttattattttgtgttgtaataccattcatataagatcaaatgatcaagatttgttcatttcactctcacaacaaactactctcaatgtaatttattaaaaaaaagtggacaaaataataaaattattacattatctttatctttttgaataattgaacataacgaatttaaataattaaacaaagaatttaagagatgagcattatgatagacttttttctacaaacacaaggcaatctgtcaacatgcatgctactatatattataaaaaatcaaagttatgaactgagcacatacccccaaaagtgtcaccagaatgcgagcaccactgcaaccaagaggatgacccagtgcaacagctccaccatgtacgtttactttttcctgcaaaataatagttacttgagtaaaagaaataaatggaggggtgcatccattaatggtcataatgaagttaaattatggattatagacaaattttaacatgttctgcactgtgcaaagaggggttctggacttacaacagcatgcactcttcaagacagtcaattggaaatagtttattatacatgcactaatggattacaactttcgcacagtgacaaggggaaaaactaaccgagttaagtccaagaagtttctgatttgcaagagccacaacctacagacagcaatatgaagaattaaaattcaccgcatcatgagttgaaaaattactaccattgaaaccttgacatgaaatcctaccgcaaaggcttcattaatttcataaaaatcaatttgtgaagtctccaaccccgccttggcaatagctttgggaatggcaagggatggagccgttgtaaataactctggttcctgcacagctcaacctcatatgagtatgaaattataacatatcaaacactagaaataatgtgaatgccaaaatggtttttctatttcttattttttatagtctgaagatgtagttcatatttaaaatatattttacatacctgagcagcatcagcatatccagtgatttttgcaataacttgaagcccaagcttcagtgccttctctccactcaccaaaactagtgcagcagcaccatcactgttagcaagagaattttcattttattaaaaaccagggctaatcactaatgtcaaactaaaaattacaaaaatattaatagcatttgagcgtttaagacacacatattggagatgtatatattgaaaattccatttcatataagaataagatgaacaaatttggaccatacaaccatacacgaagggtcaatattaaaagttttttaaggtcacacgaccaattaaaaaagtcatttgactccctatatatatatatatatatatatagtattttataacaataaataattgacaagggcatccaaatacaaatcattatgtaggaaaaagtttaacaaatttcgataatatattaaccttatgctggaagcattgccagccgtaacagagcctccggtctccttgaaacttggccgaagtttgcgtaacttggcagcatcaaactggcataggaaaaggaaaaatttaacaatatatttatttgtattcaactgaaagtatagacaaaattaatgactatagtaacaataattgcagctagaagtaacatacatataaatgttgttaatgtgaagagaaaaaaatcataaattccaatcccaactcttgattaattatcaccttatagtcttctaacaaatttaaagtctcgtgaattattgggtaaacatgtgttttcgtaggctcaccatatttatacaagaacaagtattaccatggttcaagttatttatatgggtacctttcctaggccttcatccttatcaacaactgttgatggtcttccccttccgccagagacttcaactggagcaatttcccatgaaaaggcaccactttcttgggcagcaattccacgttcaaaactctgaattgcatagttatcctgaggataaaacagagacatcaacaaaaaattgattacaatggtcctaccgaaacctttctgaacagaaattaatcctaaaatacctggtcgtctcttgttaatgcatggttatctgcacaaagctcagcacacactcccatgccaacatccttatagacatcccacaaaccatctttcaacatcccatcaacaagtgaatcatgtccaaggcgtgatcctttcctgaacttttagtattgaatcagtttatttcaacacaagaactaatcttaaggagagtgtcgaattaaaggcaatattgaccttgcttcagccaggtacttgggtacattagacatgctttccataccaccagccacaacaacatcatttgtgcctaattgaatactctgtgcagcaagcattgcagctgcaataaccggaacaaggttaatatcctttttctgtatttttaaacaaaaatacaaagaaacaaatagaattgtttttattataaacacacctttcattcctgatgcacaaactttgttaacggtagtgcagataactgaattggatattcctgctccaagagcagcttgtcttgcaggagcttgccccaaattagcactaagaacatttccaaaaaatacttcttccacaagggatggatcaacattggcccttttaagagcagctacagatgaatgaaaaatatgtaaacacaaataagtttcaaatggaatgtaataagcactgacataggcttccatagttaccttcaatagctatcgagcctagcttggtggcagatagagatgacagagtaccaagaaatccacccattggtgtacgtgcaacaccaacgatgcaaacatctatagaaatcaaaacatatgaagtcaactaaccaaataaagggttatacagaataaaactttagaaggtgttaaatgaaccaaagaaagggtttataaacactctatatctataagccaaaatgtttgatgaaagacctcttggcttgattgaatctgaagatgctgcagctactggagccattgatagatgaaaatggaatctgtaatccaaaacattaaatacggacacatttaggtaaaattaacgagctaacatgcaaaatcattgagaactaattccatgtacgatggattatgtgaaacatcagaaattgacctcttgatatgaaatgattcagaaatttaaaaagaaaagaagcagcgcgagattgtaagaaaataataaaatttggaatggtgtcttaatgtgtccataaagaagcaaataagatggaaggagcggtgaatagaaaagtgaggaagagagaagcaaatatgatattgatgtggtgctaagcgaaacgcggatctgataaagtgttgagcaaagaagcttacgagagagagaagaagtgaacaagtgtccgactgatatgagtgcttatatatggtcagctcaggtgggaggagccacgagttacaattactcttattttcccaacattttttttttttctgctcgatgctgaatgattaaatcgatttagattcacttttgacataaaagtcatcttctgcaaattgagttggatcatgttttttcttaatcgatgatttggattggtttataattgatgttagcaaaactaaatcgatctaagcaaaaacgatactctttaatatacatatcttattatatgttccatatatgatttttatatattttaatatgatttttttagtgtttcaccgttatgttgtaagatgattaatcaattgattgacatacattttatgtttgttttaaaaataataatatatgtagtagtaagatttgaaccatccaatctaattcaaatcatattttattggattggattaaatctttttaagatactaatttaaatcgaacctaatcataggtttaaaatatattttttttatcaaattttttcttctttttagatcagtttgcaagcttttttttattagattggatgcaaatatccctaatttttataatgttattatctaataataaatcaatatgtataagaaatttattgacttctataattattttatttaccataatatcatgttttttttattgattgtgtaaaaaaatttaaactctaaatatatataaattaaattataatttttatacatgcatttattactaatgtataaaattgcattactatcatcagtaaaaaaaacaatgactttcaaaataattatcataaaagttaattaatttattatatatgataatttattattagataaacaatataaaaacccttttcactaatttttcatagtgatttacttcaatttgtttcttttcctttcttcttctcttttatacattttttggcttaggcgactgtgtaaatttaacgtggatcgattacgttatgatgttaccaaaaaaaccaacaaattgttagatagcatgctgattagggtgtgtagaaaagctttgccaagatagatataattcatttttgatttttttataaaataaatatttttaaatttccggttaaaaaatatcttcatgcacatgaaaaaagtcgattacaatagtgtcttcttaaaaataaattgataataagtttaaggtaattttacatacaacagtgattggtgaattggtcacgtttttggtacagagcactgtggggagcaacggcaaagtggtttggtgtggggtagttgaacagagatgataacttaattaaatttggaatggggtgcatgcgatgcacactaattgttttttatttttcatataaagacacacttgcagtccttgagccacctaccaatcaactaaacaaagtgcatacatataaactgtagccagcttttaatatatatatatatatagaaatgagatatcaaattatattgatgtaactttaacaattattatactatttttataatttaatataaaatgtgatttttatttattcagacgttaaattatatctatatagtattgagattatttatgtcaaattttgtcgaaattgaataacaagaagaagataatcaaattattcattttttagtatattttgaaatgtttatattatgttgactttaatctatatgaataaggtaataaatttttggattaatatgaaattttgtatatatgatttatgtgaaagaaattttcaaccaaatatgagttttaagaaaatattatttagttgaaagttatagaattgtataataattgtcaaaattatatcgatataatttaatcactttttatatatatatataaataaattgtaggcctaaaattagttcttgtctgcctggattgaagtatcatgtggcttaccaatgtcaagttttgaaattggaataactttggtgtttgatttgtatcggtggatagtgttagcttgatcgagcataagaggtagatgacttatttgacatctataatcataacccctgtataatttgtttatagacagtattaacgaggtaattcaaaatgatccgtcaagtaacaaataaccattacccaaatcaattgcttatcaagcatagctatgaaagagacctgaaatacacgatgtaaagcaatttacctacccgcattgttctttttagtgtgtttgataaggttttggggaaaattataggcttttcttattagtttatacaagttacttagaccaaataaatcaattaatttataaactcttagcttatagcttatttttaaataattagttgatgttctagcaagaacaaagtcttggcttaccaatttgtttggtagctatgaaatagaaggaaaatagaaaaaagggaaggataataaagaataaatgagaaatgtgagttgtttaataggatggaaattagagagaaaataaaataaaaaagtgtaaaattcatatgaaaccaacattaaactacctaaaatgtatgacaatcaattgtcatgaaaataatggattgaaaatactaaaatggattttttgtatttatttattttatttctcttaaataagacactcacatttcattttatttcttatatatttcaatttactctatttctcttttccctaatttcatcatttttatctctcatctatttatttccttcctaccaaatacgctataagagatgacactattgttcaagttaggaatgaacccaagaggaatcagcatggacactgacccatctcctttaagaccctttaaatataagagagaaaaatgaaaaacaatattattaaggaaaaatgaataaaaaaataaggtgttgaattgatattttctcaatttcatttttattgtggatcatatctttagttttacacaaaaagtgttaaactgatattaatatcttaatttttgttgtcccttagtttgtaaactttttaagattgtctttactttaatatttttgaattttcctgttataccattttttaggtttgcttcacaataaatacatataaaatgtataaattaggtaagaagtgagggaatagttgacaaactaataatcaatgttatcttgaaatttaaaagtgaaaaataaataccagatagtaaatttttttctaaaaaattaataattaaaaggaaacaaatgtcatattgattaaactttatttaaaactgcaaattaaaaataaactcaataaataaatagtgaaactcacaaaaatttatatatatttttaatttaataaaaaatagaaagtgaactgaaattattattagaaaaaaaatatttttaacttctatacttttcgttaaatgtggtcaaggtctatattttgatattcatcaattttatctttaaatttaaaaaaaaatgtaagtttagtcttttaattattaaaaaatatggcgaagttttagatagtggcaactaaatttatatatttttaaaactgagaattaaattaatcaatataaaatatatgaacctttaatacctttgattgaaaatatgacgactaaaaatatatattttcctattattaaacggtaccgtattggatccacaagcctaggaaccaacgtctcaggacccacagccattgcacgttgcttcactgacccacacggccacacccacctttacaaatgagctaatactagaattatattattaagcgataaacagatattattgtctttttcaattttgggtgataaattacataattatttacatattatccatataaattatttagatagaactattaatactaaaattcaaataatttacataagaattaaaaaactacaaaaaattaattattcttaaatttaatttctataaaataatttaattattatcttattaaaattaaatacttttctcaagaaaatattttttaataaccatgttgaatatactttatatcacgaaaaccttgttttttttattgaaaatatctaagtcatgaaagcttgaaaatttccaacttttccaaattataatatatatatttttggtccttatagttgcaacaattctaccttttaatttttatagtttaaaatattttattttgattcttatagttatgattttaaacccattttggttttgatcgttcttgtccaaaatagcataatattgttaaagcacccaattttataaaatcaaaagttatttaaggatttttttttctgaccatgaaacattaatacaaaatattcaccctaaaaataagagataaatattcttaaaaattgtgagtgcacataaattaaatattttctttcaacatttatttcatatacaacatgatttaaatagtactactgcatttaataactaaagaaaaaacaaaaaaaataactaccattaaaagtgtacctaccatattgaatcctcgagcctacgaaccaacggctcaggacccacagccaatgcacgttatttccctcaccttcctaaccacctttacaaatgagcctgtacaaaaattaaattataagtttaattattgttaatgagcgtaaagtttttatattctcaactaataaaaatatttttatataattatttcgataattattataaaaaataataaattcatcatacataacagtttataattaaataataatataaaaatctttgatatatatattatttattcttaaattattacagataaaggcgaatcagactttaagacgggatatgttttattcttcaaaaatatctattgataatgtaaagatcattcagcaaatataaaatctgaaatactagattttaattacttttaatttagccttatattaacttagagtatgaattaatactcaaaatccacttgcagttctgaagacaattatgaaaccaattgtttatactctcgtttacttacataaaatttaaatatatcttaaagtaaattttaaaattgtctttcataaataatatttgtggtcttttatataaaaataatattttaatggaaaataacaaaagttcagtgataaattttaacaaatggaaaaaagaatgttattttgcgactacgtgtaactttcataatgagaaataaagaagcaaacagtaatagaagttgcttaagtcaataaataattgatacatcagtcaattaatgttatttttgcatccacatatcagtttcttaacgagaaataatgaaacaaacatgaataggagttgcttaagtcaataaataatgattcatcggccatttaatattatcttgcaaccacatgtcactgtcttaatgagaaatcaagaagcaaataggaagaagagttgattaggtcaaataagtaattgacacatcatacatcagtcattaataattaactaataaacccattgattcatgattagttaatgaaaataaaaatgatatatttaacatgtttagtttttttttttggtggatgcacgtttaggttatttttggttttatttaatacttaattttttattcttggtctgagggttaaccagtggtggagccgcatgcaaatcaaccatgatcacgacattacctaaaaaataaaatttgtaataattgagtggtgaataattttttttaataattatatatacttatataattatttagggttaaaaataaaatttgacaccacctaaaaataaaatttgacactacttaaaatttggtatgagctaaatttttttactggctccgccaatggggttaacctatttaattgcaagctacgagagatagagttcgtttagtcgtagatatattacggtccaagacaagctttaccactctatgatcttaatcacggggtgttctctgtctaaaactagccattgaataaggaaaggctcacgggccaacagtttgctttctcacttagaaaactatgattttttctttgtcttgaagtcataaaatgccttgtagtgtcatcatccaatcatgtttctgtaaaattcgtggaatttgctatgcttgtgtaatttaaaaaattgaacatttacaaattacaagtaataaaatgaagatgaggataactttacgtaagtttgaaagaatcgaatttgttggtaaccatttatatcattttctcaaacttatcaagcatttttaccctttgcagggatctgacaaatagagtcataaaaatacctgcacattgaaatgctatatctatcagccttaagaataaattggaacatgattggacaataacttgagaaaaagctttataatatatagtcacctgcaccaatgaaagatccattcgcaatagttatgttgccttggctgctcataatgataccaagatttagcagagttcctcctaatacggtatacatagttgccatttgtaaagccgttgctttccgagcagctctttcagactagcaaatcaagttaaataatttcaaatttacaaaacaaaagttccagaataacgacctcctaattagaaagttgttcccattaggaaaatgcttagaaatacttggtcacacataggcatagcatacaccatgtgaagaaaaataaagattcaactattcacttggtctttataatgaacttcattttgagttatagtccttatacgaaacaaattgtaagttttaatcataaaaagttacatttctattgaaaacactagagtctagagaagtttttgggacgatatacaactgttatagaaactttttggcgataataaactactacaaaaaattgtagagacactaaaatttacaatttttttgttaagaattaaaataaaaaatggggtcaactataagaataaagaaagaaataaaaaaaaaaaactgacctcaagcactcggacccgaagttttagatcccctgcctcaagttgctttgtaaactcttctattctttgaactctgtatggcattgacatggtataggttgtagcctaaaggtattacacgagcaagcgttatcaaatatcaattcaagtggatgcacattagttgcacatgctatagataaatgcttcacatcaaatgagatttttctaatttaaggaaacattatccagaacaaaggtaaaaggtgtggtacatcatctgcttgctttcttatctcctccacaagctggggtgcagtgcgctgcttttgctttatctctaaaagctcctgtaacgtggtaaagtgtatgtgtatgagcatgcattttaatgcagtatgggaacaatatttgttcatggacaatctgaactttgaacctgtgagtagggtgcagcaatcttagcaaaggagaaatttggattgagtgtgtaacctatgcctgtcagaaaaaaagaaatacaaatagatgatgaagtcatacaaagaactaacatatatatccttttgctctttttaacttatttcaataaatttcaaagtgatacatattttgatcaacttcacatttaagcttataaataagttcataagaatttatcggatgagtagttaatttggttgtttacctaactgtgtcttaaatcagtcaaatttttcccaagaaaggaaggggtggttaccatcttataatgcatatactaatgtgaaattaatagtaaacattagggcatgtttattttttttttttttttttgcaagaatgaccactaaagagagaaagatagagagggacagtaagagaattgagaagatgcaaaccttcaagtgttgaaaacgccctgagaacaaaggcaaaggtggatggaaaacggaatggttggtcttgtgctattgcaaataaatcctgccacagaaagccctcaatagtcaataataaagtctggactagattctccagatagtttggaataaccaatagaaaacaataattctccaccttcagcttatcctttagttccattgaaacaaacacccaaaatattatgaaaaaattgaaaagcagctatgaattcattgatccaatgtaacaatgttaacaaacctccccaattgcagaaagggtctgctcctgatctggtgcctggcttagcaaatggtccaggaaaaactgcacagatctcctcacctggaaaataaatttatcatttatgaggtcaatcaagtgtcaagacacaaatcaaaatatttgaaaagcaagtagttgacattcttactgatgacaagtccccagtaggttggagggctccgagctctataaggcgttgtataacctgcaccgttgtttattgtatggttgtatgtttaaaatagtgtgaaagagggacactgaagttgatcaattcaagttatgagcaacgtcaaattcttttttgctgacgataataactggttagctggattgaaatttacaatagtaatcgtacttgaagcaaaagccattttatgtcatcgtgcttgtttgagttaattgtggcaaactaaaaaagttatcatgaaattaaaaaatgtatgttgattaaacacttaacaaaatagcgtatcatgatatcagatattgatttcttattagtaaaagacaatgttatgaatttaaataatccaaaagtagtacaaatccagacctttttggcatccttttcatacatagcatagaaaagttcaagcagtctctcccgggtaaaagatttgatctctcccatcatgccaaagtcataataaataattgcttcgtccacatcaatagcaagatttccaggatgaggatcggcatggaagaaacccgttttcaatatctgtaagacaaaaagtaatgataatttattaactcaacctttttggctacaagagtgataccaacacctatcttcaagtgacaattcattcctcttcttttttggttttaatataggttgagacattttacttattctgagtaaccaaaatgaaaaccatattcaacatcagatattactgttagatcgtaattagcagagaaccaaggtggtccacctgaatcaggtatgcctcagtagcacgtgatgagatacgcaatcgatcataaccacgcgaagttaatgtatccacctggtctattttgatgcctgtccaaggaataaaatcagagataggagcagttaaaaaaatacgttctctagcataatgtcatataaaatatataactttaaagaaagaattattagctcccataaatacaatatattatctctcataataccatagtgtcatagacaattaaaaggagaaacaaggcacattcattagttaagatgaaaacctggtacatactccatggtcaacacctttaaagcagtataatcccaatataccagctacaacgaaagaaatggagatgtggtcaaaattcaatatttttactagacattaaaaatttatacaatttataatcggatgtttgtgttgcctaaggaaacatacaggtatccgaacccactttatgtttctaaaatctcggcggaacctgtcagcattttttccttcatttatataatcaatttcttgatacaaaatactgcaaaatagcatgagcaacacaataaaaattaaggcattggaaaataaagtaatgaagaaaaggtgaaaaagcaatgagcataatttagcatatgctttacttcatgaaatatcgataacaatgcacttcaatgcttattacttacgttttacattcttcatatattccaatccaatctctaagtggaccaccaaaagtttcacttctctgaaaatactctgcaatcaactttaagttttctggacataacaaacaagcaaacttgtaatagttacaaacaaacaataaaatagtaatccttaaaccctaaacaaaagaattcactaaaatagtaatccttaaactctatgctgttatacataaataagttttggtaccaaagggcaaatttgtacctaacagtctaggcttttggattcattgataattggctgttggcaacatcctcttaatcaaaatccctaggttttgtcaatggaacaaacaaagtaaccacaacttactcaaatcaatgtcgaaaagcttcttcagaccaggcctttgaactttgatgactactttttccccattatgcagaatagcacgatgaacctacagacaggctcctccaaaattgatgttactatactaagaacaacattaataagctattatcatggtctacaagatgggagaaacgttctagtttgttctaataatggactaagccacatgctgcctctcacttcatgttacatttatcaaatttgaccaattcgaataaagctacaagtttttaacaataggaaaagattcaatgtaagaaaatataaggtcaaattagattgatccttttttctccctacataaagtcagtttacattttgacccatgcataataatgtctgtgaagtaattggtaaacgcttgcacgcaggggttaaaatgtgagtttttttaaggtaaggatcaaaatggaaagtatccaagtataagaccaaatttttaattaggtaaaatatctttggatcatgtaaaatttgataagtattaatttttttctcataattttttttgaattaatttggcccgtgaaaaaataaaacatatatttatttgtcttcggtggtaactttattagacccctaaccccttagacaattttctatatgcctaattcattattttttctctctctatcttttcaaacacacttaaaaataccagaatttggtgttatttcatcttttccctaatctcattggatagtatgagaaaattgtttaggaaataacaaaaattataattttttgggatgtttagttgccataatttgtttaatttattttggaatttaatgatcacaaattatttaatttatttataatcaaattacatgtgtaagtttgttacctacatcatatctaatggaattatcattgagaactaataaaatatgtcatttatttttacaggaatcaaattaatattaataattttatgaaaatgtaataaacagaaagatactttatcctttttaatttaaccaaaataataaatataatggaatgagctgggctagattcaaacacctgaccgagactagcagcagcaattggccgatcttcaaactcctcaaataatatgttaatgggagctcccaattcactctcgatgaattttcttgctttcttaggagagaaggcaggaaccatgtcctgtataatgttatattaagaaataagaattactttctggtcttgaatataggggaaaaaaaaaccctcatgtatattgattaaaaatacaagcaaatcttaattcattttatttaacgaagttattttcagaataagttttatttaattaagattttattttcaataatttcttatatcgaattttaataaaggatagtctaagagaattttttttgaatgagataagtagaatagatgagtctgaaaatgagaaaaacaaaatctacagagatacctgcaattttgcgagctcatccacaaattgacgtggaaatagatctgaccttgttgatgataactgaccaagtttaatgaaagttggaccaagctgcaatacacacttccttaaccacgaggcagttttccgccttctgcttttctaaataaaaatattaaaatatttcaggtcagcaaaaagaatcatggccaatttaaataaatggaaaatactagtattttaaatttagcaagaaaagaaccgaaccttgagaacctacctgctttgcctctgtgaaacctccgaaatatgtccattttgcattgtccaacagaatccgaatacgtaaagaagccacaaaagaccaaacatcaatagacctctgccaggaactgtaattttcattggcccaactgaaaccttcatctgtggctaaaacctttagctcttccaatgaccttctagatttcactgtcttggtcaagcctgggataccattttttctcactacctttgaagttgctgaaccattcaccaccttattctctaacattctctttcttttcactaactcatttgtccctaccattctaacagctttaccatttgttccatactttgaggcaggcatttctgtctgtcgcattttcaccggtaacctataaaattgattgttccctgatgataatggatcacatgttctggtcctttcattctttgacaatttgttaaccgaaattgagcctgaaaaactgagattgtccagtgttcttctttgagttgccaacttcgtatagtgacaataacaaccctgcattgccattgtttctgttgtctaagatgagatgaagtcaccttaaaaagaaacacaaggataaccggtaagaaaaagagatagcacatgccgaacaccaacaagatcagatatttgtgtacttgatatttttttatcggcgaatgttaatttgttagttttgttagaaatgttaattgagagatttatacccgcgatctctcctccctctcttctcccttcatccttccccaaccactagattaaccttatatctcctaaattacttgtgctacagttagaaatttcagaagcttgaattatagtgctcatctaaaacgcgtatatttttttttattttgacttgattttacctcgtgactagtcgacaaaggtagttttaattaaaaaaatacaattccccccaccaattttgtttttgcacagaaggaatagaacttgaagtacgagatgtttggaattagcccacatgcagattcagcacattatgttaaggtgaaaccaattagattataaagtgtttaaaaagaaaacagagggagaagaaaaagaaagcgggtcatccaaaactctgatacctaaaatggaaccagcagcaagatggtagcctcatcatatactacagttgaacttggtgaagcatgattttgacggtttcgaagaaagaaaaatgttgctaatggggaatatgcatcatgacaaattaaccaatcaagcaaaaaaatgatggattctattacagagaacttgtcacatattatatcaggcataaaaaaagcaaaatcaaacaaaagatactgccaaccatacttagtgtttgatatcagctatttcattgaatgaatatgaaatgaccagaagcaattagtagtcgtattaaacacgagagacaacaacaatattgtataaactcaatatagtaatttacaacaacaaatattcatttggtcttgaacaaattaattagttgagcaacttgcatgaaaattgaacagatttagcatggaatcaaaattattgtacctgttgcctctttacttgagcgaatacagattcagcaaacctttccaattactagcatacttacactgagattttttttatcatttgcctagtaccaacaaccagaaggaaaaaatgttgttatattatacatacgcggccaaaggcatagtaagaatgaaagaggtacaaggatgttgttgcttgtaagttttaaatgaaacagtactgcaagtaactgacttttgcttcagtttcggtgttaacgacaaaaaacggaaagagcccacaacacggtgcgtgtaaggctcttctatctcttgtagtttttcaccgtttgccattaatcactaattgccttcaatttatgtctaagccacaaatatcataaatgacaaaccttcaatttattcttctaactgttaacctaactatgccacgctattattcttttcaaattcaaaattactatcaaattagtcttttaaatattaaaatgatatcatatgaatcttttatgtgtctcactcctagaataattatttattattttcccacggtacaaagcttcatttttgtgaaatctttttctttccactttcttcttttttatatcaacaacatgaaagtttgtatattttgttaaattattatcataaatgtaaaagtatttttgtataaatatatttatacaacagaacataaatatatttatatattatagaacacaagcattacttttttttaaaaaaaaaaaagtcattttcaacaatgatagatacaatttcttttaagctttcaatatcacttaaataaataaataaaatacttataaaagtctaaaaatcaatacttaaaacgtgtatgataaaaatatgtttaccttgattttttttccttttagaattatatcttataaataagaaatctatattatcagcaatttatttcaaagacatggccccacgaatgcattccttattcaaagcttccactccaaatccaatgcactatcggcatcacgatttctcaattaccatttaccaagcaatgtagtcactcacgtattgatgcattccaacagaacattacgaagcaaatatctcctactacctcggtccttactttcagcaactggggaaaaaaagaaaaatttcccttgcagattacactcaccatatccctcactcaatttctaataatttatattcatataatcatttaaagctaactttaactaacatcaccgaaggctcaagctcaaccgcggaaattgatagctaaattaatagagaacaatttccattcattcaatttcaaacaacaccacaacaaaattaaaagaagaaagttaaaaatattatctatgacatactctttgtgatcgactaatattttttaaaattattaattttggtagatctcatgtctaaatcaaaagaaagaatctatgagaaagaatcaatgataagtgtaacccactaaaattaaaatagatgatttttaataaacgagtatttttgacagaacgagtattttttttttttttttttggatttccctgtcagactccgaaacctgaaacacgctgctatgtctttaggtttgtggagcccattatcagcttcaaacctctcctctcatgcattgtgtgcttcaaaattcaaagtcactggaaagagtaaattcattccgttcaaattctaagaatattttctagtcaaactcataatccaattttatgaaactagtaatctaactatcatttactttctaatttcaccaattcaggttcataacaatttcagatttccatcttctatctatgccattaatatgctagctaaatggttcttttatttttatgcctttctttatacgcctgtgattgtgaatgcttgctgttattagtaattattcttttctaggagttttctctttgttccttttttatctgatgtagtttcgccaactccttattgtgtttagacttaggaatgccatttaggtcttcaaatgctttgtaaatattatcatgattggtttcaggtattttgatttcaaattgaagtttagaagaaaaatcaggtcctgtaattgtaaattctctcttctctattatgagtgcttgtgatatggcatgctagtgctccagatatggggcctgcctttttaatttaagttctgagaccaattatttgtgttttgtctaataatcctaattctttgtgtaaaaagtagctgctagaacacttgactttaagtttatttttttaatctcctgtatatagaaagtgactgtgttcgagaaatcagtggaagaaatagataatgatgacaagcatttgagatacctgagttaggattggtttccttattttcaagttaatgactttctgttgtgtggtaactcataggcaggttgggaaatcactttattagagtatatggttccaaatgaagggatgcatgctactaaggtgtacataagtaataagaattttcaattgagaaaggatttaactttattactaagaccctcctgcaagcataacatggataatcagaaagtatatacttactacttagactgtaaccgggtggtacactgctatcctggtttaacaacactttacttgactgttccgctttgtactttttagttatgaaatttctcagagaaaaaaatcttacttttgcaggaatggtgggtttatctctttgagaaaaacatttcattcctcaagatcttcgttgtgatggtagaaagagattgacatatcaactaatctctgttgaaactgaagttattccccgggctaggctttaatcagttgacatttggcagggtattctgattattaaaccctggcagacattatttttttactttttgctttaaatagttttaaaagtggagcaggtctattttctcctagagtgaagattatgcttactaccatatgctttcccttccatgttgttgcctctttttaatatagctgttgagctcttgtttttttcccctcaggtgctggaattgacctctcctggcttattctcgttgaaggaaaaatttgttgggatccttacattgatgggctttgttggtgattttagtgtcatcaatggattttagtagtaatgtgatttactataggccaatgcgattacgcgttaagctttggaaacgagttagggtagtgcggagtgcacgcttgttgagccaacgcataattgaccgcgattacggtgcggggttccaacgcataatttagtcatgttgaattgatttcttattcatgtgggggattgttggagtttttgtttaaactccatgggttatgaataagaggtggttaacaattcaaaataataactacttctaaccgctcttgggaaaagttagaaaaataactactcccaatcgttctgataaccaacggttacgatggttcatcgtcaagagttgcattgtttggaaaactcctatataaggagtcatttggcctcagatttcaaatatacgaaaatcatactttctttctacattcctgatctgttctctattgccagaagcagattgttcttcaaagaattatcccaacaaggatttcgtgaacccaggcaagaatagggtcgaaatactttgttcggaaagtgtacgaacacgattctttgaagttatccaggattatcatacccaaatctctaacaggcttgttgttagttcagatggaaatttgttggatgctctaggcgctgccatcaaggtacaactttaaacgaaaatagaataatatactataaaaagctggaaaagatgataatgatggatttctggctaaaataattagcgtttcagagatcatgcttttatgttgatgtcaattttcaatgctgtttacttttcaagttttcttgttcatttaaccttagtttagctattgatgttacaaacatgccatttgggctgtttgaaatactgcaaagcagcacgagcaacacaaaaacacgtaagtttaccatttacaatttttgtttaatagcaaaatattattctattggatacaaaaactaagttttatcaagaggaatccagcattacatttttatatattacttttaactttattattagttataagttaagtaatttttaattaaattgaggtttaagattcattaaattaaatagagaataactcactttgtttaataggccgtatgaattttaattacgttcaattattctataggctctttaactatttaacaatttttaattaggttctaattttttttttcaattggatccttaaaattatatttatttttaattaaatttttttgtctaatcgcttttaacttttttaaagtcttgctaccaagtattcaattgaaactaataaacagaaagacattgttttgaaaattattatgaaaataaattgctgctaacattaaataatgtattttttttgtaattttttctaactttaactccttaattactattaaaatacttgttagtatttttttttctctttctattatataagggtttttcataattatctatagcatctactaattatattaaaatgaactgttagtattttcataacttcacaaatacacttatttataatatcacaagtttaacctttgattcttcaatgaataaattacattacacgcaacacgcctaagattttgtaaagttacacagatcctcttattttttaatccttatactaaccccttaattatttttaaaagtttacgttgacgtccccttatacgttacttagattcttttaattatttaaaaaatattacatcttgttcctatacataagaaaattgagattattataaatgttaaaaacatataaaaaattgtataatttcataaaatctcaaaaataattaatgtaatttacttctttttaatttaatggttaactatagggaaatcctttattgtaaaacccctcaaatttaaatacataattcattttaatattgtatgtttatatattttctcttaaaagatttttagaattgattaaattatgcttccaaatattatcagctaagtatatttgaagatctatatataaaaaaagaaaacaaaacatctttgagttttaatatgtgagaattgaatacatattaaaaggtttataataacttatacattctacttaattaactaaactagatttttgacttttttaattaagttcatattattaatttttcatctcctaattaagaaaataattcaagaacttaattttaaattgctaaataatttaggaacttagaaagtaatttaacttttagaaaaaacaagcacacaagaacagagaaattaagaagaattaaaggagaaaaacattgtagaagaaaaggtcattcttaaatctttattattatttaatttagagtccgtagaaaaaaacaattatggaagtaattgaataattgatgacttcctcgacggcttggctgtactttgagccgcaacaggtcaatgacaccgccgtgctcatggaaaaatgggacggtgattcccctgtctccgtattagaaatgttgaatgggaaagtaaagggtcaagaaaagaaaaccaccaaaatgaaatttcctcatcactacctttgattttcagtttacataccttccttccttccatccattctccaaaattaattatatatacgttgtttgttcctatcatctcatctcatcccctcattgtctgcaaatatatatatatatatatatatatatatatattacaagagaagagctacacaaccaaatggaaggtgaaaagattgaattgctcagtggagttgaggatcatcatggaggagtcgttgtagacgtccaagaccctatggattctacgctcttctcttctatattgcaagcttcaatctacaagtggagccaacagggcaagaagggggtctggatcaagttgcccatacaacattcaaatcttgttgatcctgcagtcaaggtaaacatacattttattatcatttatttgcctaagcctaactcttaattaagaagccattttgctacaaattttgtgctcctttttcaggctggatttaggtaccaccatgctgagccagattacttgatgctggtacgttggattccagatactcctcataccattcctgcaaatgcttcacatcgtgtcggtgttggtgcttttgtcatcaacaataacaaagaggtaatcttttctttatttctttttcaatttgaagtccaagctttgaagcctgaataaaggaggaaacctttgaaatgatcttgtttcatttgacaggtgcttgtggttcaggaaacaggtggcaaattcagaggcacaggtgtatggaagatgccaacaggagctgttaatgaagtatgtcaaaattattattattatttttggacagaaagtatgtcaaaattattaccgaccaaattattaaacttctaaaattatcttttgatatgtttcaaatccacttgcagggtgaagatctctgtgaagctgcaattagagaagtcaaagaagagacgggggtaagcaagcaaacacataatttatagtttagagtaaattacattccacttgaaatttgtcaaaataatagcaaaccccgaactcaactataatttacaatccactttatatttttctctgtcactaattatttagctaacactgttatgtatttttttaagaaaaaaaaaacaatatcagtaagatttatatacaacattttttaaaattttattattttccttacaaacttaatttttaaatgtaaaaataaaataatttaatgaatatcataaaaactggcattcatgtgtatttaatattttatcaattatcatgctttagtaaatatctaatatacgattaagacccttccttttttttatcatgttcccttgctcttttgcttataatcaaagactgattccaatttgaccccaaaaataaaggcctatgcttctctgttttgtcaaaaaaaaaaaatggattttcttaatttttctcagaatttattccttacaaaccttaacctcctctgaaatcttgaaatttcataattacactatatttttatgcatgtgacaatataaatatttaaaattaaataatattacttagtaaattttaattcaaattattcaactaatatcgaccaagttttgggtttgctgttttgacaaacttggttgtaattttatctatagcttatatattacatgttttttggattgtttcaaagtctaatgccattactttcattcttttttcagatagaaacaaagtttgttgaagttttagcattcaggtaatatgtggtgtgaatgcgtttttttccacaaataaccaacatactgctatgcatataatttacactctgaaatctgaattaatattgaatgtggccttcacgttcaccgacctttatttcttttgtactaggcaaagccataagtcgttcttcgagaaatcagatttgttctttgtttgcatgttgcaacctcaatcgtttgacattcagaatcaggcttcagaaattgaggcagcgaaggtatatattctaatgtcaattgagaatctcactaattttcagttgacatgtctttaagtataactaaagaaataccatattattttcacctttcactctgttaattattaattactcctaaaatgaaaataaataacaaaccaaacgcaccctaaaatgttgcttaagttcatacttcattttaaatctctccaagtcaatgaaggctacaggctgataatctatcaagacattggtaccaggaaactttgtaatttctgtaattatttaactggtgtctcgtttttttcattcagtggatgccagttgaagattatgctgcccagccttttgtgcaagaaaatgagctctttgactttattagaaaaatatgcatttcaaagctggatggcaactacaccggtttttctaacgtgcttacttgtacatcttctggcaaaaagacccatctgtattttaacaaccgggatgccagccttttgttagcttccaaacaggagcaagattgacatgtatatgcttgcaagttgccgttacatatacttgtaaactttgtggaacaacatttgtggacagcaaactctagtagacacctagatcctagatagataaagagagaaaagacagataaagtatatataatactttgtgataaaaagagaaaaatagactgaaataatagatgttaataaaatgtttgatatatagaggtatttatatatcatactcaaactttatttgttaatagtacttacttcaagctgtatacgtaactttatttgttagtactttttccaggtgcatccggaacctgaattttatgtcttcaataaggataaaatatggtgccattctactgtttgttaattttataatgtcatctattattgtgtagaggactgccgattttctaattcacttcttagagccgagagctaaagccaaaatattaagttgaacatatacggcattttttttaatggggatgatgtcatataagaaagttgtttttgaaatctgggacccctaatcttggatcagaaatttttgaggtggaaaataagtgtaggctagtagaataagatgctaaaaagaacatgcacttctgttagtacgaggattttttttctggtgttttgtacggtttcatccgaaagtctcaggttcagaagagatggactaggattctcagcatttaataagtaactgtaggtcatgcagtaacatccgtgcagtggtgcagttcaatctttcacaatccattcttttttaattatgtttttctatcaaaattttattcaagtagaaatatatattaatgattgagaattgagattcatgcagttggaaaagaaaaaactgcaggggatcttgatcccgtgtttatagcgctgatttggcagctgcagacaccagactgagttactttaaaatggttcggttccgagacttgaaaattgtaggcacattgcagtgatggtctcttttataaatactatataagtgaaactatagttcaaagttcccattcgcaattcttggcaacgttttctttctcatatctgcaatatttccggctatacagctccatcctggttttgcttatagaaaattgtaatcttgagggtgaaaagaattcttggcaacgaggatgtattcaccctctgcagcacattgaactttgctccctttgttcaccgcaaaaattatgtaatgaacaagtcaaattctttggttgttgtgaattgaccactagatacgggcacgtgttacatgctccgcgagttagaaaatctgtccgtacccgtcccgtgaattcacgcatatcctcgaattcaactacctgtggatttttgtataccagcgaatacccatagatatccatgaatgttaaaaaatgaagacaggtgaaaagactagtgatggtgctgaagtaaatttgtatctgcatataacgatatcggtttacactatccgttgtggaatgtaataaagtagctaataaagcagctacagatctcctatacagaaccgattaggactcgggccaaaggttacattcaattcaatacatggatactgggaaggaagacgtcgcactagcactaaccgagtttctctaaaatacacactagtacaaagtttcttccaatctttagccatcaccgattcaccgctgattatgttctgttctttgcaaatttgtataatctttgtctatgcaattactttaatgactcacttaatgtcaagaaatatgacactcagctgcaaagttaatgggagatccttcatccttctcacccccctaacacgcataaatattttttttgtcaacttttcgaaactcagttctattttgtcaaattctctgtagaagaagctttaaatcttaacattattgatataaatatgaaatgggcttggcctaagtgtccaatatttagcttgattaataatactgattagtctcatatagtgatttgatcaggaccatacatcatgtactggtttggttcaggactctgataatttctgattttttattttcatttcagttttaaattgtggatgctatcggtatcggatttgaaattacgttatgattatcaaaactaaaaaataaaaaattgaggacaacttgagcagctaccgcaataattgctgtttagaaagcctccaaaattatgatattgcgactaaaatttttaaaccttgatttttcaatttcttttatcacttttggaaaacaatatctccttgggattaaaatgctctgccactgcataatcagtataaggtacaagtttgatcgatgggtgggccatatttttaaaattctatcattcagttagaggaaaatgccgttaaacatttaaataaaaaggaaactgtaagaaatttaattaaattacagcaaaaaaaaggttacctcgctatataagcttctcttaattcaagttgctactagaactgaaatagtgataagatgataagaggatatttaatgagaattttttaagttattttttataatttttatattattttttttattttcaaagtgtcatatcattataaaaaaagttatacataatttttctttaatgatgagaaattctagaaaattttaaaaaattcatatttttatattttatttaattatggtttaattataatattattatgggtcagataaatattattttttattattaaaaaataatttcttataaaaaatacatatctattttcattatcacatggacttgttataatagagaaaatatattatttttgagatacatatcttattcacttgaaaaatccgattgaagatgatttaagtaactcataagcagtagcaagttcaaaccttaagccaatgtcgtattacagtacaaaatccgagcttaatgtcttagaaaattaaaatatattaatggtgtccgaaaaacattgataagtagcataataacaataataaagaaaacatgaggggcgaatattgatatcaaaatctaatgaattgaaaactgtttatatgcacacatcccatagctggcaggtagcacaaaccggatctacccacactggaaaaaaaggccaattaaataattcggaaaacaaacaaacaataaatacaaaacctataatactaacagattaaaaaaaaaaaaaaaagaaagaagtacacatggcctcctacatgtgtcggtggcagcgttttatttccttcacatatattaaagaaagaaaagaatcttaattgcaatgatggttgaccacaagtgtatagtaccgacactccataatccatatgtatgggtgtttcatagagccaaaaagcccataattaaaccgaagaagaccatgaggaatctcacgtgcaatccgcttactccattgctgtcttcatcggcagccttctgatcttgggaatcatccgatggtccgtccgccggtgcatccgccgcatctgaatcggcggcccccttcttagcgttcttcttcttcttggcaggcttaggcgactcggcaggtgcttggtcttggtctttggcatcgctgggcttgaatagctctctgggcatcaagaccctgtttatcttataagccacgaagggatcttgatctatcaatgtccccactatgctggccgtgttgactttggtcttcaggttcacgtcttctccttcactctgcaccgtgaagtcgtacttgttcgctccctcggtggccagagtgttcatgatgccgttgctggacttgagcatctgcagggactcgtaaacgggagtcgcgtggtataacagaagtgaaaccttctgtgcttcggtgaggttcttgtactttggcgcgaaaccgctgacggcgctgtcggtggggcagaaaaccgttaagccgccgtcaacgttttccttgaaagatggaagggctttggagcctcttagaaggtccgcgaaggccttgcagccttgtttggacataatggagatcaggtcgatgtccgagggggcggcggtgggggcctcggcgtcggcggagctaatgggggcgctgatttggaggacggagatgtagtagggcatttcctggacggatttgacgtagaaggagtggagggagccgtcgttgtcttcggcggcgaagccgaccttgccggccttgaggttggtgatgttgacgtagccggcggtgccggaggcggagccggtggcctggaacatggaggagacgagggtggtgctgttgttgatctggtggagctttttggcgccgaagtagtcgacgaggatgtggagagagaggacgtttttgatggtggggagggagaggtgcttgtcgaggagggaggacatggcggcattgtcgagggccaggacggtgatggtctggcggcggttgatctcttcggccaggtgggtgagggagaggtagtggttgaaggtggagaagccggggtgtttggccagcatgtgcgtgatgttgtgggcggggacggtggcgacggcggaggaggctaagaagaggaagaggaagagagagaagaggttcttcattttgtttggaggattagggaaagaaagagagagggagagtggagaatggagaagagaggagtgtgtgggtttataactaaagcagcatgtccgtttatgaggagaaggcatactattaatgccagcttgggattggcttcgagatggaccccatcctccattattttgacaattctattaagataactaatttaattggccccacttttttataatatttatattataatacgtgtttgagtttttaatttagaagaaaattaataattagaaccaacaaagttagttcattcggtaagaatcatatccatatatcaatatgagaattttttgttaataaacaatctataaatacatttttttgatgtaattgagagaaaacattttcattaaaattagttgttcaaatttcttggataaaagttaatcatcaaccaaatcaactaatacttccgacaaaatgaaatgtgaagattagaaagaatcatggatacataaagttttgaattagtagtatttaataactttttgaagagtggtataaaaatagtaattcttttgaagaaaaatagtactcttgtgataaattatacaattaagagagaaatatgaaattgtaaattatataattaagaaagaggaatgagatataataaataagtaagtaaaaagtattgtataaaacagtgtatgagatagtattatatactctttctggaatatatgagatagtattaaagggcaaagtgggctaattgagcaattgggcatccgcatcccaccgacgctcttaggccccactccccactaatgtacatgtcagtttcacgatttttatttcctcttttaagtacagttgccaatatttgtttgtattaaataaaattatcatttaaatatatttttaatttcgataatttagaattttttattttttataaattattttttaatttttagttcttataaattatgtttttattttattttttattcttaaaattcgttaaatagtattttttttattattcaaagtattatctaaaatattttataaaagacaatttttttttgcaagaactaaaaattaaaaaaaaactaaaaaactgaattgcaagaaaaaaaattaaacttaaaattataagaggagtttggaatttggatgctcgctctctggtactattttcgatctaaaagtgttagtgttcaaggttaacatatacatattgaggagtatttaataaatttaaaatattgagtaagtgaaatctataaaattttataatttttatttgatgatagaaaagcgtattaaaaaaaaatgttacaaaacgtttgttaacgatgaggacaaatatcacactgtcctgtacctttgagatttaatttgctgaaagcattcttgacgttgaaatttttctcaataaaaaaaacaccaaatactattaatttacgtaaatccaaaatgggcaaaatcaaattttatcatcgcactagcaaatctacaatcatgtttgcatatgtttttaataaaatgtggaaataaatagaataaaatatagcataaagtgaaatgaaataaaattataatgttattacttaattattttttatgaaaaaaaaatatttattacatactttcagattaaaaaactaaaaaatatcaaataaaagaaaatatatttcatgaaatagtgttttaattgttcataatataataaattttatgttattttgtttaattaagagattatttgtagttttagtttaacgaataaattttatgttaatttagcattaatttatgcttcatgacgtgggactttaataaagttgttcaaagataagcagcaaaaacaactttttttagtaaaaaaaacataatagttttcttttgatccttcaacgtggttattttataatatagtatgatcataaattttaattaaatataacatttgatttgcggctagctgctgagtgaaatgtattttttagtaagaatttgacttaaattctctcaaaaggtcatttcattttaaaatatctcgtataatttacatacattttgaacaataactgagaaggattcaagacgagtgatttacacttgtatgtttaaaaataaaaatccgtattttagtttatatttgtaaaggtaataattttagtgtcggtgttcattctcaataaaaaaaaaatatttattttttgacaaataaataaaataaatattaaaaattatatgacttttttagaaaaattatatgaaattaataaaacaaaaataataataaatagtataacatctaacttaattaaaaatatataaaatattttaaatcctaattataatatatatgtataatatacttgcatacttcgcactaattatatgattaaaaaaatatgagtagatacatgaagtgattcagttattatagtattaatgtactattaaaaaaagtattattgtactcatacacttacttatctacaaaaattctgtgaataaagtcagcaaaaaaaatttatcatatctagattaaaacctacatgaataggtaaaaatattatccattatagacaatttttatagatgtgtattaaatttaatcatcatccttagatagggtactgtaatgcgagccagataattggcaaaaatgtataatatgtgcaagtgtgcaggagcccccatctaatgtatatctatgttttaaattgtgttttgcgtaatattaatgacggcagtcctctggagaacacgttgaaattattattggtggcaaaatcatttataaagaccaaaatcttttgccagttgggacaagtttggctcaatattccaataaaccagttcaagcattttatttttcctagtgaaaagggctccatcattgttcgtgacaaataaatttatgttttacattggttgatacatagttgtcaccctcatccttgcaataattaaaggccgagccaccaaatttggaataaaaagcatcaaatagcatcattgtggggcaaccaatagttgtactgtttcaatatttaacagtaaggttgttgctcaattaagaacggagtaaacagtgtcttactcaaaagaaagttataaaagctacccaaggacatttgattcgtttctttgtttttggttttaggataagtaaacaaagttaaaattaactgcaacaatgtcagccaaaagagataaggtgatgctcaagatttaagaaagtttgaacggaacaagccagctacaaaatacataagaaacttgtatgctagatctagcttctacaatgaagcaagttaaagcaaagttggtttgatatataataggtatcccactagcataggtttatgaattgatgcaataagttgtctaaaatcaggtaattatggacccaaaggggaaaaaaatgaatcagttatgtttataagatgacaactagatgtacctccattcccctctagttagtatgctgataccagaaaatataatgtggaattcaagtacgtttcaatttagggcaaggttcgaagttctgtgtgagaattcgagatgaggacatatgaatatttgtcacagcatagatatggaggagcaagggcaaggtacggttttttatgttttgggtccaaacaagcacatatttaaaaggtgctattttggtactctagatccatgatttgctaggcccagttaatattaaagaaggagaatcataaaccgggtccaggcttcaatgggctggctactcaagttcaagctatttgggttataactgaagtctgaagataatgaaaatccataccttttcaccaagggaagcaacaacttaatgatgccccttgcaaaccatttgtacatatagtcatttgcgtaaaaaagtgaatgttttataacacattatcaaaattctcactcttaaactctctaattaattaattaaagttaaatatgttactataaaaaaaaattaaatgtttttaatctttgcaagtaaaataaattaaatatactttatatcccttaaaaacaaattttcttgttaatctctcatttatacaaatatgattgatgtagtcattgtcctttataataaaaaaatcatttaccattgatcctttatttatagaaataagaccacgtgtgacacaattttataaatactttatttttgggatttgagaatataactttattcttgaaaaagaaacacaagaaagaaaattcgactactctattgtcatgaagagggatggaaataggggatgttttgccactaatcatgaatttcatttgaaaaatgtttaacataccatattataatgtttattacctgttttattctaaccacggagcttatagaacatccttgctttgaatccaaagcttatgcgtcaatatcctttttatttgtagtatgaaagctggcattcgaaggattgagaaaattcaaagttaccaattaagtgacgtatggtgataaacgaatcgtgcatgtttctacaaaatggatcaaaattcaaaccttaacattccttgctaagaagatgataattcgtgaccatacttctaaagttaattacataataatgttttatgcctatggtattatcgaagttagggaaaaagttcaactttaaaaagagttataatgttgatttgatgttgaaaaaaatgatttaaagattgaagggaaaatagtaaaaaaaatcatgagttcaaatcttcaagtaacattaattctaacaacaacaaaaaattcaactttatttatgtgtgatatgtcatgaaatagatgataagaaagctaatcataaaaattaaagttcatccaataaatatagaaacatcaagtttcattcaaaatattcataattatgtccattttgaaataatctaagaacaaataaaaaatacatttatatgaaaaacaaattaaatatgatacaattaattattgattattaaaaaaatagttagtgatcacacataatcattttaaaaagtcgtatagatatttttttaaaactttaaaattgaaatatgatttgataatctgtatttatagttcttattttgtatagtaagaagagttttgtttgatatatttgtgtgtgtgtaaaagtttaatgtatattccatttttggaatgtataagtgagagagagagagaaatgattgacgtgacaaatatgattaaaaataataaagaaatataaaaatgagatagaaatacaatgaaagaaaagttagatgtaaaaatacgatggatatcttttgttgtgttggggggagcatagtctagattatattttttgtaaatggaggaaaaatagatgtttgtggctttgtagcatatttcattttcgggaggatgtctctatgtattgccttttcgaaagaggtgaggtattctgttgtgagcagatttttggcttcgtgtatggcacttcttgtgctaaaactgagacatgattataataaaataaaaaatgttggctttaaaaatatatataataacctatatacgatcttgtttaatttgtattgtagttgagatgtgaatccctaaatacaatgtaaattttccaaattttcaatcactgtgttagcattcaactaagacccattattaaaagaattttataacaaacttataggtttgattttttttaaaaaaatcttttaaagattttatgattatattaaattttaatttgaatttataaatactttcatcttaactaactatttttaatcttaaattcgttgttcacatgtttataaaaattccttttatgattatataagagtattctcatattattcatactatatttatatttatatatctttgagtttggtgtgtaatttttttgttcttgaaatttaaaaatatttttttaatcactgaattttgaaaaattactttttatagttctgacataataaattgatattttgtgataatttttaagtactttatgacaaatttttttaacactttatgatagtttttaaatgcaaattcaaattaatcaaaaataaaaattaatttaaaacaactaaaaatcattataaagtgtcaatttattatgtaagggacttaaaaaaatgtaattttcaaaatttagggattaaaaaaatagtttttaaatttcaaagactaaaaaattacacacctcaaattcaaggactaataattaagccatatatatatatatataaacaactattcaggcagcaacttgcttgtttatcatttgcttagttcaaatttgttattttggccttttggctatcatgcttctttatttgaccgatcttattgtgtaaattacaaaatcatattttatttcaaagtcactctcttgacatttttgcttacaatgcaaatgcccgtagaagactttaacaataaattaacctaaaaagagagaatataaaataaaataaattttcacaactttgccaagaagcagacaactatttaagttgcttattccatagggcaagataatgatgttttggcgtttccccccttactgagtatgcgtcacaagcccaattaataaacttcataacaaaatatgattcttctattttattgagagaaataaatagtatcatggattaagactaacaagcatctatgtcttttaagtttaacggttgatgaagaataatagattttcagatgaaattattaaaaaaaccatttgatctaataataaatgtctacaccttttaagctcgttatttgagagactgtaaactataaattagaatgataaagataaaggtttagtcatagtcacaaatatgtcctttgatggacctaactctaatacataatcaagtaatacatgtcatccctaaattagtttacacctttacatgattaaggcacaataaacacctccttcctttcactaatacatgtcatccctaaaaaagggcaagaaccattacaagacgattagaagaaatattctataaataggtgtgatttgccttgatcatgacaagccatgcatagtagaccttattggatttcttgagttcttaactgactttataactcctcaatgagtgtgttctttaacatgaacatatgtataattctccattaatccctttgacaattggtttgatgcaatatctaagagcaacaaatatgttcatttcttaatacaagtcatgttaacgtgattagtatgttgaacaacgtacaagtaataagaatttatatatctaatgttttaagactttgagttagatgtgatgtccaatttatttatgtgattgatttatgacttattggtgaagattttttcatatcatttcatattttattacaagcatgttacactggatggagcaacaacatgattgattgattgagcattttttcaatttttgagactcatttattttccttttattttttcttgtcatagaaaattggcttattttttcattttctttccatcctaaatttactcaatcaaacataaacaccttgtttatattaaattttttataggtgagaaatttcatgaaaataacgaagattgagaaaggatttttataacttccactacacaaatttgacggagctcccaattttattaaaatgaatgttcaaatattaattcactcgtagagttgttgctcaattaattattcagtagttggtgacgtacatgtgggaatggaggatatctagttgattagctttatgaaggaaatggggtctgaatcaaaccacagaacatatgattgtccatcatgcatcaaacaactaccaaatctatgctagcatatagtaataactatgaagtaacaaattttacaaacctttccacctgtttaaaaaaaaaactataaactttgaagataatgatccttgttagattattatgtaatgtttagttgacacctagcgagtaactgtgaaactattaaagtatgctaccatctgttttactttgagcttgttatcattgattggatgcttaaaaggagatgcccacttcctccataatttgctctcacgagctttagtggattaagacatgctcaactagtacctattatgctgactccttttggaaatataaaacaaaccacatgggaaggtagatacttcggggacttggacatagaggccttgctaaagttgggtggaattgatgaagggcacgcaggagctacttgtataacttcaaaaggcctaaacaagaatctattgatgcttttacttagcttttcacatggttgtttgaactttggaatcttgggatgctatggttgcatcttaaattccaaaagcagctatataatggaaaagatccgtatgtatctactttttgtccctggagaatttatttgggtttggcaccctttcactaagcatatatactttataggatgcatcaatgttaataaccctataggagaacaggagaagggtagaaaatgaaagcccttggttaattttcattattattatacattagaaaatgccccttgaaagtgagtttttgcttaaaacgattaagagtgaaataatccttaatttaataatccatcatgattttgacgtacgtattaaataatcttaaaaataaatataattaattttacttattcactttacatacatgatttttcccttataggttatagccaataggtctacatctatttgaggattgaagcgactataatataattatttggtacagctatgaaattgtagacggaaaaaaatggttcaaggggccaatttccaaatccctgcagaaagagtgctctaacataaagccatgatggcgcaatttcttgttcgtttcaagggagcagacgcattagaaaaagataaaaccgtcgttggattcgataacaagagcctagtcctagtgaattctaatacaagaaagccctctttatgcattgtttatccgatacgatgtactatatgatataaaacagctgattacccattacttgtaactaaataaaaataatcacaacatacaaacatgaatatgaaatacagtggttggctcacaggtaccgatccctttctctatatcctttgcaacaaaaaataatttattcctcacaaggaatatgtatattatactaaattgacaatagggttgaaatagaaattattgatttaatattatattttcataaactattgatttagtgtcatattgttttctagtatatcgtgaaattgaaccatcaaacttcaaccaagaggacggagcaggcttttatttttctattcatgggatgggttgtcgatgtgcagtactcttgtcattggcaaaagaagtgcactagtattgaaatgattaacctttattatgcaagacaagaagttgcaaacaaaatagaaaaaagacaaagctaacatgtcaaatccaatccaacaactcatgttttcctgtatagacaggaagcacaaaacaatggatgctattttatgattttcttttttctttatttttttagaagatgccattttatgagtttagttgacaataatagtaacaagtagcaagttacgagcttttgacttcaataccattacgctgaaaacaagttcgtttagctggtgtaatccattatggtaccgaaccaatattctgtagtgttagattgctttgctttacaaacagaaatttaattaatttaatttaaaggaccggcacaaggacaagaaactgtgcaaaaagtatgcactgtttcattagacagtgtttggttgttcctgatagcaggggaacattctcctttaaaccagactcataataattagtccacagcggaatcttccaaattcattggagaataaaaccctgtatacttgcttgttcagttgctttaaggcagggaaaagtggcatcctcagagagagaaagagagtgagaggctcatcaaatattaaaataaagcaaaaaaaaactattttttttttctataacaacaatgccactcttctacctagagtcaattcctggtttgctttcaagggtttcttctatttatgcactgaaatgggtatgccatattgctttctgattctttcttctctatctaatggattcgtgctgtctcgcagctgagcatggatatctactctactctctttctgtgctgactgctgaagtttttgtatggtattttgttctgaggatagtagtgattgcgatcaaaatctgggtttcttccactttcagtgatgggtagtaacagcagaggaaaggatggtgaaggcacttctggagttaaaaaggatgagtacgaacaagacatcaaatttctgccacctgaagtgctttatggcaatactaatggattcacagatccattggttcagttaccttcacatggccctggaccatatgagccaccacctcccttgctcatacaaccccaggtcagagttagatgatcctttgttaatgtcttttattgaaaaaaataaataggacaggtcgtgtttaatgttatagttttatacagtgtatccatgaggggaaagaaagaaatttgatcaaagcagtaagaaataagcatcctatcaaattgggatgcttctcagccttctctagactgcttttaccgtttaatagtgatttgtggaattgggatggtacaactaaaatcagattttaggttatagggcatagatcaaagtaatctttcaagttttagaattttaaggtggatttaatattttgaatactaattttgtttatcattcatatgggaaacactgctggtcctatagggaattgttatgagatgtattggccgaagaaatttataatgagacttaatacatgcatgttattgcaacattagttcactcccaggtaatatatataaaaatttaagcaattacaataaggatttaatgcttttaatctgatgaagaatgtacaagttaatagttagtgccattgaatgaagctactttgacagtaaatatcttgagcggcacaacacaatgaacgtttacgttaaaacatcaaatttaaaatgcctgttttcaaggtccctgtggctgccatgcaaatgcaaagaccagcagcggtagcgcaacccctgccacaaaatggatatgtagaatctgtgattcatgaaaggctgaaaagtgtgaggatcacatggaaccatgcagccacgaatgttgctattgcaggatcatgggatagctgggagaccacgtaacaatctacacaattttaaattccaactatagttcttgctcttacttcatcttatgatatgatgaactttttaccttgtcctgtcagggagcccctgatgagagtagatcaaaattttgtcattgttaaaacactcccgataggtatctatcattaccgtttcattgtagatggctacttgacacatgctccagagttcccatcggcttctgatgattcaggttatggctacaatatattggatttgcaggtaatttcatggtttactttattagtttatttttcaggaaatgctgatgatcatgttgattacatcttcaccagtgttttcttttactataacctttaacacgatcatcaattcagtcgacagtttggctttattttgacaatatttattcagcagtacttactaaatccatttagtcacacgttgaatcattttttgtcaaaatttgttgtctgatgaggaaactcatcatgcctgagtggatggtctcatactaaactagaatagactatagagctgcatgcttggcacagaagtagaatttcatatggcatggtagatagaaaatttttacgttactgtcccaaccttgtttgttaattgctcggtgcttacgggaagatttaggaatatatgtgtcctttctaatttacctaatggtagttctggctgaacaaaaaaataaaaaactaatgctagttctgaattctgactctgactctgatctcacttatagaataagtttgcaagttcatagtaatggattgtaacttttctttgtttagattgatttcaacagtcttctatccattgctagaaaattttgtttacataatagtgtattgaatgaattaacatcccaaaaatatggtcataacttacaatcccttcaactcgagcaattcatctatatatacaaagatagcctcacctagcttcttgattaaaccatttttacaggattatatcccagaaatagttccaaacttctccgattttgaagatcctccatcaccaccatcgagttatgataacacatacttaaatgaagaggagttcagcaagcccccgccagaattaccaccacaactaccagtggcaataagacatgaggcttcttcatccgcaagtggtagtcgtcttgtccctaggcccacgcatttggaactgaatcatctatacatctacaaaactgatagggatcaatttgtggcactacgatcaacttataagtttcaacacaaatatattactacggaactgtacaagtccttacgcagggaaagatgatgaagcattaagatttttgtttgctattgaacttgcctcgtttaagctgcctttatgagaacatttgttaaggtcattaatctaatgtgtagaaaattgattggaataggtaaatgaaaaattgctttcaatgtaaaaaacttaagggaatattattttattctggcagtccgcagtcaatatatacaatacatttcatagtagtgtttttttataagcaacatacccgtagtagttgacaagttgatttcaaggtctcacaatttgaaattggatatgctagcttattgcacatgctgtgatgaagatccaatggttactctagcatataatggctaacactaatgaactatgactttcttcccctcttctctgttgtgctctcagatgatgtcctcagcttctgaaaccgacccattgccaaatggcaaatgcccaggttctatcatgggtaatttcgatggttgaacttgaacatacattaagagtcatttaaatgctttaaaataagggacagatatatagaagttaaatggcaattcctccccgggagagagctaaattcgacacctaaatgttcatactatgcatagcactactgttatctgagtacacttgtttccaccactttctacttctgataaatgaggctaacctttttttcatattggttaaaattccacagaccattacatttctttacttttactcgcaataatttctctctataaaagttacagattgctcagtgtcgaaggtcatatttaatttttaagtacaactgttgcactatacatcattacgtctgaatattgcaaataacctaatatgataaagatgtcaaccatatatttctcctaaatatgaaaaaactgcagttctatagtataccaacgatctaaacctctttgccttttctttttcctgttttataaacaaggagcagaaagaaataaaaatctcgaaccactaaattcctttgttaattttccatgtaacagtcaaccatctcatcttagcagttcggtgttcggtcattaaaataactattatgcattgatcaacaacgtgtgctattcttgaaacaagaagcagcgaatccaacagggtaaaaaaaaagaccttatttgttcttgattcttctccttttgttttcaatctaaaaacgtacaagggttatcaaactgctacagctactctgaagtagctttttcaatccgactttcatagtggtaggactgaactctagttcattacaacgagccataatataatgtccatacatatatgtgaaaaagtaaacaagttctctactgaagtttgagaatgagaagtaaagagcttaaaattcgtgaattaacatgtgaagatcgaggagtagagtagacaacgaagtgctgtctcatcgaacaggtaccttaatccaaccatttgcaaaagcaattgccaagattacaaaaggagttgacataccaaatatgataatgtaaggaagaggggtcttcatgggattctctccctccctttctcctgctgtctgccaatacctgcgcaaattcaatagaaaggctttgggaaacatacgtggtgaccagaaaattaagaaaatggaaaaaataaaaattatgaattgttactgttgtggttcttcctctctggttatgaatttcttctttcctccttgcttggcttgttcatctccaccacctaataggatcagatccacattcctaagtttatcatctcaacctcatttaattcacaaggatgggataatagttacatagaactgaagcaaagggaagtgagtgattgcatgtatgttacctaatttagcatgaactttgacaacggtaacattagttctgggggagtatgaacctggagaaaatgatggtgactttggcagaaatgaagttttgaaggaaaagggagaagatagagtgagcttggcagccatgttgatggttgtgtgctgcaaatgcaatgtcatcacatatgttcccttctcttggcttggatcctacccttatctacccagctaatgacctggcgtccatgcacccacttctttattctaatttaccttttcttcctatttagtattctagattgtaaattgcacaattaaatatttattttttatatttataatttataataaataaatactttagatatataaattcttttgcaaaaattattgtcattcaattcaaagatatagaatatggtaatttaaaagaaaaaaacttattaagaatatcgtgccaacaacaacaaaaaggtgattaaaaatatggactatacagctttagaagttttattataaaatagattttttaaataaattatcatcaaagttagattaaacattaaaaataaactcatatcatatttttaaacttagtttatttatttatcatcagacatagtgatttgtttttttatagattataattaactttatatagtattttttttaattctattagtttattttagtccatgttagatttatataaaattataatatcaaatgaagtatcttttcattcataaatatcaaataggttttgaattttttaaataggtaagatttattaatatgcaaaaggtgagttttgttgtttataatatattttatttttaatccttcgatttaacaattaatttaaaattcgactaaaaataaataaaatttaaataattttttttaatcaataatcaaacttaaatattgatcaaactattctatctataatgaacataaggataactatactaatttggaggggttacaaattttttatttttattgataaattttcacaattagtaagattcgaaccataacttcttttatcactataacccttgttcccctcccagttacaaaattttgagtttgcaatggcagcattttgttttttttactccacttacatgtaaacaagcatcctgtgattaaacggttaaatgatttcctagttagagttgcgaaaagcatgatactctgctacaggcgattgttacacaatgcaagtcatgcttgttcttcccagttagctttgtcagagcagttgctacattactacaactcatctcaccatcacctccaatttccacctttgaatttggactataatcgatacaaagattcttgcagcgtgaaagatgcccatcagcttcatctgcagatctacaaaactgggcttaccagtgatgttttctggtgtaatactcttatcaacatatttgtcagagttggcaatctggtttccgcacagaagctgtttgatgaaatgccccaaaagaacctcgtttcttggtcttgtttggtttctgggtatgcacaaaatggcatgcctgatgaggcatgtatgttattcagaagggtcatttcagctggtctctcaccaaaccactatgctattggtagtgctcttcgagcatgccaggagcttggtccaaataagcttaaactcgggatggagattcatggcttaatttccaaatctccgtatgcttcagacatggtgttgtctaatgtgctcatgtccatgtattcacattgctcagcttccattgatgatgcccttcgtgtttttgatgaaataaaaattaaaacttctgcatcctggaattctatcatttcagtctattgtcgtaggggagaagcaatttctgcttttaagctatttttaagcatgcaaagggaagctacagaacttaactgcaggcctaatgaatataccttctgtagcttagtaactgttgcatgctctcgggttgactgtggactgactttgcttgagcagatgctggccaggattgaaaaatctagctttgtacaagatttgtatgttggtagtgcattggtcagcgggtttgcaaggtatggtttaatagattctgctaaaatgatttttgagcagatgggtgatcgtaatgcagtgactatgaatgggttaatggttggactggcaaggcagcaccagggtgaagaagcagctaagatattcaaggaaatgaaagatttagttgaaataaatgcatcatcttatgcagttcttttaagtgcttttactgaattttcaaatttaaaggaagggaagagaaagggtcaagaggttcatgcttatctgattcgcaatgccatggttgatgtctggattttgattggaaatgctcttgtcaatatgtatgcaaaatgcaatgccattgataatgctcggtcaattttccaactcatacccagtaaagatactgtttcatggaactctataatctctggccttgaccacaatgagcgatttgaggaagcagttgcatgttaccacacaatgaggagaaatagaatggtgccatcaaaattctcagttattagtactttgagttcatgtgcaagtttgggttggatcatgttaggacaacagatacacggtgaagggatcaaatgcgggcttgatttggacgtttcagtttcaaatgctcttctaacattatatgctgaaactgattgtatgggggaatgtcagaaagttttctttctaatgccagagtacgatcaagtttcttggaattcttttattggtgcactagcaacttcagaggcgtcagttttacaggctataaaatatttcctggagatgatgcaagctggatggaaacccaacagagtaacatttataaatattttatctgcagtttcttctctttctcttcttgaactgggccgtcaaattcatgctttaatcttaaagcactctgtcgctgatgacaatgctattgagaatacacttctagctttctatggaaagtgtgagcagatggaggactgtgagattatcttttctagaatgtctgagcgaagagatgaagtcagttggaatgccatgatttctggatatatacacaatggcatcctgcataaggccatggatttggtatggcttatgatgcaaaggggccaaagattggatgatttcacgcttgctactgttcttagtgcctgtgcttcggttgcaacattagagcgtggtatggaagtccatgcatgtgccataagagcttgtttagaatctgaagttgttgttggtagtgcactagttgacatgtatgcaaaatgtggaaagatagattatgcatcaagattctttgaattgatgcctgtgaggaacatatattcttggaattcaatgatttctggttatgcacgccatggacatggaggaaaagctcttaagctttttacacaaatgaaacagcatggccaattgccagatcatgttacctttgtcggggtcctatcagcctgtagtcatgtagggttagttgatgaaggatttgagcatttcaaatcaatgggtgaagtatatgaactagctcctcgaatagagcacttctcttgtatggtagacctccttgggcgggcaggtaatgttaagaagctggaggagttcatcaaaacaatgccaatgaatcctaatgcccttatttggagaacaattttaggagcatgttgtcgagctaatagccgaaatacagagctagggcgtagggctgccaagatgcttattgagttagagccgctgaacgcagtgaactatgtgcttctttctaacatgcatgctgctggtgggaagtgggaagatgcggcagaggctaggttggcaatgaggaacgcagcagttaagaaggaagctgggtgtagttgggtcaccatgaaggatggagttcatgtgtttgtggctggagatcaaacacacccagaaaaagaaaaaatctatgataaactcaaggagataatgaacaaaatgagggacctgggatatgtgcctgaaaccaaatatgcactctatgatcttgagcttgaaaacaaagaagagcttctcagctatcatagtgagaaactagcgattgcttttgttctcactcgccaatctgagctacctattaggataattaagaaccttcgggtttgtggtgactgtcacactgctttcaaatacatatcaaatattgttaatcgacagataattttacgagattcaaatagatttcaccattttgatggtggcatatgttcttgtcaggattattggtgactgatgctaaaaattatgggaagtattgcctatgattcttctctactttggctacgaggaaatttggttgtgacattttcaagtgtaagagatattaattattaaatagtgaaaaaaaaagagaaggaataagtttggagaggaaaaatgggacatggagatagaagagaagccatatgtcccgaagcgccactaagatgtatataggattaggtgccatttttgggaactctatgtcttaacttatgaaattagtcagttatccaaactataaaacagattggacattgttgccacgctcccaagtggaagtgtcccaactatcctttttatcatttttttttcttagtgggaaaaaagtttggttaggtacattgctttaacgcattgtcttgtttttccgacctgaattcaattgtgttcatttttatacatgtctccttgctgtaactttaacgaagtcctcattaaaaggtttaacaaaaaacctttaacgaagtcctaaaagtcatatataaaaagtgtgtacatgtacgtgtctaagcggtttttttagccatgttttcaaaatcagttccagaaggtgtgaaccaaccgggttcgtggtcacacgatttgtcatcaaattgataacccgtttgatctggatcaaatcacacatcttcgaattttctttttttcaaatttaaggaaaagttcgttttattcttttttatcttttatcttataaatatttctaaaacagtttatacaaacagactaaagctgacagagactcggatatataaggtggcaatgtgttttgatcctagatcttaaattattttaagctgtcaaattatatagtaaaacatggacaaattaggacaaacaaagttctaaaatataactaaaggaacttagatccacttctatttattcataattaattatatgacatatttggagtcaccaaattattgctaagaagtattaatcgattttgctagtaagtaatattagaagaagatgtaattagtcatgttagtaaggtttcctttttcaatcacttttttatttacaagatttcaatttgagatcttgaataatatataattaatgatatattggttgaatagttttagataattctttaacaatatttatgaataagagaaaaggtaaaaagataaatacaatagattttaaattaacttatttacttaattttttcttttaaaaactctatcatctaacttatttaaaaactaagatgcataaattaattggttttcatttataaataaataaaaatgatttattttacacttattttttgtaagttcttaaagagaattttattaatattagttcatggttatattagagagagaaagacataatttattttttcatgaagaaccatcataattattaataagatatatttttaattatatttaatataaaaaaatggtgcgatgaggatagttgttggatgttactccgtgtgttggaaaggtgcatagattaaaaatagaataagttgaggttgagagtgatggagtgctcatggctatgctaagttagattgaacgatactgatgcatgttgttatcaacgaaggacaaatgtttatgtagggccacattcttaaagtttgtggaaaattagcgctttgtatccgtttattatgatgatttcgttggctttctcagaaataaagacttgactcatgtcaagtaaagaattgtttggtatggatctctttgaatataagattaaaagtgtttttgagaatttttctattaaaaaaattatatttttaataatagaaacactctcaaaaataactttttatataaagaggccgcatataaatttcttggagatccgttgtcaaattattgtgccaacttgagaaggacgtacgtttcaattcaacaaaggaagctacgtggcccccttcctgactctgccaccgtatcaatttcaaacatcctttattttatttcattcacaacctgttaaatacattatttccttgcacagaaatgctgtaaatatcctctctaatacattttcaagccaagttgcaatcaattttaactcataaaatatatatatatatatatatatatatatatatattaaaatgagtatattgtaagcattcttctttgtatctatcacacattaaaatctgccactttaaataagcataactgagaattagatctctgcggcttgaaaatttgaacccaatgcagttactaatgtcatatacgaggttttcaaatattaaagatagtttggtaaatgaagggatgagatcccatacagtttcttaacaaaactgtagctgatcctaacccgaataacatgtcagcaataatacgctgtgcactctattatttttctttctggatataatataaaaaaggtaatcaaagtaataaggattagcttgattgtgtgtttgaattgcaagagataatgaaaggttaaaagatatttgacaaattttctttagattaaaatatgtttttatttctaataaatatttgatttttatgtttgttttttaataaaattttgttttgtgtgaattcttaataaaataatatttttattttcagttcttatattatgttttcattcttaataaattaacgaatttttaataaattaacgaattttgtatttattttttaataaattaataaattttattttagtcccaactaataacaaataaaaaagatttattaaacaaacacaaaatttattaatttataatggattacaaataagtgtcattaactaaaaacaaaattattaatttattagggactaaaagtaaaataaaaatttattagaaaataaacaccaaaattaagtatttattaaaaattaaaaatatatttaagtcattttgtttataaactatccgtgttttctttttccagacccgcctttagaaagggaacttttccacaaatccaaaattattttttacattgctcaagtttccactcaggagcttatgaaagcccaaaaacaaatgtttcacagagcgaatacaaaacactttatttttataaaaagcgcattcaagatagagctgatgattttgactggggtaacgctcactaaagtgcactctttaatctgtgatacgattgagatatcatggatagggtggatacctgttaaaaaaaatagtcttgatgctcaaatcagtaacgatgatatataataaagtttatctactatagtgacattggttgaattttattataaggctgccagatggacggaattctctcacaagaagctaaacaaaacaagtcgaattgaagtatcatatttttgaactcaaatggccattttagcagcatccttctttacgagttaatggagggttaaatgaaaattagatttaactgaatcatattatatggatacaagttgaatgtgtaaacctaaaatgtttataattgaaagagatgctaaagttaattactgtagtaaacaagacgtgcatttaataaaatagagtgagcttgatgtttccattggaacagagaacagaacatggaacatagtctgacataaccatttagggcaggatttaattcctacaagcaaaaatctgggtggcaaaaaaacttggaaactaagacaccctgttagttaaaatcaatgcaaaagaaagggagatacatgatgttctaagattcacaactacttaattaacagccaccagcaatttctgattatcaaaataaaaactgttgacagctcttagctccaagttattggaagagaacgttgctttcatccttttaataaaatcttcacatttcttatttaactcttcagtgtcatgctcatcttcatcaatgatcacaagggcatttccctcttcttcttcttcttcttcttcttcttcttgggtatctgatagaacattgtcttgttctactctcaccaaaatcttttcttctttatgtggggattcagtttcctcaccagcaattggtgctgcaactgccatgtctggttccttggattctaactggctacttttctcttctatgtgaacagctacagcagcatgttcagtggttggtagtgaagaggcattgattggagcagagttgatggctattaaaacaaggaggaggccattgcagagaaggaacatgtagcttttttcaaccatgtagctgaagaattgcatgagggatggcttcaaggattgaaggagtaaaagaaatgaagagaacaaaagacagagcagagataaacaaagcagaaacttgattgatacttgtatcttcttcattctcttggaatttaacttttatgaaaagtgctctctatgtaagcaggggaatggggctctatttacgtatggacagtatggtgaaatgagatataaataggggatgtcctcctcagcgtgtgttagaagttacgcagaaaaagcttatggcaaaagcttctttacaatttacatcttattactcaattactattagcatctttctttctttttctttatgtcttcgtcaatagacttatagacatctcaagagtgttattttgttttttcaaatgatacatggaagtggaacagtattaactaagagagcaaaaaagatcttaaagagttcaatcttgtatattaataataaatactaagttatcatttttctcaattcgtgttatttattaaaaatggtaaacattatcaacgaaaaataatcttaatttttttatttataagaacagaagacaatataaaaatatttataatactcgtacatattacttaataaagtgacttaaatttgtttaataaataatttttacctatcaaacagagaaattagtctgtggttactgaacaggtgccgtaaaaaaaatcctaaaaagaaaagaaaagaaaatgatctgattcttgatttcttatttattaaaaaaatcatttttgcattataattaataacgaagacttttgagagacgaccggaagtcagtcaactaatactttaaataaaatacaaaaacgtgtccgagtatcagaccacatgagaagggcggcaattcgagcgaataattaaatatatcattgtgcaaaatttgacaaatgatcctaacccataacatatctacgtaattatttcattttttttaatttacttggaagttgaaatttcagcgctgatgagcatataaaattggttagaaaattctttgtaactactaatgtaatgtaataataattaaacttaaaggtctactttcctcgaattttcattttcagtcctctagatttaccttttcgactctctttgtaacttattgacctacgtggttcagattcttgattctctttaagttaaaagataatgatcttttagtttacaaaacgcataagttcatctactttagattttcattctctaacattcacttcatttcatttcaatattctcttatcataatatgctcttaagcttttaaattttaactgattatcataaatcaaattcaaaaaaaaaaatatatatatatatatatatataaatgcaacttaatattcctaacaatgcaactttctatctctttcaatccatcaataatttaaattatatcataacaatacacatgctaaatcggtaaaaaaaaaggttatgtattctaataacctaatgggtaaaacgttgtaaaaaaaaaaaaaaaaaatcctataatattggataaaaaggtgagttagaggataacaaagcttaccttcagatttagttacctaattccttaaacctcaccttgctcaaatcttcaaaatttcctcgagctacattcacaagttgatgcaagatatttagacaaacatacttgtgagccaattatagcaaatttaagttgaatcaaaagctacattcacaagttgatgtcccacaaaggatggaaacttctcagaatttacctcgtgtatacttctgtgtacctacaatgcgtagtagtatgaagttttttaatcctatcattatatcattttttaaacctctgttgggcaatgcaaattttcatcatttttatcacttggctcttcatttaagtttacaccagaagtcaatattaaatttaaacttgtttaaatgtagtagtaaacataacatctttaataaaaacacagaatgcattaagatatgcattacagtgtaaaatgcattcattctctccttctagagacatgaaacccacaataaaggagataccaatattctatcacatgaacctctactccgatcataacgcacaaaaaatatatttaaatccatatattagtcaaaatccatcaatctatgctagcactaaaaaacaattgcatcagcagtccgtcccttgctatttaatgaaaatccataatccaaaggaccaaaataacttgcagtcatccttcactctttccttcgcttgtgtggctgattcagctcattgtccttaatttcctccaacaccttatcactagaatcacaaggttttgaaacctctgttggatcatgcacattttcatcatttttatcacttgactcttcagaattttcttcttcagcctggcgttgtaatgattctataacggccagcatttctctattaacctgtacaaaaaaggccagaaaattgtagaacaaaacttacaaataaaatgccaatttgaatacaatgaatgaaaaattccagaatgtatttcattagtgccagtagtatttgcaacaaatattcaagccttataaaaagcatatacacgagctcaaaataaagccttaatatatttctaccattctcctttattcaagatgaaccgttttactcattgaattccatattttcaaaaaataggcataagcatttcattgtaaactaggaataattaaaagaaatccaaatatggtttggaagcatacttggagcaaatataaaacctaataatggcattcagtagtacctgtggattctggagaaagtcagcaatgtcatttgaacaagatgggcatttcataacattcttctgtgctcgtaaagtgcgtccacctccacatgccctatttctgatgaaactttggccagaaaaggtaccctccaaacaggctttgcagaagttgtgagcacaaggtgtagtaagaggagaagccataaccttgagacatatttggcagccaaactctgaacaaattggaagtcagtggcaaaattgaatagattttacaagttcaattgactgcaatgggattttaaaaaacaataaggcaaacaagatttataagtagtctatacagggtaaattatgggaacatgtacacagagcatacctttcaaaagcctttctttcacagacacatcttttgcctttcgtttaactctgattgttgttccatcttcagatttaatgtccactgatttcttgctttctggtggaggcttcttccacaaccagcaccccttttcctcctatatttcaccgaaagtactgagtgagacccatcaaagtatagattatagaacatcaatagtggaacaacatgtaccactagaacgatttccaaaactctttagtacaataattatgattgtctcactatttaatcctaccagacacaaatcaacctatcaacagcaaaaggaccagaacaacacttacatcataatcccatgatggatcaccctttctttcagttacatcaactgcccccttcaactcatcaattttaggcagtgagcgtgggcgatctccaatttcatcactgcacatcaacaaaataaagtcaataacacataagcacacaaacaaacagcagcaaagaaagaaccaaccaaccttgtccacggtgctggctcattgtcacatctcacaaacaaatacctgcaaaccttgcaaccctgtcacagaacaaagcttctccatgaatcaaaaaacttggagaaaactatcaaggaaaaatacattcccaggcctcaatcaataaacacaatgcctatcattagaagtagcttacttgtattccatttttacgccagcatttctctattctataaactccatcataacgcactccagattccggtgcataagaagaacgtttttccttgtgcgacctgaacaaaacaaaagttatttcggcacaaaataaatttgtgatactcagaaaaatgcatttagttggtaatcgaatgaaaaatattaggatcgagagagaagaggtgaccttacaacccgaacgggataacccttcctgcagcttactctcaaggcctcgttcatgttttcaaacttctggtcaaaggattgcagcttgttggtgcgtttattgccacttagatctctgccaccactgccagtgtaaaggaaccactcaccatggtcctcgtcatcctcgtacccaccagaaagggcaacagactgggaaccataactactctgtccagcaatgccggcaacatgaggcaaatgagcaccccactgccgacactccatcctgtcctcccacgtatccccgaccagaacaccacggttcctggtggggtcgttttcagcagggatgggcccaaaatggtcaggaggaacagtaacaaaaatcttaccactgcaagcgtttgcctttccagtcttcttggctcgctctgtggtgaatgcagtatcagggcggtcctgattgcgtacaaaatgatacaccttggatggacccgaagaacctcccgacttggctgccttcgccaatcggatggccatggccaactgagagtttattctcggctggctcgccatcttggtcgggatttgagcacggcaattggcgcaagtgcgctttccctgtccgatccacttctcgaaacatctcaaacaaaagttgtgcccacatggcgtctgaaagataaattgaggaaactaacacactgactactcaaaaattaatagatgataaaaaaaaaaaaaaacagagaagacaaaagaaacaaaccgtgacgggtctgtcgggtagttgcatgcatatggagcaatttaagcttccatcaaaaatgtctttggttttggttttgtcctttgaggggtcggcagagccagcgaggagttcttggcgttttttggctttctgttggtcagtgagagaggggtcggactgaatggcgtgaatggcggagacaaggtcaccggagggagcgacggggtgatgattggaggtgtcagaacagtcggggcagtcccagtgggaatcagagagggagagaggtggcgaagggagacacgaaaggtgccagggagtggcacacgttcgacaggagagggtttcggagggagtgggtttgtgtttgcagcgcatgcacacgccatcggagtcgcacggaagctgcgccattttccactgccaacaatttcgggtgcttttttgttttatagggaaaagtgagaaagtggaatatccaaatttcggattttccggagcgagggaatcacccttttgaatattttccattttctaattctttccctcccttcatttcgccatttccccctcgcgccctttcgcttctcttctttctatatccagttccagcccatactttgtaactttgtatcccatggataataataaatatacgttacctctaaaaataataatcactgattcattaaaataacaagatacgtttgaactattaaaaaagtaatcattacttttttttataataaattaatcattaactcattaataattatagtaattactgtatatgtgttcgtatttctattaagctatcctactttattatgctaaaatttatatattgaaatgatatcttttattatctataaattgatgtcatattatttttagtttaatatgttttgtaatgtatacataattttacttaaatttatttatttgttatgataacatgataaatatcataacctaggtttgaaagataaagaaagaaaggaaaatttaaatttataaaattctgtcgcaaaagccttagcgacggaattagcgacggatttagcgacggacagaatctggcgccaggagcgccaagagtgccacagatgctggattttggcgccaggagcgccacagatgctggaaattggcgccaggagcgccagagtggcgccaagggcgctagatacactggattttggcgccaggagcgccaaagtggcgccaggagcgcggcaagtcggtgctggccattataaatggaaaactcgcgatttctagagagaaacactgtttctcttcttcctcagagctccctccaccatttttgagtgcctaagcttcctagaaccttggtttctagcccaaatcacttccattagccattaaacttgtgaggaacacctagaaagctaaaatctttcatccaaaccccttgaaaccttgagctgagagattcctttctcagaggaattgtagaactcaagctaggcaaggaactacggagattcaagaacattggggctaggagaagtagttcagagtcttccttgccaattctgaggtaagaatcttgagttttctccggttaaactttgatttgggggtttttgatgaatagtgacccatctgtgatagagctagaattagctctgggtccagttgggagaggtgtttagaatgcagagaggaggaaggattaactttcagtttgtaatttggtgactgttggttttggctctaggttgtgcatgtgtgacttggattgagtcacttgatttgagacatgcaagagccatttggatgggcttgaggtgcctggaaggccttgggaacggtgtcttatgattagaccgttcaagccctatggaaattctgagttatgggtggtgtgagctgtgatgctcattgtagatggctatctgtgagtcggaagtgactctacagccatggttgatctgtgatagaccactgagggtctatggaaaggcttgaagtggatgagcctgaaaaccttaggttagataacctgggttgttagaaaggactgaggttcctttctcagaggctgtagatgtctgtttgatgagcttgtgttgaatggtctgtgatatatgtgtttgtatgccttgatagggcttgacactgtgagtgtcagagaagcaaaccatcattcgaggttttggagctgcaggcacggcttgtcaggtaagctcatcgttctgggaattagccctttctcttgtttaccacccaagtaggtgaagtatgcatgccatgcttgaatatataattatattgtgcatgctgtggaatgaatggccaaggttgcctgctttagtgattatatacatttgtgagcctgaagggctagatgaacggtacttggagtgaaactcagaccgttctagatgtatgaatatctgatgaaccctaggatagacactgagatagtgtgaggttgacagacacctgagattgcaggtgatggaatctataagatactggaatagtatcgggctagttgaggttccctagccagaggaagagtttgaggactccctggaatagttgagattccatgggaggtgccactgctctccgcctaaagacctaagggtggattgccctgtctggatgttcctccttaggcagaaatgatgagattcctgagtgagtatcctcaggtgattatgctgagattgataaagaccatggtggtggtctgtgttgagaataaatagacactgtgatagtgtctgagttctgagattctctggccagtagaatagagtcctatggtggtaggacagatggtatgtgattgaaagtcctaagagattgagtgcctcctgtgtgagatgatctctcttaggcatgtgattgatgaccctgagggatagagtgcctcctttgtgagatgatctctctcaggtgatggattgacagtctgagggatggagtgcctcctgtgtgagatgatctctctcagaccgtgatttgaagtcctgagggattgagtgcctccgttgtgagatgatctctctcaggcagtggatctggaagtcctgaaagataagtgcctccggtgtgagatgatctctttcaggcatgtgtatgtaaagtcctgagtagagagattcctcaggcattatgtgtaaagtcctgagttgagagattcctcaggcattatgtgtaaagtcctgagtacagagattcctcaggcagtgtgtatgaagtcctgagtggtggactcaggcaatgctttatatatggcattggaggcggtgcctctctggtatatacagtgtccagtgattgacactgatgattaggtacctctgtgaggtctctgtcagacgattatgagggccgatatgagatattgaagccatgattctggcttggctctgttagatggttttgagatggctgtgagagccaggatgaggtgtgatacctctgatactgagagtctttggttatgttgccctgtagtgggttatgagagctaggatgatttcctaagctcgtttctgcttggttttatgtgtatttttgaggtgaaccagggtaagggaatatctcccagaaccctgagtttactgagacgtttgtctcacccctgttgtgggttgtggttttcaggtgtttctagaggagaggagatacctcagggcaggaggccctagctgagtatgctggagtagtcatgggctgcagttgaagaccggagcagagcttcaagagttgaagctggtttagttttctgttttgtgttagggtgtaagtgtacacccattgtattgtacatgtactgttgaatgacctgatgtggtcttgtttaatgtatgtatatgtacagatgttggtgtatatatatctgcctatgttttgtatgttctgtttatctggatcagcagaagcttgtttatgatgctttaggttgtgttttatgttccatgcataatgtaatcaagaaaatgattctatagcttccgcaccgcgcgtacttagcgccgatagcgtgattctgatattgttaatgataacacgtccggggtgttacaataaattaatatattatatttttaaatatatgtttacttatacataattcatcaaattatttatggtatatatttgaatatcattttatttactatatgtatttatgaaacattgaaataataacattattatatcacttgttgattttcttcttcttattttgatctttaattatctgtgttctaaggggtgtatatatttcaattatgaagattttttatatatttcaaatttagatatgtggtgtagagaaaaataagaaaaatgaataaatatataaagtaaatataaaaaaatgtgtagagagtaaagattatccaaatatttttctaattgaaattacaaaacaaaaaaaaaaattcaaatcatgtttcctgctttttagtttgttatcatttttaaacatttatattaaaaattaacaaattatagaaatatataatgatgtttgttttttgctagcatttaataaataaataaaatttaggacaatgaattttatttatttatttacttgtttagaaggaaaaaaattaagcataacattatcttgaagtcattataaaacatgttaacttaaaagatatttaaattcattttttaacgcatgttttaaggtttacataaaaaattcattttataaacttctcttaagaggaaaaatcatcttaaaccttacaaaaatttaataaaactattttctaacattatcaaccaccgattaagtcatttattcataatttgatgttcataatccaaatataaaattcagcagaaaaaaatatccaaatacaaatccaaaaatcaattttaatacaaatttatacgactaatactgtaaatatgacatgatcaaaaacaaaaagatatatatatatatatatatatatatatatatatatatatataaaatcccttaactacacacaaaaatgtgaaaaataaaatcatagtaataaaaaacaaaagaaaattaataaaagacaaaattaattaaaaatataaataaagttaacagataagacaaataaaaagtctataaatataaaatattttcttactttatctatgcaatttcttctggattctttctttagatcaaacactctcatcatgtgtttagattgataggaaattaacaagaagaataatagccctctatcacgttattcaacctctgaagtctgaacaatagtacattattacatttagatgcaaaagaataaaatgaatccccctccccccaaaaagaaaaacgttaccaggtttatatttgacttgacgatcatgtacagtggatggacatttcaacaatagcaaggaaatttggcaatatatatatataaagctaaattatatatagaagtaattagatgtatcggttgcatttgccgtgtctttacaaagaatagatcgagcttcaatcactgagcgaggaggctcaatatccttttcttgcaacgcatttcctcgtaatcgttgcatttgggaagcaaatgtatcatccaatatctgcaaagtgaaacaatcaacgtcaacggtgcaatattgcaatcaacaataacatcatcagaaaataatctaataatattgacttacccccagagcatatgaagagccgttgtaccatatcctgttttcttttctcccttcgagaaatttcaaaataatctatcacaaaaccaatgaaaataaatgagatccgagaaagaaaaaaatatgaaccaataatataggagtttttaaaatagttggttacctgtcccatcctatcccataatccacgacatattgctataaaaatctggctggtaaagacctcatgcagattggagatgaagtcagtgagttgtgaattcagcaactgcattctttcacgcacttctgcttctccatctgtttctgttgtttcctcaaggatctttttcagccttgtgttccgattagcttttgtctgaacaattcaattgtatcaaatgtaaataaatatttgaggcttctaaacaaaaactttatgctcactattgttatccattttacgataacatagaactaacgtagaaaactggagtttgaatgatcttacattgttgacaagattccctattattgcttgcaaataagttttgtatttggttctcaagagaacagtgattccattcatttgctccccaaacagtgtcttcttatctcccatgacaggtagacaggatgcccatgaatttaggatgtcttccactctacaatgaaggacatcaagaatcctcttgagggtgttcaagaatattcccaactgtggataaaacaaaatgttataagaaaccaaaatcctgcatgttttctattatgccacaaaagtttgagtgagcttaaaatttgagtacttaaattaagctggattttagaatatggacctaatgcaaaagcatacagagaacttacttgattaggaaccaaatgaacagtagctgattgtcttcttgctatcttttgaacttgcaagtgaagtctcttttgtatgctatctttcaaaggagttaatatatcgctgtattgtttttcgagggatttcacaattgccctttcaatgtttgcaacagccttacagaaagaaaagggtaagaaaaatgcaaagtcaaggtatttaccacatgttttatacagtggagatagaattgtttatatatatgagaggagggagacactatagaaaaagatatctggaatgctgatggtttaacagaaatatctctaatttagaacttacattttccaaataaagtgagtattgaggccatctgttgattacaacttcatactgggtaaggttgtctttgattttctcgtacatttcctcagcaaatggggaggtggagtggtttgtggttactccagcccatggcacctgtgtcattattggggaggtcaagtcatttatagactgaagtgctttgttgtatatataaaaaaaaataactactaccttttctgctttacataaatcaagcaaactaagttgcatatcctgtatccacaccatgatataattgtggaacaaatttctggagtctacgcctccctgcacaagactggaacatgaagagtattgcgagtaagaaatgatattttactgttggggaatctcatgtcttttttatactgcattttgcattagcatgggagaagtttctttcacaaaccttatattccatgattccaaatcccgttcaaaatctgcagctgcaactagaagctcatttacatgtgcctgtggactcgatggtggcaatgcagaaaggaaagctctcagtctcttgcacagctctgtgctgtaaactgctgctgtgatgtttgtcaggtcaattgaactgaaaattggaaaatagaactcagaaaatctatgatgaaccaaaattaaaatttacagagaaaaataacgagaatttgagtaatgctatcattggatgaatgggtaccgacgttgataataagaaactctgactgaaacaggagaaaataacattctgttatgccaattgaaagttgcagaatgtttaaatttaataaagaccaattgcatctcccatgtaggggatgtaaaaaagataaatatcaacccctcattataattatgtgtgagaattgaattgcaaattgtatgcactgttaactgtattgtcaacttgctaaagagagctgttatagccaactaccttggaaatatatgctgaccatggatcgtatgctggttatggatctttatgtctgcttgaatttcatttcttattgaaacacaaagattcttcatcttcaggtatgccgttgagatggtaatggtatccattaggtaacattcagaggtgctcgacacaaattcatcagtctccatcatgtgttttctacacctttttcttgctgcagtctgttgacagtagccttatcatttagactccaaaaaaggaaaaccaagctttacatgcagccataaatatacttcaaacatccatggttgaaactatgttgaacaagagcattagttatcagtaactctgcaaatttggaattacctgaagatagtttcttagaatagtttgagcatctagagatagaatatcatgaacacttgtgtagacttgaacagcaggatctaaagctggtgcagcagcatcaaatgctggaccaaaatgatctgttaaacctgttggcgagttttcatctagcgatttgtaattctcaaaaactgtcgctagaagactttcaatttgagtttcacagtctgaaagtatacttctctgtgagaacaagcaaacagagaaaactgttacaccaccatccatttctagatatgtatgacaagtattaaggtggtctgaactctaaactaatgccattgacatagcatattaaaattatgagaagctgaaacaacataagattaagcaaaccaaattacaagatatggtaaattactgcaacgggaaagagagcaatatatgacttacctcctgcctggtcagactcctctcacttctggcctttatgaggggttctagcaactctctcacaagctctaggcagtccttggttggagttgccacattcatcacatgtaatagatatctacaagaaaaccaccacaggtaagtgaagaaaaatgaagaaattaaaagaaaatcatgtagcataaagaatatcagaaaactgtttcttattttcatatttttgggggcacacattcaaatacctcagcttggcatatgaattagaaactccatagtagtccgcaaatgcatctaacaaccatttccaaggcccatttaaccgcaagtttcgggagtggaaatgttgtgcacgcatggcaccctccaataataaatcataagcttgagtttccacaacagccgcactctgcagaaatgtacaaaccgagcaaatgaaaacctgaatctatgctcagaacagcatagccagaaatgttgatattggtgtttaatggccaaaagtttaaactaagataaaaacaatattaaatcatgatgagccttttcaataaataaataaaagatcctttgtccgatcaaattagaatagttttctttttaataccaacaaatgattaaacaaggtgataagtatgatcctctccatggttaatctcagaaagaatctagttcttgagaacaatttttcgatatattacatctaagatgtatcctaaacagttacttctttgccttagtcctgagatgtcaacttggaagatgatcttacatcaactaacttgaatatttctattagataaaacaagatttattgaactaaattttgctagagacagaacctttatgtgattgttctcatcgcttgtcattgtactgccaatagagagctggatcttgccaacacattcacgttcatcatgatatactggccaccaccgaattctgtcactctgcacattcaagataattcattatgtgaatgtggaaggtgcaagagagagaataatatccatggacgatgaaagggtagagctcatacaggattatcactgagggatgaaattggaatcctggcttcaccatggactaccttttttgaatcttggacttctacaattaaagcgtccccttggctcaatgggaaactgaaagtaggtgagagttcagaatctttatgattattatgcaaatttcaacaattgaagaaatcaagacaacatgtgattgtagttgtcttaaagaatgtacaatgtaaatcgccatcttatgcactaggctgtgtactggaagaaacttagaacataaagcagtgtatgatatcaactgttaagattggtttttcatcaattgtctactactatacatatcctgctaaaatgcatttggaaaaccttcaccgactatcatgtttagctattttctaagaagagccaaacagcaggtcaattaaaaacacttttcccaattaaaatataaaagtaaaaaaaaatgaaacttacaaatcatggtaatctccacttccagggcgcaaaagaattgcagaacatggctctgattcattttcttccgtcgtactcttaagttggatcgaacaatgtagtggctctacaagaataaaacagatacctttaattcattcattaaaaggattggtgtttatgaaaggaaaaaaatctatattaaaaaagcccatttcatttggtggaggataaagtatgactcctaaatcctgataatatgtaactcttacagtctaatacaagtctcattatcaagatcaaaaagatttctaaactataaaacgaaagagttgctgaaaccttcagatcccaaggagaaggaggccgtcttcatagaatttatgccatttttcacaagtgatgaaacatgccggacgtactccaccccagtttgcatgtagattgatcctcgctgtgactttgtgatcttaagtttttgtcttggtataatgcgaagtttcttcactgcaattttcatataggatgtcagattatacagctctcaagttgtttgaaggagatccaacgttatgaacatagttacattaggaagttctaaaatatgtccataagaaaatgtcattccatacatccatgtacaattataatcatattacatttaaatgataaaaatgtgttgagattgtaagattaccttccactcttattttccctacaactttcttaatcttcaggggaactgtttgttccgaattcctggtatttctgccttcagttggcttgacacctcgaggttgcaacaagaactcatgcaatctatggaaatagagaaataagagaaatgaggagaacaataaatgaagccaaaagaaatgtgttggtaaaacaaaatggaacccaccctaaagcacttcggagagctaggcactcatcttttaaaaactctggggcctcagtgcagccttttgcccatgcttgtaggcataaacgtatgcaggcatcataagtgataagggtttgccaggcatattgactattgcaactgctgaaataacataacatgccataaaaggaagtgagcatataaatgtgaatttcaagataactatattaattaaattttgctataattagcaaagtattaatgttggtcatgggttcgaatccggaaacaacttctttgcatatgcaagagtaaagttgtgtacaatattcatcccccttacctgcgcatagcgtggagcctccaggtaacagggtacttagttttttagcaaagtattaatggattcaaactaaactaaatatttcgttaaggttgacagctaatttgataattgttaaatagaaagtaaaagttgaagatagacagcacctggtgttgtaatattgtaaatgaggggtctgtctttctctgtcatctgtaaaattcttgtccagtctacagagttgaatttaatattataaggaaggacactagagctggttaggaattggaagaagaactgcaaacagacaaactaaaaaagagcaaatacagcacctttgagcgagctcagcgacagtgggtttagcaacagtgttgggcttgggtttttgttcaatggaagtctcactttttgtgccatcataatccagagattctcttgaaggccatgatccaggagggtaagttggttcgttccttagggagcattctgaatccctctccagtggagaatcagaatcaatgatgggaggggcacttggagtacccaaaccaacggtgtcatcatcagggcaattcacattgcgaaggtgaacttgcttttgaagctgaacagtggcagcgccagctggagtgaggttcctttgaagacttatattgaaacccatttctccatctgtgaaccttctaactgtgttgggaacctgaatggttaggttttgattggccaaacctgtcttgagaattcctctgcggcctttgcatccaaacaattgttcctcgtcatagtagtgtggtattggagagtccgagaaatcaaggttgttgggagcagagacttcgtcatcggagaaattggcatcctccgtgctttcgtaactgtcatcgtgatcggcaaaggcgaggttgggcggttgtaataaagccgagtggaacttcaagggagggagaacgggagaattaagagagttggcactgctcaagagaggagatcgtgggaatcgatcgctgctgcagctgattttctcggccagaggagagcgtggctgaggaagaggaggctcttcgacatcaacatcaagtggtacttttgatccctgtattgtattgtatgtataaattggtcagtgaaggaatggaatccctaataaagaatcaaacaaaagaaagaaagatggaaaaagaaacaaagagttagcattagattagacaaaaagaagaaaggtgacctgcttgatccattggattgcgctctcgtcgagtccttcggtgaacatcttcgccagagtcagagagaggagggagaatttagatcactgaattaagcaaaagcaaaagcaaaggaaagagaggagcctaaagcactgaatcacagtgtacaactaatacatgatgaagtaccattgccaacggctagttttcttttttcaaaccttcttgcatgcgtcacaaataattctttcttcctctttttattatatcacacactaatataataccatatacatctgggatgtgattttcagagtaattataatttccacatcccatttataattccttacctttcacggatttctatacatttatgtttactaattttaagttttcattactgttaactgcgtgtaatgtaataacaaagtaaacatcatttttttttttacgggaacatgaaacctgtcattactaatactattccatgtctttttcttttcttttctttttattttctattaataatacattgttttagctacacaaataaaaaatgtatactttcaggaatttatcacaacacgtggggggaaaaggtttatgtcttcttattaaaataatgaaatatgcgtgttatacaaataattaagtcggtcaaagattataaaaatattaaagttttttttatatagtagtattactacaatactactaagagacgatagcttgcgctctatatatctcttaatttatacggttatattcaacacatcatattgataaaataaaagaagaagttattcttatctttaaatgatttaagaataatgtgtcttaaatcattcaaaaatatgagttctagctaaaacgtttaaatatatatttttatgtttataaaattttattaacaaccaatttaaataatttatcaaatcaaattgtaattaaaacattatatttacaaaccaacaaactattttggtacatacataaataccagtgcaacccatgcaccaggtaaatttactacttcattcctaaaaaaaaagaaaaaaccttttatatattagatgccgtgtatgaaaaaaattgaaatatgtttttatgcagagagtagtaaaatataaatttatttgccagttatgattgaaactaaaattaatatcagacagtgaccaaatttataatttaatctggttgtttgtacttagacagtatttgagaagatgcaaaaaatgagtgggtgaatggtagatagaagcacctaatcacctaccccgacacatgtcagcaaccctctagctctacttaaagcttcaaggcctctgaaaactctacaacttttgaactctcctctcgtagtggtatggcgagcattattccagaaagtgacccccttaactggagtcaggcagcagattcactgaagtgtagccactttgatgaagtgaaacgcatggtggcagagtaccggaacccacttgtctgtctgggtgggggagagacactaactatatcacaggtggcttctgttgctgttgccgatcccaaccattacttgcaggctaaggtttccctctcagagtcttcaaggccaggcgttgacgccagctgccactggatcatccaaaacattaacaaaggcactcccatttatggtgttaccaccggctttggtgctgcctcccacagaagaactgaccaaggccttgcccttcagaaggaaatggttaggtctgcttcttctctgcttccttctcaatatcttggaattatcatgcaacttcattgtcaatactaatcaaaattcatttcaaatatatctttcaaagtatcaattataaaagtcaacttacttttatatatgtgacaacaacctatatattatatgacagtatatagaccattccattccaatttaattcttcttttggtttatgtatttacggattttccatttttccttcccaaggtttttaaactgcgcaatatttggctaccaaacagagttatctcacacactgcctaaatcagcaaccagagcagcaatgcttgtgagggttaatacccttcttcaaggctactcaggaattagatttgaaatcttagaagctatcaccaaactactcaaccacaatgtcacccctatcttgccattacgtggtacaattactgcgtctggtgatctaattcctctgtcctacattgttgcattgctaactggtaggcgaaacagtaaagctgttggaccctctggagagtcccttaatgctaaggaagctttccatttagcaggtctagattctgggttctttgagttgaagcccaaggaaggtcttgccctcgtaaatggcacggccgttgggtctggcgtggcttctaccgtgctttttgaggcaaacatattagctttactgtcggaagttctgtcagcagtttttgctgaagtcatgcaggggaagccagaatttacacatcatcttatacataagctgaagtaccatcccggccaaattgaagctgcagctattatggaacacattctagatggaagctcttatgtcaaaaatgttacactgcaacaaccagatccgttgcagaagcctagaaaagatcgttatgctcttgtaacttctcctcagtggcttggtccacagattgaaatcatccggtattcgaccaaatcaattgaaagggaaataaactcagcaaatgacaatcccttgattgatgtcacaaggaataaggctctgaatggtggtaatttccaaggaaccccaattggagtttcaatggataatacacgtttagccgttgcttcaatcggcaaactcatctttgcccaatttactgagcttgtcaatgatttgtataacaatgggttgccatcaagtctttctgctggtagaaacccaagtcttgattacggtttcaaggcatctgaagttgccatggctgcttattgttctgagcttcaatatctagcaaatccagtaacgagccatgggcaaagtgctgagcagcacgaccaagatgtgaactctttgggcttaatttctgctttgaaaactgtcgaagccgttgagatattaaagctcatgtcttccacttatctggttgcactctgccaagctattgacttgaggcatttagaggaaattttcaagaacacggtcaagaatactgtaagcatagttgcacagaaaacattagttacagaagacacagaagaaattaacccatttcgactttgtgagaaagatttgcttaaagtggtcgatagagaatatgtattttcctacattgatgatccctccaatgttacgtacccattgatgccaaaactaaagcaagtactttatgagcaagcacacattagtgccattaatgacaagaatgtgagcttgttgatttttgagaagattggagcttttgaggatgaattgaagtctctcttgccaaaggaagttgaaagtgcaagggtggcttatgagaatggcaatccagcaattccaaacagaataaaggagtgtaggtcatatccactgtacaagtttgtgagggaagagttagagatagggttgctcaccggagaaaagactctctcaccagatgaggaatttgaaaaagtatatacagccatgtgtcaagcaaagattattgatcccattctggaatgtcttggagattggaacggggttcccatcccaatataatgttgtaatgttctactgttagacaataacttgctggcaacttttttttttttttttttctcgtgatgtttgttttaggattttatttgaataactagttgagaaaaactagagtgaatttattgtgtatgccttatcttgtcaaaaaacaaatttctgtaatgtgtcaaatataaaataattttgcatatagtaccaatcaatttagtctaaatagcttgtgcagacaagatccacgcaaaagtttctcttgtaacttgccaaactggataaacaataaactgaagagcatggctaagggaatactagccagaagaagcaatccttataacaaaggtttgttataattctttcacttctagcgtagccgggagtttgttatcagaaccatacaaaacctacgaggaaggtatacaaaacacctgtaatttataaatgtttttttcttcgtttttcttttttttaggatacatgaaaaccaaccaacaaactcaactcctaacaaaggtgatactagctagtatcagcagcaggagaggatagcttccttttgtgatgagattgacagtatcaagagagttagatagacagacaaatgaaccagttgtcctctccacactaactatttactgaaaacaaatttagcatgtgtttggtttcacatcgtagggacatcatgcgggtttatcttgatgccacaacttgtagcttccacgtccattgttaatcagacgtgaaaagaaacatgcgcatatctctctcagacttaagataaagacacaaacatcacaacaagactcaccttatttgtacacgatcccttaaacttgttttggctttaccagaatacgaaaaggaacatcacaggatccaattccatgaaccagcgactaatagactggtctatttttgcaggtcgttttcagtacatttatttaattttttccacatccacgacaaatatgtatgttctcagtatgaagtagtatgaaataataataatctgtatattgaaaataattccatttggtatacatatttttaatttctaatttatctttcaatatataactacatttttcgtacttcataacaacactcccaggaccttttacccctttttgtacacatttcgtttccaaatttacccttcaaaaataattgttgcgtctcacagaaaaggtgttggttactggcttactgcaacttctcccacacaatttgatattttacatttttcaaaatataattgcaaactctaattctcccttcaactactatgttcacacgtccactgcattattttatcctttttctcattcccgtaaatctccccttcaaactttccttacctttcttctccacttgttttagaaatttttttctcctcatttctattgacactcactcacggcagttatcgccgatttatttattcaaaaataatttctacttcatgaacgtgcataacataacttcaaagtgactctttcacattcacaattatctctctcccatttacaattatccctttcctcctctgcatctctttttcaggaatgaaacctttcatttttcatttccattcactaaaataaacagtgcttttaaaaataggtcatgtacgcataaatcactttggtttatttgcatttgtcttttttttgtgtgctttttcatgtttttactttctattgccgtgctcattttagttttattttggatgctatttcggaggaggcttcactgattaatttattgactcaattgatttatgtttaaaataattttcaaatgatgacaaggacttttttaatacaactgagattttttaaattaaatttaaaagtttatcattttctttattagcaaaaaatgtaataataaaataaaaatacagacacaaaagtataaggatgacaattcacctttttctttctcctccttttcaaggttaatcaatcggagaagaaataatgcattctagttttcctttcaactcttaattgtgtattatcaaatagcttttgttgatataccagaacaataataattgtatctttttttacaccttctcataatagagttgcctctatagaaataatctaagttatattttattatattgtatgacaaaataaatttaaataaaaaaatatgataacataatagaaatatagacacacgcctgtatttttgctaataataataataatatattaccaagccgtatgtggataactaagaaaaatcatgttaacgaatacgtcactttcctatccttgaacacaaaacattcgaacacccaaaagcacagtggatggataccttgaagaaacctagaagtatccatttaatttttcttgatatttgaataaggaatgagacagtctgtgcaaattacaacttcctcaaacaacttgacaaaactaaatcacatgaaacagaatgataccaaacactagttgaatgagtaaacaacttacgggagagacagatagagagtggaacaaactgtagttcgcatagcaacataaaattgagtggcaactaattactgcaatcagcaaggcatctatttccccactcaacatgctgcaaagcaatcaagctacaaaaagaattaagcaaaagttatactatttaagaaaatttcctcttccagcatgccttttgcttagttggtgagagatagcaaagcaaacttcaatctatctttactgatgagaacaagtagtgcacaaagtaaaatgacatcaggaagccaatggtgccagttgacaacatgattgcaattgccatgagcagggaatagccgagataaagtatagctgagacaggtccactcaaactctgcaggtcgaacaccaagtagttaatggagtacaagaagacataaagagcaacagagcctgaagcaaagaatgacttccaccaccaccgccaatcttccacacaaagatgcatatatgtgaggaccactgacacttcagcacaaacaataaccagcaatagaagaacaaccaacaggaaaccaaatacataatagaacctcccaagccagatactggaaaggataaagaaaagctcaatgaaaagggttccaaatggaagagttcctgcaccaagaataagaagccatgatggatatttacgtgcaggaatctcccttggaatctggttagttcgcacaggatattcaatttgctgagcttttgtccccataaatcctccaatgagggtaagtggaactgatatgcagaaccagaggaagagcaactcaaaatacagggaaatgggaatagcaccagtacttttgctgccccagagaagaaaattcagtcctgttagaataataaaagcaattccaggaaaaaagcatgcagataaccaggaaatggatctccacccttccgaggttcccttaatggtcctccatagacgtacactgacatatccagcagcaattcccaggaaaagatataaaattatcatcccagtaagcagcatacccctggaagctggtgacatgaaacccagggctgcaaaaacaatagtcacagcagccattccaagaatctgaaccccatccccaaccatcacacagagaagcttcgaaccatcaggctctctaaatacatcacccacaacaagcttccatccagaaagctcctcattcatctgcgcttgtgcctctttgtccaactcctcataccttgtcaagtcccttctcacagttctcaagaaaataacaaagacaataccggctaggaaaaagatcaccatcaatgaatttaggatggagaaccaatgcacccgggagccctccatctttaagtaagcatcccaacgcgatggccatcttatatcacttttcacgaactcaacttcatatgtaaatgatatcctctcttgctctttaatcggttggtacttgtctagctcagatgggcagtttgtcgaagagatattgtcatacatgtggagttttgtcatgacttcaggatcgcgcttaacactgcaaggggtaacctgaaagccaacaatttcatatccagataccttcttcttgtcagcttcagagataacacccataccttcctccccagtcccaatgatttcaacaccatttccttcatattcatgaaccaagactgtgaatttgagatggttaatgatgtaatctgcactaccatcaggtggtgtgtagccaacagggaaccccgtccactggatcttaatcccattttgattggcaaacctcataacaggcaaattgtcaaggatcatatttacttgatacagatcacgagttctttgtttcagtagctttacctcattctcattcaaggcggtcgtagtacagaggtagattgactgattaacattcatgcggaaaaggtagggagagttatcaatctgatctcccctgaggagctctccaagattctcagcacttttctttactttaccaaggggcttgcagtaagggagactgtagtagctgtagggaagctcggtctcaatagaagtcaatgaattaaccttggcatatatctgatctccatttgagtaagtatgcatgtagcttcccggaagataaaatgcattgctaatttgtacaaacgcattgacaatgacgaaaaggcaaacccagtagatcactggttttctcctacttggcacctccattttacaccaaatgtcaaaaaattaacctaactctgacgatgcattcaacacgaaatctacaatggaataaacatttcaacatgagaggccagatattttcaaagaaaaaaaaaaaacagccaaatgcaagcacaaaataataaacaataacaatcatatcaacatattgaaatcagatccaatagttttgaagcagaaaaaaaaaaaaggcgatgcaggtccgctttaaaaccgagaatcagatcacaagagtaaagtatagcagcaaacaagtccattgataaagctaacaagtaacaaaacgagaagcaaaaacacgaggaatgtaaaattaatcgatgcaggagaaaaagcagcaacaagaagcaaaagcaggcatcatgagcaacatattgcaaagggaaaaggaagagaactggttagagaggaaaggaaccatgaattttggcgagacagatctcaaagctcaacacaacgtagcagatgcagatgtagatgcagatggagatagtaaggaaataaaataacaacgcaagagaaaaagattcgcactcgttcgccaaaatgaaaatgatacttgtttgctgtacggtatggcccactcaagcccaccttcgcctcaatactctgtttttagttatctgttggaccctctagtgaatcgcccggcctgctttacatttttttgttcttaggaaactctgggcttttgcttcctacacctcacataatcatattccaccataattttgtttcccggcaatcacattccggggaatattatgcctaagaatgttatttccatatacatatttagttggcatttagtaattgtagaacaatttaaaatgtaaaaaagtaaaagtaaaaagagaatatcaggatgtaatgagaatagatagttatattcccatgagaatatcatatacccttccctcctctcttgggaatagaatttgcttgaaacacgaagatataacattcccctgggaatacaatatacatggttataaattctcataaccttctaacaaacattggtatccctgagaatagaggaataacatgacgtaaaataaatgcccccttaagataatttttaactgattgatatagtaaaaaaaaattacattaaaccttaataaaattataccaaatatcaactttcatttaattctttttgaaatcacaccaattggttggtccttgttcttccagcagtttttgtctttttatgcatataatctcgcccgaaaaattctgaccacgcaaaatacacatcaaaatgagattaagaattttttcgaagttatagaagaaaataatacatttttatatcgtgatttggttcgagtgacaagaaaacttaatttctcttaaagttacatgtttaaattttatgcatggaataaaataaaataaaactctacaagagcgtttagtctttttttctccctcgcggagtcgtggtaaatgagttttgtctactaaaaaaaattctttttattcagactcaaaatagtaaagaattaaaacgattttcaaatgcctaattgtggagcaaaattaaaaaaatcttgtgacttgattgctgtttaaatttcaggttgccgtcaaacaaatgttgggagttaagctattgccttaaaagctgcacatttgagtataggattcattccagtttaactacattctggcgagatccaatcttaactagattaattatttaaagatgatttttttaaaaattctctcacaacatatacagtttatagaattgtaacattattcagactagtgcaatttggaatgcagaaggctgaaataaataaaagcttgggtacggttaatctaacgagcaaaaggataaaagaaagatgtggaatgtttctagttgttttacatgtcaattcttacagcggcacaccaaggaacaaaaaatgtccacatgatggttgagttttggtaactgcgaagcgaacaagatataatagatttagtggaacttgagactggtcaagacgttgttgtgcacggggtcagccaaatgatctaggaggttttggtatgggccaacacctgtgacaagagcttgaacaaagtaacccaagattgccaacatagccaaccttccattcttcacttccttgagcttcaaatccttcaaggacttttcatccttaccaaagccaagagggttgaagaaaggtcctcctgggtaagctggctcaccagaacctccaagacccttctctagtcctaggaagtattgtttgcccatagagcctggtttggcccagtcttggaatcttctgtgctctgcaaatcccatcagtgccatctcaaacacgaacagtgtgtaggagtctgcccagtagttgtaggttcctgcaggtgggaccacaccggttctgaaccatgggagtgctgtctcctgagggatcagaccagccttgcctagaatttcaggtgctatggaaccaactgcacccaacattgcaaaacgaccattgatgatctcaccatatgctagccattttggctcaatgaaccctcctgttccttcagggtccgaaagtcccagagggtcaaatccatagtcacctggaaggctgcaatgcacatgatgccagataaagtcaatttcagcaccaacatagtaattaattatttaccactcttctaaattgcaatagatacacacaagtgttattcgaataagctttccaggaacggaataaaatgaattaagtttctttcataagttttttggagaaattaagcgaaagagctactataaattaacttaattatgttttaactcatgaaataaacttcacttcacctttttattctttaagtgcttatgagaagtttatatatccagacatgatgatatcgttatattatgttagtgatgaactaggatgaaatttacctgccatccaagtaagaaagactttgctttgatgcaaaccacaaaggtcggtctgatccttgctgaacaccaaaagaaagagagtttttttatatattaagtacaagtgtagatagatgaaaacataaaaacaaatggagtgagagaggaattacagaccttgacagggggagtagcagcagccttaacaagaaaggaggcttttctggagaaggcaaatggagattggagtgatcttggtccaagagtttgtcttgcagcctccgcagagaaggtaagagatgatgatgatacaagagcttgtgcagccatgctcttaatttacaagcagaggattagctaggaatgaatgatatctattgctcccactaatagtacgaccagtatccaactcctggtggatattgaatggtgaggatgagattatgatctacttctccaaccagctttatacacgtaatatcatgaatcatcatctaatctcaccccgcctcctgtggataatatcttcctttctctacttttctttactctcaactctataccacgtgttctttttttaacataaatctttcttccatcaaatcatttcaccattgcccacaatttagaaaataaataaaacacctaggatccgtgtgtaacgttcaaatgtcaaaataattattaatgtttcttctctgccattgaaaattattttaagatattgtgttcatataataataataaattatataataagttatacgacacttttttttctttttctttctctttgcatctcatcattcattttatcttacatttctattatcttcactcttatttatatgaaattatgaattggtgcctatgtttgttgtgttagagatgtttaaaattcaatctaatcactttaaactagtaaatcgatctaaaaaaactaaaaataatcaaacaaagaaaccacatttttgttgcaattaggttttattttttatacctattgtaaatcacgcattatactttaattatttttttatgcctccaaataaattttcattattctaacctaagtcatggcccaattttgatgataaaatatgtaacttcatgtgttgagtatttttttagttatgtatttttgtgactaaaaacaatggtaaaaaaaagagacactccatgaataattaactatgaatggtttttaatgcatttttttgaagaataggtttgtaatgtaattataataacctgtgattttttttttgcttcatttactataattatgtaaatgtcatttttaagggttgatcatgactcaattattacactctacattggaataatttattttgtcaattatcaaattaaaataattttggaagtcttgtgaaaataaattttaaaaataaaaaaaatattggattgatttgattcaaatttgttattagttacattcacatgaaatcagattgaatcccaagaattttatgtttagtttggataatttttcatttaaaaatcaaacatagatgtatcgcagacacccctgataaatataatttcttaataattttattattttaacgtcaaatagagggacacgaaacaaatagaagtaaaccaataaatactaaaaaaatgagataagtatgcttggtttacaaaaagaagacaaaaggttcagttaagtagaaagctaaacattatgtcgtgtttggtttgctaatatttctaacttcgaagataagttgctcacaaagtttcatatttagacgaaggttacgctgcgttagttaaaatacttgcataccgttcgcaaattctttttgatcgttagattcttttatttttaatggatggttaaacaaagatttctttttcttctatttcccttgattgcttcctagtttatccttttctttttctctttccttcgctcttctaccgtcaaggaccacagaggcggtggtgcctcatcggagaatgaatggtgaggttatcaatggcgtcttctcggcttctgctatcaacgagtaaacgctgcaggccggcggcaaggttcccttcgcgattagagtgcggcggcgaccacaaagtccttcacaggtctcctaggatgtgattcttcaaatatgatgatgccaatgcttggtactgattcttcatattagatctgatccttcgcacaactgatgttcaaagcgaacaggaaaggaagtaggagatcatgggggcgaagtgcgttattgctcgtagtggcaacgccatgaggtgtggcgtagagaacaacctctcgttaccagcgaaaagcgatagcagaagaagagggatggaatcgggggtaaagaaggaaagacaaacaaaaaaagaaagaagaaaatttaaccattgattttaatcccactatatctaacggctaagaaatccttttccactatgtgtaagaagtttagcttatgttgtgtagcctttgtcttttatccaacccaaattgggtcatccattataatttttaaccatacacttaaaaaaaataccttttcccacaaccaaaaacccacggtgaaaggtgataatcctgagcaaagagagcaaatgcctcagcagaagatacaatgatgattaatgatgattgcagttgcaaagcgtagaaaggaccctctcaagccatatccagatcttggagagaaattttaagttgaagatctattcttctaagatccaatagaaataccctcaagattttcatattaaagatttgttgattgtaaaaaaatcctgaaaatctgcatatttaaaaaaaaaaacattttttattgtttctctcattaactgattctacgaagaaacacatctagaaaaagaagaaaaacagatcaacaaaaacataacacagtccaaaacaataacacaacaaatacataataatataattttaaaacaaatgataaaaaataaaataattacaaaatccaataaccatgcgaagagacacggagacacgacagtcgacgtgcgatggccagtgacgaccatggggcccaattgaaggctcgcgtggccatgagaccctctcatatcttatattataattataattattatttttgataacgagccatttgctgggcccaaatcatgcaagtgttattcaggacgcacaagctagatgtagttttaaaatacaggatgcagcttaaagtaaattgggtttacaatatatttatgtgatttttttaatttactctgtgcgcctccattttagataatcgtttatagagattcttgtaccgaattcgtcgtttaatagtattttgatggaaatgataagactggggggagatgagagcaagcgggtaaaatagcataatagtaccttagcaagagatctccaagtgctgctttttttttagctaactttatggtaaaatctagcattgaacataaaaaaactttagtgtaatacatccatggcaaaacccataaaacaatgcaacaatctctgatcacttcccctcaaaataactggctgaaatgttatttcttcgttgtgcttgccgtatacctcgtgagaacatagcagtctggcggtgtaatgtttgtataatagttctggattgtttctgtaatttcaaacccaaatttcttatagaagtttatggcatcttcattgtttgtctgcacatgcaagtaaacctcagaaatgttttgcttggagcaaagatcaagaacatgattcaatagctttgttcctgcatgaaccaaaagattcacatcacaacacttgcatagtttataaaaataacgagcttaaaaggaagtgataaattttgaaacagtgattgttgccagatgtaaattaacatgttcccaatatgaagcatgcaccttatgacaaaccattaatatgtatttgtggtactgagacaggtatccacaccaaggtcattaaaaaaatgatcaattaaactttcaatcaccagggaaagatattcagtttctttcttaccaataccaagtccacggtaaggtgctaaaacacctaacgtcatgatgtaaacccgaacttgccccccaccttccttcttctctagccggcatgcaattgctccaacacaaatatcactatagtaagctgaaagacaaaggcaaagtactcaatggtgttagacacattctataggccccttgtctacccatcccttctttctgtatcatccatatatcaagcaaactgaaagcacagagatatcaaacaagctggttcgactaaagaaatattatatgcttgcatgctaactctaagtccaaatgctttcaaaagcacatgattaagtattgaagacatcttgtgttgtattccaataaagataactctgtacatttttctaggcatggataaatttatcaaaatcaaacagggagtgcatattctccttaaataaagcagaaaaagaaggggggaaatcacttcatgagctctccaaaccatcagcatatccaatgttgtcaaaatcaagatcttagctaagaccgggaagggagtagaagattatataacccaggattgtaacatgaatcataagatcctactaaaaatgcaaaattatacttacacatgcgtacacaaaaaataacatagatagcaaaaataacacctaaatcacaatatttagataaactaaaattgaaaattcacaatcataaggttacgtacaaatcataaaaagtcacataacataagtaatcctcaatagcaatcttaaacataaagcacgggcagaaaaatagaagcttgaaggcagtgaggcacaaagcttgaaccccttgaaggcaaaatcttcaaaggcataaacagagatgttggtgctggaagtagaatgcagattattgttaatgggaggcagaacacagaaagcagagagaccagagatagattagagaatgtgattaggctttatagagtgagagcatgcaagggaatcagaaggcgatcctttgatcttactcgcaattttgacaacagagtataaaaaaaaactaatgtaccctggtgccaaaggctcctcgcaacgcgaaagtatgggggagggtcattgtatgcaaccttatccttacatatgcaaagaggttgtttcccatgatcaactggtcactaaggcacgactttacagttgtgtcatggctcaccctcaacaacaacactgagtacatctaccaaaaagaaaaaccaatagaactatgctatatgttcacatgtttgtcaaaactctgcaaaggagttttatttccccattgttaaggaaagggagtgggtatgtttgaatccaaaaagttagaaaggctttcatatcctttatatgcattttgttttatcaaagggtatgtttgataaaacaaaatgcacgaagaatattgcaaaaggtaggaaataagaattctgaattgaacaagaaattcggatcaattaaaaaaataaaccaagtgcaacttgaattaaacaaataaaaaaaaaaagaatgaaccaaagtttaaaaggttttgctatgaatgactggagtgaatgcgtggattagtttgtagccaatagatatattattttgtaagattgaaaaaaatcattgtccaaagattagtaatgtaagcaatgactaattgcaacacccaaattcaaaacatcttcagataaaaataatatattaataatggattataagacctaatatcctacagtggaattagaatcttgagctttaatatgtgaaggaagctaaactgctaaaggcaacctgtgcaggaactgaagtacagtaagcttaagaaaaccttaagggaatacagaggccaagatatagacatatatgcttctgcttcatcatcaaataaaaggaaatatctatcaaatatattttttggcagccaacttgttgtccatgtgatcattccccaatcatgggaagctttttggaggcaaataagtaactagtattggaacaaaaattagttcgttcattgttttatttatttatttatttcaaatggattccaagtgatttgactccccagcaaaaccctgacaaggtaagcataaacccagtagagtagctcgttaagcaaggagaaagaaatatgtaacaacgaggaagaataaagatggtgaatgaaattaatgtggaaataaggaagtgagaaagaagcatagagtagaacctagtttggtaaattcaccggaagcgagtgcatcgacatagtatttgtcattgtagcgaacagggaaaagagcgagattgagctttttgagctgcataaggttcttgtccctcaccccatcaagtgagatggagacttcacgcccagctcccattctacaaaaaacaaaagcaaaaatgttagcaaaagcagagaaggttgcatggcatgggagaataatggtaacggaaatgaatcttcgcccaaactcaaaatccaactctaagagttacctgaaagtaaattcaaattgacgaaccacacatacctagaaaacagagagagagagagagagagagagagagagagagagagagagagagagatgcctcagcctcacctcggaaacgtttgaatctgcgagtgaagagtggcgtggcggtggacgagagagaaaaacctagacccggggtacttttgacattttacaatttcatttttccttttccgaccttttttagagtactgttttaacattaaaaatcttttattaacaaaaaaataattaaaattatatatatatatatatatatatatatatatatatataaggttctgaaatcaaagtccttacatttacctaccttgataaataagtacattacaaaagtgaaataaagagaacaaaaaaaaagtgaaattgaaagaaaaacatgtattattaggaataaaaaacaagttaaaagctttttctcctcttatttgtaggggtgtttattaattggggttggatgtcactgaattcatgattcaatccaaatcaacctttagatattaattttaggtactaaattggatttgtatatatttctttaatccaattcaaattgaatcaagttgcaaatgggttaatttaagtttgattaatgatgaaaaatttaaatttattttaaatttcaatgtagttttaaataaataatatagacagaaacaatcatacatattacacaaatctaggtccccattctattacaattcaacacttcaaaattcaaccaaacacaagacaattctaatatttgcacctacattattcaattgatttgcaacatcatgtgggacctgaactttcatcctgtccttaaaaatttgtttaccattacacaatacatacttaaagaactttacagggttgttatcactaataataatatttttttaatttaaatatatacatatataattattattttttattaatcaaccgaaccaacaaataaagttcacatttttaaaactaaaactcatgatctactttaatcatgaatgagttggattaagtttgacctaaacactcaaaaaaaaatccaacccaaatatttgactaagttaaaatagcaaatgacttataatcatgaacatccttatttattttgagttataagaatagtggaaataaaaaaaatatatgaaaaatattttaaaaattaaattatttattatttttagaattaaattatttattatttttagattagaaaacaatgaaataatgttattttatttcattccaatttaggggattttttttcagtacaagaaaataaaacatctctctttatttttcttatccccacaatattaatttgatatttatattttattccttttaatatttgtgtggattcaatttctatagaaacaaacaaaagaacaaaagagacttaaatctaatgagagaatgatactacacttttggagggcatttgacagttttttttatgccaaaaaaatcatggttgttgaaaattatgaattttattgttaaataataaattctgaaaatgataatttttagaaataattaaaatttgtttgattgattaaaaaaatatttattcaggttttataaggaaaaaaggatttgcatacatgattttaatagaaatttctcaaagatacaactaaaataaaataagatttagggggcaaatttctttgcttccaaccatttgcaatctctaaacaataacagttgcgctcccagctctatgctccatcaaaatgccatcgcttctgccaccccaattggaggctactattatgtgaaacaggtagcagccgcaagaggtttacttcttaattaaaagtcataattaacttatatatatatatatatatatatatatatatatatatatatatatttaaaattgaagttgtataattattttttaattattttatgattttataattttaattattttttaattttaattatttttttaaaaaaataatgacattaaagttgtataatttttttttaaactaaaataatgacttcgatttgatattttttatctgatttaagatttcaaaatcgtaaactaaagttttttttatgatttcaaaaagtcgtaattttatttatttatttatatacttagtttgtttttttcaaataatttaaataattttttaatttaattatttaataaataaatgtatttttattttttagttttatttaatctttttatatttttagatatgattttatttaattttttttatatttttatatattttttactaatattaaagaccattatttattttgtaaattaaaaaataatgaaaaacttaaattagaaaaaccttcgatctaactgagttgattgtcgaaattctttgtacaggtacttcattccataccagaataggagaccgaagatcccactaaggccagaaaaagagagaaaaaaatagataacttgtttagaactaagccgaaacaccttcatatcattactataattgggaatgcaataaaaaactattggactaacatataattaacatataatgtagatgtcatagctaaggaaggagttaaatcccaacaacttttttaatccatgtattaattggtatatttatttaaacacggattttttaaatatctaatcatatttggattttactattttttggtctgaccacagacatcttctactttattggacccaaaactaatatcactcatgatattgttactgctcgctgaattatacccattgaagtagagataattatgattataaatataaaaaatccaagataagagtttaccgcgtcgcttggtggtaaataaaatgtactgtatttaattttagtaaagccgtttatgtaaattaaatagtcaactcctgtattctgcataaatcgagaagacaaaaacaaggtagaattgcacatccaaaccaacgtaagaggttgattggatttccatgctttcttctcccttttgtccccagataaataccaagtggcaaaagtaaaattaaaataatttatttatttatttataactgcaagtatttgaaaggaaggaagaccttatcatctgggaatttcattttcagagcttatatcgaatcaaattggagtgtcggaaatccaatccgaagcataatgccttgtgcgagcattgtctcagctccgtcctacgcgttcccttttcgctctagctccgcttccgctacttgtatcactccaactacgatctcgctcactaatcgccgttggaagccacctccaatgagaaaaggcctagtgcgagccaccctttcgatagagaaagagaccccggaggcccagcgtccggatacgtttctcagaggagtggacgaggcccagtcttccacttcggttcgggcccgcttcgagaagatgataagggaggcccaggacaccgtttgcagtgccctcgaggccgctgatggtggggccaagttcaaggaggacgtttggtccaggcccggtggcggcggtggcattagcagggtccttcaagacggtgccgtttgggagaaggctggggttaatgtctctgttgtttacggtgtcatgccacctgacgcatatcgtgctgccaagggtgctcctaccgatcaaaaacctggtcctgtgcctttcttcgctgctggaatcagctctgttagtatctctctaccatctcaactcatttttttttattgcctttttttcttggactaattaattttccctcattgtctttctgttcaggttttacatccaaagaacccgtttgcccctacactacatttcaactatcgctattttgaaaccgatgctcctaaaggtaaattacattttgctttgctcatttccaagctcctctttttatcattttagcagtattttttgtcatattactttcaactcatgtgatgtgattcacaatttctttttatactgcttctttcatgcctgtctttttgcttcctgttgtttgggctttgtttgtgtgcttgggactgtttaatctttcattactgtatagaagctaatatgatctgatatctgctccgtctttttcaagcttggttacctcgggttcaactttgtaggtttttttttcttttcaaattactatttgttatcagttgcttatgattaaatcacaactatatatatataaataaaaacaaaaaaacaaaaacacaactatatctatatgttcgtctcaaaatcttaaaacaaatattaaaccaaagagatgttaacataagagcataaagttgttgaatccttttttaaatatgctgctattgatagtcaagctgttgctttctgcagatgctcctggagcacctagacaatggtggtttggtgggggaactgacttgacaccagcttacatttttgaggaggatgttaagcacttccattcagtatgtgcttagcacaagtattggcttctgacatttttatggtttagaaccaataatggcttttttacttggtaaaagatgaaagaaaaaatcaatttcctttgttctaaaatgtcaccacaccttgatgattttggtcctttttgagagtacctttaatatatttttgtagttttaggtgggttttctttagttgaatttatgtatcttggttcatttaaaattggaggcattgaaatgttaagcaccgaatttgtttctctttatatttctatgaaaggttttggcaaatgcttaaggattttgcaatcaaggcacttaaaatctctcttactttaaatcatgcttcttatgtagattcaaaaacaaacctgtgacaagttcgaacctacgttttacccccgattcaagaaatggtgtgatgattacttttatatcaaggtataattcttaatcctttttcccacaatgaagcttttaatactgtaatttttagcagtcttaggatctgtttgataaaactaaagtctaaaggttaacagtgatgagtgagtattaagcattccatgtccagttcatgtacctttaatagaagtttactcatgaatttggctttctgttatatttaattttgatgaatttaatatatgatgaattggaggctgtcataattaataagcaagaaacaaatggtggtaaatgggtaacagcaatgactgtcagtaataatgaaatgatgggaatgggaagaagatatgtgatgcaggggaagcaagatgatgactatgcaattatgatcgtggtggtagtggtggtgatcatggcgattatgctggctacagtgacatcggacagtgttgtggtggtgatggtggtggaacaaaggagttgcacactgtgagatgaaggtgaaaagggaaattttatctatgtaatcttatttgttcagaatcttactctccccttaggataattttcgaattaatgaataagatatgatgaacaaataggaatagaataagtttatcatatctaatcgactcaccaaacaatagattaaaataggatatgatagcttaccctatcttatcttctttatgccaactacttagtgtccttaacacataagaaacatttgatactttcttcatcttataaataggaggattactaggaagatgttgtcggaaggtttaaaattgttaatctgttttcagtctcttgtttgtcagttgtcatagacagtgctcccgtttgagtataccggagttgagtcaatataacacgtaatttgatgggccatggaggccatcttttatgtttaaggggttagagtggattcattatacatattttttaaattgaagttgagtgcatgggcatatgctgttgttggttgtttttccttatcttcctcttatttcttacattcagcatcgaggtgaaaggcgagggcttggaggaatattttttgatgatcttaatgactatgatcaggagatgctcctttcctttgctactggtaattacttgcatttataaatctgatggttctcactggaaagacatataattctctctatctcatgctgcccaaacaatggttgcttgcagaatgtgcaaattctgttattcctgcttatttacctatcatagagaaaaggaaggatttgcccttcaatgatcatcagaaagcatggcaacaattgcgaaggggacgatatgttgaattcaatttggtacaccttttaacccaactttagacttaaaatgtattgctctactctttcaaatcagatttgtatttgtattatataacatttttggccacaggtatatgataggggtacaacatttggactgaaaactggagggagaatagaaagtatacttgtttctctcccactgactgctcggtgggaatacgatcatgtacgattttggaatcttctttattttaaacaagttggatgttagatgacttaaattttccatttatgaaattgctactgaaatgttggtgaccttttgtatgcagaaaccagaagaaggaagcgaagaatggaaactcttggacgcatgcatcaaccccaaggaatggatctaattcatcagttgacccccaatttgtcagctttttaatttaataataagagagcttgtttcttttttcggtgtatatcaactatcaagtgcttgttatgatgagtcagaatgttagcttgttgtactaggtggattgtaaatcacgtgttttgctagagtcatccgtttaaagcgtgaaaatgcagaaaattacaaatgtctaggatgcgtctgtagtatacctactgccaaccattgttctttctacaagtaactcctcaatgaaaacaaaaggcagcttctttaatgccagtattgcacaccacagactagtaaattggtaattctgttgaaggtgatatcatattttttactgaaaaatctgtgcgcaattgctgaatgtaagatcctttaatttgccacatacatccacttttaatgaactcatcgaacaattattaaattaaatatttcataaagtgataggtatggcctatggtgaagaataaaataaaattcaaaagtaaattagtgaaaatgagatttaattgggtcaaaatttacatcatgcattgcactagcatttagcattcccccacccccaccattgtcaatatatttcttagcaatggtggaaaaatatacaaagaagcacacatcgtttgcaatgcagcatgcacccttctccttactacccccaaaaccaaaaggcaaaaaaaaaaaagaaaaaaaaaaagacataataactccgtatctgtcactcaggccaatcgaggaacttgcggcccagaagtgatggtggcaagtaagtttgtgttgcggtgggattgtcgggagtgtagatgtatcccttcccatatccaatgtccttcattaatttggttggagcattcctcaaatggagaggcacaccctcattctgtcccgcggattccctcactgccttctgagcggctcctatggctcgataaacagcaacagacttaggtgccaaggccaagtaagcaacacactgagcaagaatgacattgcattctggcattcctatgaagtggcatgcttggtagcatgagactgcctgattaagagccaatggatcagccaaaccaacatcctcacttgcaaaccgtatgagtctgcgtgcaatgtaaagaggctcttcacctccctctaacattcttgccaaccaataaatagctgcatttgcatcacttcccctcatagacttgtgcaacgcactgattacattatagtgctcttccccagctttatcataagcaacatgcttgcactgaagtgcctcctttgcatcagcaacactaacaacaacagcagcagcagcagcagcagcatccttgcattcctcgttcgtgtgaagatccaattccatcccttgttgtagccttgcagccgcggtaacagctgcaatctccaaggcattcaaggccacccgagcatccccatcacagttgttgcttatgaaatcaacaacttcctcgctcacatcaacatgaacccccacgctctgcatcaacccttggtcagtgtgagtgacagcgcggtttagaagcaaggcaaggtgatggggttggagagggttaagagtgaggacgcggcaacgagacaagagaggggtgatcaaatggaaagaagggttttcggtggtggccccaaggaagacaatgctgccatcttcaatgacgggtaagaaagagtcctgttgggacttgttgaacctgtgaacctcgtccacgaagagaacggtgggttggttggatttgagtctgagttttctggcctcgtcgacggcgtccctgacgtctttgacgccgctggtgacggcagataaggagacgaagcggtaagagttaatagaaggggtggagttgacgatggctttggcgatagtggtcttgccggtgccgggtgggccccagaggaggatggaggggaggcggttgcgttggattgcggagcgaagaagggagttgggagcgaggagatgctcctgacctacgacgtcgtcaagggttctgggacgcaaccgctcgtacaagggttcgtgaatgtggctgttggcgtgtttcttgtctgcgatcttaaagaagaaagagggcgagtgttgtggttgtggtggagaaggagaaggagaaggagaaggagaaggtttggggcgcttggagggttcgtcatgttcttgtgattgtgactgggaatggaagaagcgatcgagcttgggctggaatgtggaagagttgggtttctgagagagaatccattcggtggctttgacggtggatttgccgccggtggcagccaaggcttgggcggctaactcgtccgggaagcccatactgaggagttgctgcatctccatcttcttcaatttgatgcaaatgcaatcttctcttcttttctttattctcacacccttctccttcctactttctcggggctcgatactaatcaacggaggatgaaaataattaaaattttaatattttagtttaggtatgattttttttacatgtttaggtatggttttaattttttttattttaagtttttatcttttcaagtgtttggactacgttttttattctatttttttttacttatacttttgtcaaactcaaatataaacaaaattaatttatttttagctaattaataatacattcagttctataaataaataaaaaatatttaattcgtcaaaataaatgaaaatagataaattaattttaattaataatatcataaatttaaaatttattttaaatatgcttatagaactaattagtttaaagtgacgattgtatataacaacattactaataatttaagaaataatgagtatgagatataatgttaatagtttgataaatgcatttactttcatgcaaaaataataatatctcaatattgtatttcacaataaatcaagaccaaggatatcaattattaatacatttcaaaacaataatatgtttcattctataattaggaaaaaaatattatgatttgtttttatgtaaaggatcggaattagtattaaaatttaaaaactattttttaagtgtctttttaatttaatattaagaataaaaaataatcttcgattaaaatttcaattaattaaaaattatttttaagatgatattattaaataggatgcaaatagttaaaatttgctttcatcaatccttttttttttccttttttaattaagtctggagggagtaaaatataacaaatgtattctaatgggtgtcaatatttttttaagtaaatcaataaataataaaataaaatagtgtgtgataactttattaaattttacaataatcattgtaaaagttatattgataatgatttttaattgtttgataatataaaataaaataaaaaacttttacattgtggatgtatgattattatactcttatttgtttaggtttattatccattttatccttataattacaatatatttctcttttagtagttataaacattctattgtgatcctataattagaattgatgaagtagtaggacaattttactgtaattatatggatagaagaggtaatgatgtgagtgtgacaacaaaaggaaatagcaataggatgagggtcatggcttctacggttgttcctgttcctcctgttcaagttgagggcggaaagccaagccgcggcgttagcattcggtctcgcctaagcaaactgtgccaacagggacaacctcacgtggcacgccatcttctggacactcttccacgcgcctccaccgctgtgtggaacaccgtcatcatcggcttcatctgcaaccacatgccgttggaagccctccagctctacgctgaaatgaagtccacccccgacaccccttccgattgctacaccttctcttccaccctcaaggcctgcgccctaacccaaaacctcactgccggtaaggcccttcattcccattttcttcgctccccatccaactctcgaatcgtctacaactccctcttgaacatgtactcctcctgcttgcccccccaatcccaacacgactacgtcctcaaagttttctcctttatgcccaacccaaacgaaacgtcgtcgcttggaacaccttgatttcatggttcgtcaaaacccacagacaccttcactcacttcgcgccttcgcaaccctcattaaaacttccattactccgtcgcccgttactttcgtcaatgtcttccccgctgtccctgatcctaaaaccgctcttatgttttatgccttgcatcttaaatttggtgctgactatgtcaatgacgtctttgctgttagctccgcaatcgttatgtttgctaatcttggttgcttagactatgctaggatggtttttgaccgttgctccataaaaaatacagaggtttggaataccatgattggtggttatgttcaaaataactgtcctcttcaaggggttgatgttttcgttcgagccctggagtcagaggaggccgtgtgcgatgaggtcacttttctgtccgttatctctgctctttcgctgctgcagcaaattaaatcggctcatcagctacatgcatttgttctaaaaaaattggcagttactcccgttattgttgtcaatgctatcatggttatgtactccagatgcaattttgttgacacttcctttaaggtttttgataacatgtctcaaagggatgctgtttcgtggaatactataatttcttccttcgtacagaatggtttggatgaggaagcactcatgcttgtgtgcgagatgcagaagcagaagtttccgatcgattccgtcaccatgatggcccttctttctgcggcttccaacatgaggagctcttacattggaaggcaaacccatgcatacctaattcgccacgggatacagtttgagggtatggagagttatctgattcatatgtatgcgaaatccaggttgattaggacttctgagttgttatttgagcagaactgcccaagtgatagagatctggccacatggaatgctatgattgctggttatacacagaacgggctcagtgacaaagtcattctcattcttagaggcattagttcacaaggtaataccaaatgcagtgaccttagcctcgattctcccagcttgtagttcaatgggaagtacgacctttgctaggcaacttcatggatttgccatacatcatttcttggacgaaaatgtttttgtgggaactgctttagtggacacgtattccaaattgggtgcaatcagttatgccgaaaatgtttttatcagaacaccagagaggaattctgtcacatacaccacaatgataatgagctatggtcagcatggaatgggtaaggaagctgttgccttgtatgattcgatgtgagatgttggattaagcctgatgcagttacttttgttgccattttgtctgcttgcagttatagtggtttggttgaagaaggtcttcacgtatttgagtatatggacaaagtacataaaattaagacctcaattgaacattattgttgtgttgcagacatgttagggagggttgggagggtggtcgaagcctatgagtttgtccagagattgggtgaggatggtaatgcaatagaaatctggggatctattcttggggcctgcagaaatcatgggtactttgaattgggaaaatttattgctgaaaagttgcttagtatggaaacagataaaaggattggtggatatcatgttttgctctcaaatatctatgcagaggaaggagagtgggaaaatgttgatagtgtgagaaatcagatgaaggaaaaaggtttgcaaaaggaaatgggatgtagttgggttgagattgctgggcatgagaacttctttgtatccagagatgagaagcaccctcaaagtggtgagatatattatatcttggacaaattgactatggacatgaaggatgctggttataagccacgcaacaattccaatttaaataggattttggaatctagtgactgaaatgaatgtgttatgacaaatattatcaaagtgagctgttggttgctctgcagtgggcagctttcaaaaaattgagtttggttcgttgttacacagcagtcataggattgattataaccaatgatagtttcacgaccagcataagttcatccagtgtacacatacatgactagaactgttattgttcattcatttgaaacacttctttcagtgatgaacaactcattcaattcatgtacagttgaatagtgtcacaagtttcatcctaccttttactcctgatacaagaaatggtgtgatgattactgttatattgaggtataattctccagctcagccttttttacataatttggctgtagtcttgaactcttggggcttgtttgataaaactgaaaccgaacaattaagagcaaaagtgttttgtgtgatagtggagatgttatctcatgaagaaatctgtgaggttgatgatgcatttattcaagactcttggaattgtggtgttataaggcaaacttgcaactatgattattattgagtcttacccctaagcattcctgtgataggcggtttctcaaatagtttgattttatttttcaagcattgtaactgtagtggtagatatattggaaagcatatgggataggatctcattagcattatttggcttacaaaacgagaccagccagttttcatgcacaatggtcctattttagagaatttcatttccagtttagtctgtatcatagttttaaatagcgggtagctgtcagtagcaatcgacctcaaaaacgctaaagcggtatagcgggtagcggtaaaactgctactgtgaaatctattaaaaatacttataataaattatattacatatataaatgttataattaagaaattacccaaaaataggaagaaatgaggaatgaaaagtataatacttatattttttattaatattaatatattattaataatttttaaaataaacaagcttattaactctaaaataaataaataaaaatatattttttattaatattaatatattattaatatttatttaattgtaccttcatattaaaagatttatttctctatataataattttcttgtttataaacattacttttatttaatctcttaaaaaaatgtttagtatagcattaaaatgaataaaaaataggaaaaaatattttgctttaaatggtgaataaaaatgagtgttgacattgacagaggaagtggagattgcagtgataaaccatttaccaaaacccacatgccacacccactttctctcaatattgtgtcagtgataagccttatctcattattatcttctctttcgttcttcctcgatccatacccataggccacacccactttccctcaaccctctctcccatgacctcctctccccctcctctcgatccccccactgccatctccctcgccctcgtccccatccctgcaccaccctcctcccaccatctccctccgtcgtgctggtcccccgatgaaaccctcgccctcattgacgcctaccgcgacaagtggtactcccttggtcgcggcaaccgggcggtgaggggtcggcggcgccggcgtatggatttgacgaggcaacggcaaaggagctctgcaactcgtcttctctgcaacccttaacttatttttaattttcaaaacactgcccgccgatggctaaagctttgcaattttttctcttccatggaaatagcggcgcgatagtgccgcaagatctgccacccgcaacgccacctccggaaaccgtcgcgttgcagcatagaagtagcggctggggagatagcgcactaaaacgccactattttaatctatggtttgtatcacatgtaaataagacggatgccttctgtcatgtttaagtagctaatgtattcactatatatttttttttcaattgaaattaagtacattgcatgtcatatgctgttgttgattgtttttcttcatttttcctcttaaatataaatccagcgccgggatgaaaggagagggcttcgagaaatatcttttatgatcttcgtgactatgatcaggagaaatattcatgcatggctacctgtcgtgtaagcagcacttgtggtgtcaaatggtatatagtttcattaccaacactgcaacacactgatccagatacggtcatcgcggttgatcataagcttggcaaggaaggaataaattaacaccactcggccatcttacttcatcttcgtgactacgtaatgaaataataatatttggagattaaataaattcttttctttatagaacgtgaatttgtcgggaaatattgcatgtctaaatcaaaatctatgctgattggggtgtcaacaaaaaaacaagttatggaccgcatcattttatcatgaaccgctatcacctatcagcctgtgacattggcatatgtggacatgtgcgttggctgtcctcaataagtgttatttggactgcacgtgaattgacatatgtggagattgtgcttccactctagactaaccacagtataagtcgctttccaaaacgtcagagaatattagttaactaaacagaatatgcttgacacatgatcttaattataatattcttttttatttttttaacaacaatgttattaacacacttcttcgttaaaaattaatttttgtgactgatgtaagaatcacaatgatatttaccatattcttttaatatttttcttccacgaaataaaaatatggataaattatcatttttatctttaaaagtgtttaacgctaacaaatttattcctgaatgttaaaaatacaaaagttagttcctgaaaatgtaaaagtgagaaaaattcattccaccgttaactttcgtccattaacattaaggaattcacctacgtagctcgtaaggacaaaaatgtcacgaaataattgctcacatgacattcattggttgaacctgaggcgatgactcgtaggactaaaatgtcaatataattttttcttgtgttactacttgagtcagactcaaaacacaaggtcatttacccttaatttgttaagttttctcttttcaccttccccttctcgccttttgagacttctgacgacttccatggctaccgtgaaggagcaccattcttcttccactgaagacgaagctttgtatatctttgaaagacaaaaatgtcaataaattatttaatttaatgacgtatttgtcagtaacttaaatgaatgaaggtaagataaaaaaaaaacacctagagaggaagaacaagaaactcagtccttcattcttggagaacaatatataagatagagggaaaaaaatagtcattgcaagtctaacaatcaaaaggagaagcaataaaaaaaatcattactaacaaattagtctctatgtccacgtgataattctttcatgacactttcatccttacatgccatataagcgaactgactaatattaatttattaacatcacatacttttaaaaacaaacataactatttaccataaaaacctattaaaataatgtcaaatattatgatgtacaaatactattacccaatataataaattacactaggtaacaaagccgaaccccttctacgccaacacctaaattcaccaacattccttaaacatttttttattttacaacaaaaattattataatctaaatttaacttactgacgctgtacagatctctaccttaaaaaatatacatcacattaatctaaaaactaacaattgctacttccatttaaaaaaatatattttttgaattgtcgctgtgatccaaatgcatatattatgcagtcatcattcaagactaacaactcaaaaacaaaagattaaattgacaagcacaggatttcaatttcaaagtacaaagcaaaagtattcctcaaacatacagattaccagtaatagacaggtcggtcacgcgtacacaaacctgaaattgccaaccttcagaaaatggaattcagatcaagaagatcaaaatttcctgttaaaacttaggtttatgtttttcttttctattgtacaaaaaacaaaaaagaaagaatcaaggagataaaaaatcgaacattcaacgtaacagcaataaaaatggggcttagacataaactatataacaggaaaagtccatcaatcacaccaagcatcatgcccaaaaaaaaatggcaacaactatgagtgtgtttgttttactgaaatcgtacattccgatgcacattcaacgggatggcagtatcaaaagattggtgttggatggaactaacaccaatccaaacaaaccctatataataggatctcatcacttagtggtttgcgcaattatattacttaatgaactggtttcctcctgagcagtctccaccaatgaatcctgaaaaccaaattcatatagaataacatcagaaaaaacttttgagaaagaaactgccaaccaaaacattcccaaacaagaagacctgtgcagctattaaccttagattaattatcatcaatttaatttgaaattataaataattaaatcatgatagcagtaattataagttaattgttatcaaggaattatgataagtatacgaataattagaatattaatataaagataaaaaattagttaagttttagatttttttttaaataccaattttaaagttgttatttttaaaatttaaacaaactcatcctcaattatggtaattaaaattactataaaatcttcatttttataataataaaagtaattgatgatgtgggatacgccaacgtgataacagtggcggatgagaacacttcttgagtgaagaataaaaaaaatgtgaattttgtgtttttcttatttgttctagatttttgaaatatttttaggattttctttattttaacatctttaactagtaaataaataaaaaaaaatcagaaaaacgatggtggtaggaggagaggggtaggacgagagggagaagtgaagttgtgaagaattgggagtaaagatagggagaaaaagtttagaagtggtgaagaattgtttttattttatttttgtgtttcaaactttcaatctggatttgaaattgtataaatgttggatttggatttgagatataagaatttctagcccatagaatatgtttataatctttaaaaagttatcctagcctttgagttgccataaaatgaattataataaaaataaataacatatcatcatttaactatggaataaatgaaaatgatctaaacattggacatagaaaaagtagaagtgtcaaataagtgtgatgaatatagattgatctatcataagttgagtgttaaataaccgaattaatttaactcatatttaaatgagtcatgaaaatatcaactcgatatgattcactatgaattagtgggttagataagttgactcaccaaatttataaaaataaaaagtaaattctaaataaaaaattaaaacatttttcattttttttaaaataattttttcatcaacgacatttattaattcaaatggttcaaatacgaatgcaaataataggcaaatgtctcaaataatcattcaaacatataatattatcattcaagtaataattcaaatgtcttaaattcctaaatatcattcaaaaatcttacaataccaaagtcttaaaatcaaattcaattgtctaaacatcatgggttaagtgagccgaattacaatttcatcacattgcaaaaaaaattaatttttcatctaggcgggttatgctttctacacccagcatattttcaatacatttagcattgtacagttaattttcaaaaataccctttgtaaaaatggacatacaccatttatctttttcttcttctcctcttgtctgtttttgtttgcacaatgttctctttcttctccaccttcaccattcgttcgtgcacccaacgtcgtggttcgtatgttgttttgttattcgtcgttgctttcattgatttttgtcttctctgccttgagtttttctcattcgtttgtgttgaatatttacgaattgacaatctgtatgactacgaattaccaatccgtatgagtcatattgataatcaatccatatgacttatacagattgataatccgtacaagaataaaattgtaaataaaaaatatactgaatatattaaaaatatgctgagtttaggaaacataacttacttatgcctcaccagattcggcctattttgatatcaataaaaattgttgaagaacgaagtctttaaaaagttgaaggaacaaaatcatgaaaatgaaaaagcattttttataagagaaaaacatagtttactctgaaacaatcgtttagtactcttcttcgtcttcgttttaagaaaaagaacatttcggaggaaaacagtgaagaaaaagcgcataggacgtttgcgagcaaaattgcgatttatttattaccaaagagaagaaaaaaagagaggcggagcggaggagaagagaatagaagaggcgaatggcagatcagagcgagcattcgaaaacggcgtcgcctccggaggagcaggagcgtcccgttcgggtgtacgcggatggcatctacgatctcttccactttggccacgctcgctcccttgagcaagccaagaaatcgtatgcatcaatcatttcctaatcctcatatgatatttgatccttcgctttgcctccgagatctgataatagatttcatttatatcaatccattaattaatagaagtcatttcttcaaggttccattcacagacactcttactttgggattttaggtttccgaatacatacttgcttgttgggtgttgcaacgatgaagtcacccacaaatacaaaggcaaaactgttatgacagaggccgaacgatacgaatccctgcgccactgcaagtatgatattttgtttgttgttgttgcttcaaccatttgaatttgaatttgaatttgagtttgatttcattttgagatcagatgggtggatgaagttattcctgatgccccttgggttatcaatcaagagtttcttgacaagaacaacattgattatgtggctcatgactctcttccgtaagattaatctctcaacatcaacatctgaatctagtaacttcattgcataatataatcatcttttttccccttgtcaacccgttgtccacagttatgctgatgccagtggtgctgccaatgatgtttatgaatttgtatgtatggcaaaatttttttttttttttttatttcgttgttactttctcctctgacttatactatgtgccgtgaattttgtatgtaggttaaatctgttgggaggtttaaggaaacaaaacggaccgaaggaatatccacgtcagatgttataatgagaattgtcaaagattataaccaatatgtgctgcggaacttggatcgtgggtactcaagaaacgagcttggcgtgagctatgtgaaggcatgatttgacatagatctctttgatgtattctactttaaaatttaacatgatacgtctttcagcaaattgtttgtccttatattgacgccactctttgttcctttggtgaatgctcttgtcccttgtggttgtcattactttgtcataaataggaaaagcgactgagggtgaatagaaggttgaaaacattacaagagaaagtgaaggaacatcaagaaaaagttggcgaaaaggtatgtattgctataacatataatttaggtaatcaagtcgaattaatacttttgttaggcaacatcatgtgaattaaatgggatgaaagggctgtaggatgaaaatcacatgtagattgtaaatttgtaatgtaatgactgttgaagtaggagctaagaatgtcaggtaaagtgctttgaaaaattcatagttaagtaaaattgtcattcaaactgttatgggacattgggcatctgctactggtttttggattcaacggtttatcttcacaattttgtctaagtattgcatttgtggatctcggagtctttttcaaggacaaaaacatgatcaaggagtaaaatcaacaaaaaaaccaacccaatctgaattgacatatggctatgttgttttaattgttattttgaaccatgcagtctgttttaattcggaatcatggagtcctaacattatcaaatcaattgaatataccttctcgaaaattgcattcctcatattgtgctaaatttcattatatatatataggtctttgttttcatatcctctgtatgtttttatatttaagtaaatgtattggcttcatggatcttcttgctgtttgattactattgtgtaattagagaagggtgggtgggtgggtgggtggagaggggggagagaactttgcagattgaatttcttatttttcttaaatttatatctatatatttttttcaatatagttttaacttatcattgtaattttagtgtgacaaacctggatgaatgagaaaatattgcttttaatttctccccatttttttgtcaaaccttcactgtcgggcatcacagatcacagtttcactggtaattagtggttgtatgatttattgccatgaaactgatatcagtcagttactagtttgctttggcataattctctattgtcagctatacatctgattccaaatatttcttgtttcaatttttttccttgactttattaggctcatattaatatttggccaacattaaaattctttgcctacacggaaaagatactagagagtgaaaaaaactatggactggctttattgtagttgtcttgtaaaagaaaaatagagaaatgatactatttttgcatctctctctctttctgagtttgtctttaagaaaagttgtgtcttggtgacttgttggttatggggtcgaatccggaaacaacttatttgcatatgcaagggtaagactgcatacaatatccctccctcttacttgcgcatagggtggagcctccggatattggggtacgtagttttttatttatttatttattaggaagcagctttcttaaattattgattttgctaatgtatatcggggtgtgagggagatgttttgttaaattgaaagtgatgaaactaatctacggtttttgctttgtatatagcagtatagatgaggctatggtttaaaacctatgctttttacataataagtggacattagtattctcttttcaacttttatgtacgcttaatacttaatatataacagtatcatacattgaaattatctcggttgtttttaattgaattatcaattatggtaaagatacatatctttgtgtggtttatccagatccaaattgttgcaaagactgctggtatgcatcggaatgagtgggtggaaaatgctgatcgttgggtagctggttttctggaaatgtttgaagaaggttgccacaagatggtgagctaatttatgtgaaaaagctatgcaactcttctaatgtatgtaaacttcttgttaacttctcattttttatttattgttaccacttggatctacaaacagggaacagcaattagggatcgaattcaagagaggttaagaggtcagcagtcaagagatggcacacttcgtctacaaaatggcaaggatgataaggacgacgatgatgaggagtattattatgatgaggaggatgatagtgatgaagaatattttgaagaatattatgatgatgatgagcttaatcctcaaaataatggaagagatgagaaaaaagaataggtatacttcggtggagttgttgggttctcggcagaatgtcaatagcaactgtccgtgcgatatctgtaatattatatgcattatgttggatagtggatttgaagttgcacaagggaactttcattttgctggtgtggtcaaaattttgcgtgttgaatgctggtatacaagaaagtgttgtttgtgcatatgcttaattttagatgggaaaaataccatatcctttttattcacttaatttcgggttctactttctttttcagcgttgctagctccgggaaggaaaatcacaacttactcgtacaatctaacgtgaattttcatgtcccattgaagtcatcaattatatcttttgcatattgtaggcatcatacatgaattggatatatgtctttagaattagtttgaatcatgtgattttataaaattgattttaagttaatgtaagatcagtcgtatgatttttttccgcgtatatttgaaaattgattttgacatgtaatgtttaaaataacacaattcaagatagtgttcatacaaaaaaaaataaaatactttcaattgcttccaattaaacttgaatttgaaacacaattcaagatagtgacgctctttttagattttattgaaaattataaattttcaataaatttaggaaagagaaacattaattaagaagtaaaatttatcaaaataagtgattttcaataaattttaacaaattacaaaaaaaaaaatgtcgttaacactcctcttatatcaaacatcatcgtcaactgaaaaataatgtttgactcatcctaaactcaaagatgaaataggtccaaacacacttgttaacagctacttaatttcaaataaatttattttttccacaccatggagattttactattataaagagagggctgcttcctgcttccacatttttcgttaccaaaggccagagagataatgaatgctatttatatataatacaaatttatattaactttcatgcaaaagagataataaaaaagtatataataaaatagaaaatggtatttggacagtatttcatttagtgcatgtttagttttacattaaaaattaattttgagtccataattgattttaggtattttttcacatgtttagttttcatgctgaattttttttataattgattttgaatccaaacttgattgagtagtatgttaaatttgtgtccataagtttacgtggatcaagttcaacataatgttgaagcagatatgcattgagttgaattaactttgagcaatttttgtattaaataaaaaaattatactaaattttacttttaacttaaatttaaaataaaaatatttaaacattaatcacatcacttcaaaatcacttttaatcaaaattaatttcatttaaaatcaattttgtcaactcttatcaaagaattcatttaatatatgttattgacactcatcattctctttttatcatatcatatctatatattttttgtatcactttcttataggtgtctaataatttaattagtgtccaacaatcatttttaagattaaatgacttatttgatcatttatcttttttatttatttatttcaatttggtcatttatcttttaacaaagctcattttagtcttctatcttttaaaaaaattatttattcatttattttattttttggttcaatttgattttttattttattattttgttcaagtttgatcttttatctttttttttcttttcaatttgatctttaatttatttaagattaactttatttatcatttaaaatgatttttttttcaattttctccctttttccttcacttcatttttaacaaaaaagttcgtttaaaattgaaacaaaaaattaagataaataaccaatttttaactaaagcgaactaaaaaaatcaaattatatttaaaagaacaaatgatcaaattaaactaaaaataagataaaagatcatataagtgatttgatatttttggaataaaataagtaatttgataaaaaaataaattattataaaatttattgtgtgaataacgttgttacagagagagataaaaagaaggaagcaagtcaacacacgtaaaagaatttgtaggtagtggcaggcctaaccgagttaccatatccaaaataattgaactataatcgggctaggactccctaaagagaaggtcccaattaagattaacatagaaaacaaatacacaaatttaaatagaaaaggaaaacaaacaaaagcttaagccgacgccgacacagcataaattcagaaaaagaaaaaaagaacatagctggattcgatttcaaccaaggaaggccaaaaaataagatagagctgaaaagtgtggtacaggtgcaggtggctgtctacactggaaatatagttccatttcacatagggttggtcaagaagttagcacctaaatatctgcttaatttatcgctgtcggaagaaacttaaaagctccttcctattggacagacaagaaagattcaagaagaagttgttgggaagaaacggccgccatcgtccacgaaaacctcatcagcacgatcattatttggagctgttgctgttgggttgctcagtctctgaaaaaaaccgttgtctccaccatctgtgtatgctaagtggttttgttgctgataaagggactgagaaggggccaacatgaggccatttgggttcacagggattggctgcccaaacagatcaggcgcagaaggggctccagtgaactgttgcaccatggcccgaaaattggtggtgtccgtgttcagcagagtggtgggagttcgccttgaggcccgggaacgccgtctaatgggctttgagactccgccttctgggcttagctgggccggcgcggcggtggttgtgacggttgtggcgtcggaaacggaagaggggaattggttttgttgatagaaatggagccagtgatcattaggaatagggccagacatggtagcactcatggagggaatgagaatgacatgggaagaaaaatgtgcattggtggcctatttatggttccttcttcactgtgctcaccttggtccttgtcataactcataagtcatagttacaaacgcaatgcaatatcctcgcccttcatttactgaccacgtgttcatgtgtcagacaataatatttaattaatagaaagaaaaaaaaaaaaaaaccttttttcttttgcagacactgaatttttcaagatggtttggtgagtttacaggaaacaagaccggatggttttagtagtatatcaaaaggacttcatggagatagaaagtcatcataaataatattcttcgtaatttggtttttaatggaaatcaataataacatgtgattcatgtagtgaataaaaaaatgttgttattgtattctgaacttttaattttatttttgtaaattaatatttttatctatttaatagaaaaataaatttcggcaccgcatatatttgaagaaaataattaattacacaaattattatgattaaatgacttctttttactgagatagtgtgattatatatgagatcgatgagatataatataggtgtgtatcatttaaatatttacgggagatactaataaatgaaaatattgatatcatttagaatgttggagtttaattagggaagagtaggatgatgttataatgaggtgtgattgagggaaggggggatgtatgtcatgagtcatgtgtgtttctttgaggatgcatccaggaagcagtctttgggatgaaatattgaatattgaatgacacactgtcaagtatctgcgacttcttctgtggttgtggttgtggctgacttgggctcttccttcaattcagtggactggacttcaaattctaatccaacttctacatacatgaaactcccctctaccttcctcaacttcccttccacgctaaacatcaaaatatttcactttatgcttcattattctaccacctgcttaccaccttcctttaatttccttcattctttaactcttcttacaattatatatttatattcctcaatcacctcaattgattaaccattttcttcaaaataaaatttaactcgccagatggggtgaaaaggcctacaattctgcatttcagcttaaacacaagtcatccatttaactattgtctacttctaaggctaaaactttctgcacctctaattatttcttcttgtcccccattgcattttggaatataattttacatttcatgttgtactttttaaaatgcaatgggacatgaaacgataattgaaggtgtaacaacctaattagccacacaatttatgagcttgtagaccaatggtctataacttgtaaaaataactttgttaatatattaaaaattaaaaataagtttaattattttaagtacctgaaaattcaccttattagccacatgcttatgtgaacttatctaattaacccatttttgtacaatttaaaagaaaacaagagattagatttaagaaataaccattatagtagataaaaaatataagttaacctttattattataaaaaatgctaaattacaatttcaattttcttttgttagtatatgagtttaaacattttttttcttcctacaatcatcaaatcaaccttgaatccaacggaatgactttcaaatctttccgaaaaaacatccttcaaattgtatgtattgtgttaagcatagatctcaaggataattttaaattaatcttaaataaaatcttaaataaaaaagtcataccactatagtgactcatcacctcttttataagtttgatatggaaataacaattgacctatattgaaggtgttttcatgtggcttaactttaatattttgaaattacaaaatacaattttgttaatatccgtttaattttaagtatttaaaaattaaaagcaatattttttattaaaaatatttattacattaaaatataaagatatataaatattttatttttcaaaaagagtttttcacatttagtaggtcaaaaccagcccttacatttaataaaaaaaatataggaaactggcgttttatttatgtttttttttttataaaaaaattatggttgaaacaatataaaaaagaggaaaaaaattgcaaaaaattgagaggctgaagactccaagaaaagtgtgtgtgagcgaggtgcagaggaaggaaagaggaaaaacgtagaatggagaatcgtgggagaagtggaaggatcataaagttggcatgtcacgagttgcagttggcgggttataatcgtgagataactattccaaaaaagcgaataatctttcgattttggttaattaaaaaattaattatctgaatcaaaggaaccctaacctttgttcggatcagtatcatcattgtcacccctctttcccttctattattataatgctaatcataattaaataaaaataaaaatataatataacacattatggcgtttgggcatttgatgccgtgactgtaacagttttgccaaagcgtttccttggatggaaaagagaggtgaccgtgctgatgctgagcttcaacttgatgccgattttgtgccggttcctgtccaggttactctaaatattttcttaaagaaatgaaaccctgggtttgttttgatctgaataatcgtaatgtgactactaaattaattctgtgctttcttttcattcaagatcttgtttttattttttgtgggggtctgggtgtggcagtgccaataatctgtattttttaaccaattgattagaattagattactaatgttttagtatttagattaactggatagactaaagtaattattagttatcacaccatgccatcataaaaggaatacaaacatgtccagctctgaattttttactttgatggcatggcattgtagacatgtactggaaatgaaaagagtaacaaggactcccagattcctcagtccagacgacctaatttatcctcactgcaaataccagcatggtccctagatattgcattatctacttttgcaaagactgatggtcctttggtttcacgatcaagtcctggttccacaagaggactgcccccaaggccaaattcagccaaagtcaggtcttcaatgagaggtttacttcctcataggagcttcaagataaatacctgttcccaggatattgaaaggacaggtctcatagttcctaacactcccccatcagatgctcctttggacaaaccttccacttcaactcctctgtctcttaataatagggttatctccccattaacaaaagtttcacattcattaccagttactccatttgcaacttcaggtgtagagaatggacatggaagacatctaggacgtgattctgatttaagtgtatgtttccagtgttcattctagtttcaagaccaaaacaactacttttacactgtacttattattcacattttgtaagtgaaaaatggcacatgttgcttaatatatgccttttctttttgaacagacaatggaagttcatcagcatatgacacgatcattttcagtcccagttaatggcagagccactaatttaagggttacagattctaggggcttgattcgtgtaatttcggcaaaacgacatcttgaaactgttggtggaaagttaactgatggtgctttccttccagagattggtaattcctcaatatatggaatttacaaaattttcttctaaatgtcccttttaaacttcttgaacttgatcaacaatgtgcataatttgaaatgttctgtcattttgacaagcaacatgtatttattattgagttgagcactaaaccataaattaaatgaaattagcaacaataatatagaagaaagagaatagaggtttcctagagataatctaaagaaaaccctttcatttcattgcagtggactctccaaattaaataaagaaatgataatactgaatgaagtttatattgatgttaacttctaattttgattctcaattttgatcttagggttttagtttatggtttgtctttttctgagttaggattacttggtatttaaatagaaacaggttaaatagggactagaatttttcatagaatacataaattttttaatcagtatactgttctcattggcttgtattgtcttgttaaccgaatgcttaaatccctcctcctccccctcctttgtgtcttttcactctgttctttcctttccagccattgaagatgctactgaggatattccagaggaacaagcagtttgcaggatttgtttggtggagcttggggaaggagggaatacacttaagatggaatgcagttgtaaaggtgatcttgcacttgctcaccaagaatgtgcagtaaagtggtttagtattaagggaaacaggacctgtgatgtctgcaagcaggatgtccagaacctcccagtaacactgttgaaaatttataatcctcaaactcttgctaggcaggcatcaaatgtgccacaacagtcagaaatagtttattacaggtatgtttaattacttcaccgtgttagtcatctgtgttcaattaacacttaaactgacatagaggagacttaaagtgttatctatgatatgatattagggcaaccaggctggttataaaactatataaagtagtagatcttaactattttgggttgttaagtttaaaaagcttcagcttcagtttatttgcacatatgggtaggtggcactgtggcagtaagatgtgctcttgcctcttggtattgtttggcatcctttttgttccttttaaggaaaagaaagaatataaggaaaagattacaaagaatagatttccttctttcactttaccaaagaaaataagagagctatccaatccctttttatatccgtctaagcaacccccttggaagaatcgatgtgctgaactccaataagatgccatcagaacaataatgttctacatcaagttgaatgatatttaccttgaataaccaagcatctcttctccatcctaagacccaaatgacagtgtacaagacacctgtaaaactttaccctctgctcctgccaaattttttgaattaatctcaagaaactgttcctggttatgggggaaaatccaaggcccatcaaacacactgaaaagcctactccataagctattggctgatgggctgtctaatagacatgcagttgattctgattttgaacaacatatacatctgctttttttttttttttttggataaacgaagaatcatttaataaaaaaagacatgtcaaaacctagaggataataaataaatcctgaaaaactaaaccaaaaatgaaagggaataaagagaaaaactaagaacatgatacatgtaatgtaacacattacaatctctttgtatatctacctaagatacccctcctaaaaagacataaacatcacccttcttatgtctacaaaacctatgataaatcatcagccaatcactacttttctaattgtaatgtattctatctatttcatgcataacaggatctggcaggatgtaccagtacttatcttggtcagcatgcttgcgtacttttgttttctagagcaactactggtatgtttttctttgtatctgtgctgaagtttatggtaactggctaactgctgcttacatcaagttatgattttgggcttattgcatccaattgttacagtgccatctacatgagaaacttgcctctgaaagattattttgaccaatctgtagttgttagtatgtaattctgaaaatataacctcatctactgggagtatagcgattttctcagtttacagatgaaggattttattttattttatttagggcataagaacagggaacacatacttagggcccatttgttaaaagttattttaaaaaaaatatttttttaataaaataagcagtcttatgctttttttgtgtttctctaaattgctttttcttcaaaaaataaaaatagttttctgttttttgtaagaagcaaatcctatctgtatcttaaaaaggcaaaagataacttgttttaagtttaattagtgctgaaggagtgggaaaagtgctttataatttaggcagtttgtaggtccaaatttaaacaaatggctttctttgtattttattattttgttcaatttactcattaatttattcatggaatacatttttgtacctgtgttctggggaataaagggagatactatttctttgcctatttagtactagaaggccatgtttactaatactgtttatatgagagcccttggataatgctgtatatgcttcatttattttttctagttttgttttcctttgttaacaattaactgttagttgttagtttgttagtttttgttagtgggagggatttgaacccacaacctctccctccccccttctccctttaaccaccaagccaactttataactactgttttgtatgaaatataagtgtgtctgacacaatggtttctagtttaccaggtttcagatttgggacctcgtgctcttgccatttcattaccattctcctgtgttttaggtctcctttcatctatgattgcatcaaccatgggtaagctgttttcttctctctttcttaacatttgcacttttgatttcatttttattctggattttttttattttttattatgaggtataaaagtgaactatattcatgtataattgtcaaatttatggtaagttagagagatgttagcaatatgctctttatactcttttgaagacacttccttctattggatgatattcatgtaggcttcatctcctatttaatgagtcccattttttatttactaagactcgcgtgaattttaatacgtggtacaaagtgtattggaaagtgtgttgctggaattcatcaagtaggttattatgcacttgcaagctatggttacagataaggataacggtaaaaataatcatgaagtattaaaatggaatacatgcaatggaaattgacaaatattggactaacaagtaacaatgcattgtaattgacaaatattggactaataagtaagttcttataaaatctaaatcaaatgttttggcctccattggcctggaattattttttaatgtctctcctcactagacctgcaaatgtcattccttatgtgcgcttttcctaccaccaaaagaattgagataagttacaaggtctgtacacctcatttctctatttagaattaccctcattacgactgtaattactaagcgtctaactctagtttatcaaggaagaataagcattcttgtacccccaaaaaaatgggagaataagcatttttcaagtatttcttgcttgtttatatgagtttttcattttctttttttgaatataaactatattttaagtaaaagatttttatataataattatgtatgttttgtttttaaaaaactgttttactgcttttttcataggttgaaaatagcagcttatgaaaaatgcccccccaaaaacttatactgcagaatcatttttgtaagctttaacaaactgggaggatccagaacacagaagctttccctttaacatctgacgttttgacttccatttgcttttataacgggccagggttctataataatagtttttaagctaagggagaagccaacattgttaaataattttaatttaaagagcagtaggagccttagtgacaaaaatatcaaatggaaggtagtccaattaaaaggagtggatggagacctaagaaaactttataaaggttctagctctaaatggtgctgatccatatcctcctcttcctcctccctcctccctgagttttcttctgtaaagtcctgtggaaaaaagcattgatgttgttgtcctactgtgggtggatggctacagttcaaagttctctttagttaatgcatggttgttacccctgtactggatcttgatatgtgtaattaaatgtaaatcttggactttgatttcgaaccagattatgtgtgggttttggcaaattgggggatacagttaagtcaggtgagttaaaagaaacaaagtttgtttgggttttggcaaatgtagtatacggttaagtctgctgagttcaaaggaacaatttctatcagctgcaacatctgatttggtgtgtaatatctgatttaaaacgaataaagtggtgaaacaagttgacattgtcctattgtttctgacatgagaattcatgagaacaagacccatactctgtaattttcctgttcattttaagtttagtgagttcaaagaaacaatttctatcagccgcaacatctgatttggtgtgtaatgtctgatttaaaacaaataaatggtaaaagaagttgacattatcctaatgattctgacacgagaattgattagaacaaggcccatactctgtaatttacctgttcattagatcctctggagttgctataatcctatgctgtagactacatgatactggattattagtttctgattaacatgagtgatgttgttgtggtggcagtgagcaggagtttcgtatgggcttatgcttgcttccagtttgcaactcttatcctgttagctcatgtattttatactattgtaagatgatatagttcctatcctgacttcatgaagatacttggcactcggtgagagcaaaaatatatattttgacatttacctttttttcaattttgtagctcaattttaatgcaattctctccattctcctttcctcgttcactggatttgggattgccatcagtatgaattctctcgttatggaattcatcggatggagaactagcaggcaggttcaatcctcctttgaaaatgttaactggacagagcagcagcatcgtgagcatgtacaagaacaggtacaggaagatggaggacatcatcagcgacaaagacaacaagagaatcatctgccgcagcatggcaacagttgatgcgactgattcagggcagtcttcctcggttatgaagacttttgttctttttctttctttttttactaactttttacactaaaaacatgaggatttccacttgaaggtgtgaatcatgatatttgttaacatagttaaacgttacttttgtatgttatgctctttcctttcactgacaagcaatcccatcgactaattcaaccccattaatgaaaacaccctcaagttactaccggcgatttgttagagtgcatgaataaaaaggaaaagttgttacagtttaaggtgtcctagatagagtgcatgaatttcagttagccagttgcggtttaaatttataaaattgggaaatggaagggcaaaactatgagaaattgattccacatgcacgtagctatgacaaaaccatgcaatgtaatgcgaaggagagcccctaaataccctttccaaaagcaaaggagattaagaactgctagccattaatgtcccgcaatacatggaattatacaaacacaaatctgtggaagagatgaaaagaataattttcatctatgccaccatccttttaatggagggagtccttcttagcttctaaatcttacagatgcaggggagttgccggaaatatatataccgtagttcacttttagaataaggacaatggaaaaaccaatttagggaaatttagtcgcaatatctttaattcttattcaaagtgccaaactgcagttgaattatctaattacaagcacaaaaaatatgttgcagttccaacttaaccatttcttacaaagaaaataaccacatctcaacctttcagaggacaattcacttttgatatggcaaaatggtggataattggtgaagacaaaatcttgttagggcaaaggtttcacctagaactgcacaaagtcgagtaatgaaatgaagaaaagtgccttgctcttctttgattgtggaagtgataggtgacggatcatacaaaaagaagacagctgcagacatcaaacaaacaggaaatgataatcaaaacctatactcaaagaatatagccaactttaaacactagtataaaaccgacctagccagcttcgatcaaactcatttatgggccaaaaatattctgtaagtgagaagttggtatggagagtgagtattattaaagaaaataaaaaaataacgttttaattacataattactttaagaacaataataatttaacatatattatgaaaaaacttaaaagacgtgtcattaattgaaggaaacacatgattaactgaaaaagaataatggtataaaagttattttgtgtagaattaaattgtttttttggaacatatgtgaagatttaaatttattttatagaagtaggataatgctcttttaaattgcaatgcaagaaaacacgagtgaagtccaaattaaagcacagactatgatctaatgcttgatgacattagaaagaaaaaaatcccgtttttgaatgtactggtcctcttattaagcaagagggagggaaaacagttcagcatagcagggtgagctcatcagaggtataaatatatgttgcctcttttgatcaataagttgtgatgttggcctcttaagattagttcagaatctctgtcaaaaaaagattagttcagaatcaggggtcggcctctaggaaatggctttaactgaaaagacaaaatgcttaaaccatgtgcttgctttgaagattatgaagtaggccaaccaggtttggaattggaggtaagtatgaaaaggtgtgaacaccatttccaccagtgagtgttagttaggaatttatcatcgataaaggattacacttggggtgaatgcattctgcatgtacggatgtgcctgtgcctgtgcctttgcacagttgtatgtgattgatgctctttttaatcacttatggaacttgcgaaaaaaaaatttgcactggataatgtagtatccgcgtccatctcagagggattgggtgtttggtcctcatcttttactctttactcttccttcttcattttttcattttattttttaccattcatttttttattactatttacccttttctacttgtttttttacataattacatgaaaatgtcaacattcttttcaaaataaatcactttacagtcgtcaattggttaaaattcactttgctacatattcttatgtcccattggctcaaaacaatcttggcatattaggcctatgaactgaagcgcatgatttcttagatatatcttgctctttctgggtagaacaaccacacacgtcttcttaaaattaaaaaataaaaacatctcacacgtggcatgtgacacatgagaacaatctaagtgtgtagtactctttgatccggttagattttaagaaattaggtttctagttcaaatttatacaacttttcttattatacgagaaacgtgagatagataatgtgataaaaagaatttggaggaaaagagttgtaaaagatattgtagaaaaaagaaatataaatattataactctcagattgccttttttttttttttttttttaattttacgttgaaggctaattttgaaaaaatcagttaagaagttagttgaaagacgatcacagtcaatttgctggtcaattttcatcttgctgatgcaatagtcaatttttcaacaaataattggaagttttgtgcggaaaaactaattaaggaccctattagtgttgatggaattattaaatatatgcccgaaataattgaaataatatttaacatatttaattaaggtctcatcgaatagcttataataatccgtgctgatatgaaatagtacatagaagttactagtggaaaatgaccaacagagagatagataggcagctgattgaaagggtgttatatatataaattcatgtctttttgaaatgaattctatcacgtgaaagaaattagagagagcacgtagtataagagatgcataatgcaataagagtggttacacagagaaagtaaaaccaactaaagtcgaccaagtgaccaaatatccaatttgggtaattttgtactttagaagagcaaacaatgatagctgtcaacttaagaaggcacatgaaatacagattgagttagtaattgcattgaatgccgcgggtacgcaactgataagagctatagcttgctataaccataatgaatagttttgggcatgtgtaactcatttcccacatccccaaacatattttttcatctgtgtttgtatataacacccttcccgtaatcaactccctgtgttttttaattgagttctccaatattttcaaattaattgccatatcttttgttacccattacaaaatagttccatttttcatttttcaaattaatacatgaagagaaactgctatttggatcttcgtcttccgtcttcatcaccttcccatcgttcaatgcaagcaatctggactctttcttttcaatatttacgttatgactcccttcatttgtatatctcaggaattaagcaagtggaattcttcttacgttatttgctaattctccctccttttctgcaaaatttttgcaggaatgggacgttgaacatccacaataaacttgtagctattcttcataatggacgacgccaatgcatttttgacacagcagaacttcaggtatacgttatagtatcttccaatcttctatctttccattttaactcctttttaaaccatttttttttattgcattccaagaactgcagactcggtgaatgtttcctttaacttattttaaatgaataattacttattcttattaaaaactaagtaattatttattcaattttaagcgttaacaaacaagactgtacttgatagcataataaaattttgcatcattattctcttcatgcaattttatttatcttttaaaaggttattttataagatctaatcaaattattaaataaattcgattataagtataaaaaaatgtttatttcactatattgtttttattgaaataattaaaataatatatcttctataatttattactaaaaaagtaacggatgaattagttaatgaatgtaaattttttaattaagcaattcataaaactgaaataaggattaatagatataatgcctttttcttggtaaaaaaaatataactgtttttaattgtaatcttgtatcccttgaacattagttaagaatttaaaattattttttattttttattaaattttcctaattaaaaaataagtttatttaactgagttgtcctttcttgaaatactttatttccccttattgataccggtaaatttagagagagaaaataatacgtcaattttgaaggtatgaaagaatttcttgaaacattaaatagatgaaataaaagaagggattatgccttatctttttctccaaaactggaaatcagcatttagctcacaaaatgggagaagcaagcttgtgaatttaaaagaaattaataagataaaataattacacaattttgatggaaggaaataattattaaaattagatgggtcaaattaaattaacgcttataaaactaaataactaatagaaaatagattatgcattgatagtgtaaaatacaatcatctaattataattaatcatatatgataagtttgtttatatgataagtttgttgaattttataaaattatctaaaagattatatcaacgatggtaattttttgtgattagatggtctcacatcaccattaaactcatgatttaatactataaaaatatatatatgcaggcaagaatgataatatggttagcaagtcaagaaatggaggaaagcactaccggcttgcattctgaagcactattgatacatgtctcgccaggcctttccataaagaaatcaattcaaaatttcctccaggggagaaggaagaaaaggtctcaaagccacatctcccttgtaactcaaaatgacaaaaatatgaattaattaaatcctcattcatctatatctgcttgagtatggacctgtttgggtgtaaacttatctagaaatatttctagaaaaagaaaataagaagaaaaaaataaaatgaacttctccataagataaaatgagttttccattagttaatttgtatatgtcatcttatcttttaaagaaattatattgatgagtttctaaaaattagctaatggaagacttatttttatttatgaaaaattcatctaatttttttttagaagtattttttaaagaaacttatcaaaagatcttatatagaatactgtctgcaggtggtatggtgcatttcttgaatgaagaagggctgatctgtgaagacagctttgttaattgttggttattatgtatttctaattcattaaactccagcccaatacacgaatgagtatattagtagttttggtataacatgcataatatggatttgcaaatgctgaagactttaatgaagcggttataatatatgtatttgttatatgacatgaatgtgccaataagtcaaaccaccaagcacgccacgtcctctccctctgcagccaggttctggagcagagccaccctctttatcatctcattctcatcactaaattatttataatcgtataactaaactaaatgattaaatataaattaataattgtatgattaaaattaattagacatgtttcctccgtcagtatatggagttacggagttgacgcgatgaatttgaaggtgcatgtccttttcttgctagaacagctctttcttagtccttttgcaacgagctttattttaatttagaataattttatactatttcatggcattattttactgttttatttacgataagtattaagtttattttattttattagatataaaatactttacttttttatttagtggtttctttattaaataataggagaaattgtaggaaaatcagtaaaaagatataacactactcattaatttattttacttcacagttcaagttcaaaaaaatgtatgaatctcttcgtctatcccattttattgtgaaaatttgagtaatagaaaggagagatattggtaaaaaaaaaaaaggagataaacaaatgataaataatgtaataagaaaaaaaaaagaaataaagaaagaagaattttttaaatatttttattataatctcaactgtttaattataattaattattataaataattaacatttcattttcttctaaaaaaatatctcattttctaaagtacatgcacctttttaatcttcatatttgatggatatgtatgtaaagggatttaatactatcatctaatcatgaatcatcatatatattatatactaataattatttttgattgattaacaataaaaagaaaattttaacattaaaaaatacctattaattaaactcaacctttttatgagtgtcaaatttatgagttgtcataaattttcaaaatatgaagtgttgtgtttcttcatgaaaactgaattatttcatattgaagattgtattgtttcattgaaaatacaaatctattcgtaaagaataatttaaaaataaaagtgagttttcatatacgatatcaagtaaaaaagatgtgatttttcattaaatgaaaattacttcaaaaattataatttttttaaaatatacatcatttcatttgagaggtgtcacttttctttcaaaaagacgccacttgaaaaatatataattttcataaaaggttcaattcaacttttaatcccaaaatatatatagcaattgtatgattctttcatgttccaattgtactaaaattcatttgtcttacctttggttaatctcatagaaaacttacaccaaaaatagtataggtattactagcataataatattcacaattgaatttaagaaaacatgagtttcaggcaattttgtcaaaaaaaaaaaatacttaaaaaataatcagcataacaaatattttgttctttaataaaatcaaattattttgtttttaattagaattttctttttatcatatttttgtattatatatatatatatatatatgtattatcagtaaaatattaatttttaattgttagtttttattatcgagaggaatcgaatccacaatctatttgttcctctctacatcttttatcactaagttaaccttttatatatatatccaataaaaaaaattataattcaaaaaaaaatgaaaacaaaattatcattttgtaaacatcattattatctgccttgagttttgaaaaggcaaaaaaactcaagtgttttcattgtatcatgaagaaattttgtggtcaaaccctagttgcattcaagtcttgacattggtgagggaaattaaattgtgcacatattccttttactacttcatcttcccctacttttcatagatctgattcatctgatgtcaacattttttgtgtctgacatgctaatatgtccaaggtggactgttgattatggactagccactcctccgctgatcaattaatatccaaaatctgtttagtttgcctgatgctctgatgagactaaaccattaaaaatgggtgaatatatacttgtacaaagaacactttgacacaatgatactcgagttagtatgaattttaccaaggtaatgatatatattaaatgtattcaattaccacttttcctgatacattaacattaattgctagtatttatagaagttaagttgggttggattctctatcggattagaaattcaaagcctcttaaaggtaagactctctatcttgaaataacttttctttatattgaagtgtaatctatttatttacgaatttatcgtaaacacatgcatctaaaattttagggtgaaatattctaaaatgagatgactctgtgtgcgcttaacagaggctaacacacacttaattgcgtgggtcctccttaattagacagtggctgcggactgcggaggcactccttctgtggctcctgccacgtcacatccctgctctccgcctcctcttttgaagtctccaccccaaccctaatagagcactttggcatactctctcactttacgcccttttggttcaacaatatttagcatgcatgttaagtgcaagtcttttttttttttatatatacaaaataataatacgtggctcaaaaattgctaattaacttggtaattttgttctaacatgccttaaaaaaaccccaaattattttataatatgttttggaagagccttttttaatatatagtaaaaaagtttttaaaaatgtctctatttggtctatcatccctttcttaagaatggtttactttgtataacaatgttaatgataaagtggagagtgaatataaattgattaatttggtattttggtcatcataaaaggagaagtaatcgagtaaatagttgttaactttgtgtatgttttgccaaatacttttagtaaatttttaaccttttttttaattatttgaaaattttgtctaaatttattaacaatgttttataaacaaacttattttaatagtttataacattttttatactttacttcaaataacgttttttaaaatactaacttctaatttttatattttatttatatttttatccataaaatatttattaaatttctttattatctttttttaggtaagacataattttattagtttttggtttctcttatactatttatttaaaccattactaaaaaaaaccattaaactaattacatgatttattgtatgattttaacactatatttcgaaatattttaactagtccactaattaacataatgaaaatatggcatctacttaagagtatgttattttattttattttatacttggtttggaacattttaagataaaatctaagattaataataaaatacataatgaaattatgtataataattaaaactaaaaaattataattagaataattaatctataaataaaaattgcaaaactttaaaatcaattaaaaaataaaattataattatcctaaaatatatttgatcaataaattaaaattaaactttgtataaaaatatcatataaacatgtttgttattatcattttatatttataaattatttgaacaattaattttaccaattgttgatctagaatgtaagtgttttgtttaattgttttaagtttaaaatcctcaagtaatgtgcatataagtcttccgttccaaaataaatatcgtatttgaaaagaaaaaaatcaaaataagtgttgcatttatcttttcaatatgatattaattatttttttattgataatcctaataaatatcactttagttttgcaatgcaatattaacattaaggttaattttgtaaaattactattatctttcatttatttattaatttttcttgatttacaaaaaaaaaaaaaacctaaaatgacacttattttagaaataagaaagtaattttttttgaacaatatagatataaaatttaagatacattatttgatgatactacaatgacgtcgcattaaatcaaaagtaaataatgtacccaaaaatcaatgtaccaaaaaattctaataaaaaacattaatatttacgttgagtctattggtttggagcaacttcatcaaccaaaaaaaaagaatggaaaccaaattcatcaaccaaaaaacaaaccaattccttcttgatgaacttggtttccctctctccgcctaatctaatttattttgattagttcatttttctcttccttaaaactgaatcaaccaatctgtaaacactcggaacttagatgaggttatatccttgttggcatgtacccactttaggaaaagtaatgagaattgacatttgtttaaaaacctacatggcaaaatcaattgatataatctgaaaccattaaaacagtttttttcctgtatagataagttatttaatatgaaagataatcttactcgacctaaatagaattatgaacaacaaaatttcacttctaactctaaatatttaacacaattaaatattcaaaatgtgaatttaataccattgattaatctagaacaattctatgttagttaatggtaaaacattttccctttgaactggtttacctttatggaatattagaaaatggggtctaagtgtttatgataaaggatatactaagttaattaagacagcatctaaaattctcaacttatactactatttcaaacccataaaattttctaacgtttatgttatctttgtacaatagacgctagacgaagcacgagtaactttgaaagtaggagtagcttttggtatgatataggctaaagtaacggaagctgtcctaaactaaaaggatccaagggaatatcaaaccaaaccccaaaggtaatgagagaaacaaaaatttataatttacatttctataaactggacaaaagtattttaaatatctctaaagatcaaaatagagcgctggattaaaaatcgtgcatgctgcctactgctatggccgatgggcatgggccggtactttgtattcaggattttaccaatcattgaaaaataaaccgaattatgcaggcatcacataatgtcatgaacaccatggccttgaccagtgaagagttagaataacctcaataaacacctgtttgacagtaagtaacccagtaggcatcaaccaatcaatttcattaacaatggaaaaattaccggtattccttcccaatttagagtgcacaagcacagttttcaagttgtaaccgattcctataagatggtgaaataaaaatgcatgtgccatctactccaccacttttgtatttctctgacacattttaaactcattcaaacgttagttttgcttcccagctcaacctttatacagaacttgacaccctcaaattagcccactgcataaaactatgatcctcttgctcctctttgcctcttctcttccaatgcagctgcctcatttaacatatcagccgcatccttgtgcatgtccagttttgcaagagcaactgattgcatgtagaaagccgtgggccagtctggataaacgcactgtgcttgcattgcatctcgtagtgcaggatctggttgatcacataacagatagcatagactgcgccttgcaaacacagttggggagaccatcgttccaacatcaataaactgcatgaataacaatgcagaagcatctcaaaataattagcgtgcacatagcaaagctacaataatttacaatgtcaaacaagtgcagaattgcacctgggaatagttatcaatggctgtcctaaagtccttgtcacggaatgcatagtctccacgcttccttgcttccagcatatctctcatctgttgagtccactcttgaaacgacaactgaaccaatccaaattcaaaccttatggcacatcatccaattaaaaatagaaaatttaaaaccaatgcacccatcagttacctcattagttccttcatcgtccctgtagtgtgtcgcaaccaagatctgatgtattgcagttaggtccattcttgaacaagcctcacccattgctgaaagaggacgttgtggggttgatggagcttcctcatgctttggaattccaagcatgatatgagaacgaacctgaagcacataataatagtcaactagaattgtttctgctttaatcccatttatatgtctaaattgccatttaacaaggataatttccatatcaagtgacagaagatgttggaattgctatagctcaatatatatctttaatcccttctctagttttctacactgagaaatacatgataagacaaggaagacaataaaaatacttgcatgcatgacaaattgaaaaaagtatacaaaaagcatggaagaactttctttagtcacgttcagccttgcatagatagaactagtttggcttgtgccctatttttatcatactgcttaaaagattcttgtaagatatgcatgaatgcaaagttaaaatttatagatagataactaaattttatccgatggctatataaagttcaaaaccttcaatgtacatgcatgaaaatcatatcatatagtttaagatttttcaaactgcaagtaaatgcaaacttaaaagtaacaccgggctcagccctaaagtcattcaaccaggtgtatgaccaaaagctcaaaatttgaaatcatgcgagtctaacaattgggttatccttatccaactgaatgtctttatataatgcataaatgcaatacaattaagagtctacataaatagttttatattcacaaattaaaatgcttacatagagggcgagccttgaacaactataacattgttgtcttactttgaagtcacattcaaatccaagaaataacctctctccactcacaggggtaaggcagcctgatacatctaccctccctaaactccattaggttggagccttgtgtactagattgtcctacatttaaaatgcttgaaaaatatgaattaaaatttgtttattgttggaaaaccgccttaattgcaattacccttagcttgccttaattgcagcctcttcagagtctccttaattgtagatgtgaaagggtgtgtttagtcccacatcacctagaaatatagcttctaaatagaggttataaagtttgagcaatactcaccttacaaggcgattttgtggggttgacctagacccaaattctaatcaagtatcaaagtctaacctagatttgttattgggccacccatatttctctatgctctagatgttatccctggtcgtgagggagtgttcttattctaagatgttaataatttatccttgattcattgtcgagccacctgccttgtcatgctttaggccaccatgagcatgaggatttgggggttgccttaatagcaacctggaggaggtgtgtttagtttcacatcacctagagaagtgacttataaagcttaagcaattcacaccagttttgtggagttgagttaggccttgagcctaaattctaaaatgacattaaagtccatcaaagattcgttattaggccacccatgtttctttatggtctagatgtatgttcttaggcatgaagagatgttgttattgggacatgcgagtgaggggagagttaagatcctacatcaactagagaatagccaatgtagtactcttaagcttgggcagtcctcaccttacaagatgttttcttctttttttgaaaatcttacaagctggtttttaaaagtcaattttgtagaattgagttaaaccttaagcccaaattctaagatggtgtcaaagcttatcttaaattcatttttggttaattgcagtctcaaggggtgtgtttggtccaacattacctagagatatggattaatagagcttatatggcatcaacaatcctcaccttacaagttggttttgtggggttgagttagaccctaatcctaaattttaagatgatcttaaaacatgtcctagatcatttattaggccatttttgtttgtctatgttctagatttctattcccaggggtgaggcggtgttgtcattggatcatgggcgcaaggagtgtgttaagatttcacattgactggagataaggtcaatgtagtccttacaaggcctgaacagtcgtcaacttacaagatggttttttaaagtcaattttgtaggttgagttagttcctaagcttaaattctaagatctcacatcaactagaaatacggccaatgttatccttataaggcttggacaatcctcaacttagaagctggttttttaaaagccggttttgtggggttaagttagaccctaaatcctaagaactagctatagataaaaagtcttgactatgctctttataagcttaaataaagcttataaagcttgagcaatctcactttacaggccatttttgtggggttgagttaggccctaagcctaaattttaagatggtattagagctaaacctaaatccattattgggtcattcgtatttgtctacattctagatgcctattcctaggcatgaagggccgttactgggtcatgggcgcattaagatcccacattgacttgagatataaccaatgtagttcttataaggcatggacaatcgtcaccttacaaattgaatttttaaagtcagctttgtggaattgagatagaccctaagcccaaattcaatgatcccaaaaatctatcctagattcgtggttgggcctcccacattaccatgttccgagcctatatagccttgagagagaagaagaggaggagggggggggggggggggggggttaagaaagccttcttaattgcaacctcctggggagttggctaaactacagcctcaatggagtgtgtttagcccaacatcacctagagatacgacttaaatagagcatataaagcttgagcaatccgcaccttataagtcaatttgtaggattgagttacactctaagcctaacccaaattttaatgtgatatcaaagcttatcctagatcctttattgagccacccgtatttgtctatgctctagatggttattcctaggcatgagagggtattgttattgggttgtgaggcaaaaggtgttaaaatctaacatcaatttggtttttttcaagctaattttatagggtagagtcgggctctaagcccaaattccaagatggtagcaaagcctatccaaaattcattgttgggccacccaattgcaacatctaggcccataaccttaggtgtgagagggtgtgctggaaagtcaccttaattgctgtcactcctattaatgtggcctttttgacctgccttagagatgtgacttaactagaacttcaaaaggcagtcctcactttacaagctgattttatggggttgagttagaccataaatctaaattctaatatggtatcaaggtcaatcctacatccgttattgggtcaccagtatttgtctatgctctagatgtctattcctaggcatgaaggtgtgttaagatctcacatcaactaaatatatgaccaatgtagtctttcgaaggctttggcaatcctcaacttagaagccactttaataccaattttgtgggggctgaattatgccctaagctcaaattctaagaactggctatagattttaaaaataaaataaaataagtcttgactaagctctttgagatagatgtacacaaagaacagattccttgaaggtcatatgcctatatttctagacaatatcacatcatgaaaattactaaaatttcttctatcctttacaagtaataaactaacagtagtacacacaagatttattttggggtgaatgaagtttattaatgtaactctgaaacaaggaccaaaccagcaaagatgactaattctttgctaactagaattcacaagtcagctagaaccataaaccaattactttggctgtttgagaacttgacatatcaaacatcttttaaccttacttatacagaaaacccttataatattatatcatctcaagcaagtggaaaagtttacggactaaagaaaccctagagtcaaaatgaacttttgcaaataacccaggttcaactaaattttctccaaagacaatttaaaatgttccagcctaatatttgaattaccatgttttatgtaagttgaggatggtgagctaagcgaccccaaccatgtagattccattttgaaatgagtgaccaaagaaacaaatatgaaatataaaaagtcatagaattttaatattagacattaacatccaacataaatttttgtgtaggtgataatggaatatttgatagggctgttgaaacaacaaagttccagtaaatcatatgttccattattaagttagagaaggggtctgtacttcgggttttgtatgcaacggggcaagtgttgtgaccaaatcctttgtatcaggccgctcccttggttcatattgcaaacatttagaggcaagattaacaactaccgttgcctcttctgttgaaaacttcccctctaaatgtgaatccattaagagcatattgtttttcccctgtatcatatcaagtgcctgcaaacacaatcagataactccatatggcaccaaccaagaagaaaactaattgaacacgtgagcatatggaaaatgaattgacgttaaatttaaataaataactatcatagcatcatcaacttccattattaagtatttaagtatttaatcaaagagaaaggtttccataccttaagttgtcattcgtataagatcatgtttcatttattgaacaataacgtaatatcatttgaggtacagtcacaacttcaatgcgacaaaataaatagtgtcataacaagcacttattaacacaataatagtcaagatggaaaaacactgaaagtgagaattgcatgttaagattaaaatagcttgattaaaaacatagaggtatttacagcttttagtgatatgtggaatcagaagagaggggcaggtaaaggatagaaggcagttacatgactgggagggatgtgcttgccactgaggaggtctagaagaacggttccaaagctgtaaatgacactttcaggcgtgacccttcctgtaacaaaagaaatatgattgagagaagtattgttatacataaaaaagtaaaaaagaaaatgtgaagaagggagttagttaccgtttcttaaatattcaggaggtgtgtaagcaagattggtgctataactcttgccatccctgctgttcttcataaaaccaaagcaagagagacggggatcaccttgctggtcgaagagaacacggtaagcattcaagtcatggtacaagggccgcccctcagaactgcaataatgcaaagcctgtgcgatgtacagagccactcgcaaacgcatggcccactcaatagtctgagtttcccctgaatcaatgaaccaatgaatgaatgaacagatgagataaacactagtacagataacaaacagataagttacacatacagtggaagagatgcttggcaagagtatcattaggcatgtactcggcaacgagaagcctctcatcgccgtcgcagcagtaaccgatcaaattagcgagccgtggatggcgcaagttgccgacgccggaagcctcttcgacgaattgcttgggatccggccaagcagccttgctgaacttcttcacagcaatccaacggctctggttctggaggcgacccttgtacaccaggttgggtgccttctccccactctctgacacgatatactcggagctgaaattgttggtggccgccttcagctccgccagcgagaactccgagaacgagaaatccaccccctctctctcgccctcagactgcctctggtgggttccgtacgcttgctctttttccttttccctctccttctccttctccttctcctgatcagggtgagtctccctctctcccactctcagcaacatcgatgattggcaacaacccatcctctctctctctctcttcaacaattatcaccgatcatgaatgagatctccacagactctatactcttctactcttgtgttcgcgtgatttgcctttttggcaatttttttagtttccttgtttctatgctatgcttcacttcccttcccttccttcaccctcactgttgctaattactaatcactgtttacttattacaatccagcactcattaatattctattaaatctatttccaacttcttcatatgctcttcctcaatattacctttttatccatactttctttaactacaaccctatcttacttattctgcttctcttcagtcttcacctacccaaatcaatgcttcccattcttgttactattttaccttcttttttatttttatatattcaccactttttttgttacggaaaagtaaaatcttccctgacttcctacctggtttttccgacacattacaaatatcttccaactctagctagctccaccaatgataccttgccgactaatatatctcaacctagacacgtcaagtcaagataaacatcatatgggttcaatttatatcacacaaagttatttttgttttctttgttttgcttaatcttttcattttaatttggcttttctgttttaaaaattgtatgattttaaaaattaattttaattaaattcttaattttatctatcttttatttattttattttgatttaattaaatcttaaatttaacatatttgtttaaaatatcattaaaaataatttaattaattataatgtaagaaataaaatacaaataaaattaaagatgagattaaaattgcatatttctaaaaaatatgaggataaaattataaatttttaaaataaaatgatcaaatatttttattttaaaataaataatcaaaattgtgaattgaataaaatagaaaaatcaaaattacatttaaatctaatttttatctaataaattttatatattaaaataacttattgttgttttggtacatttttatctaataaatcatatgtgttgaaatattaaaaggcttggtttgttatggctgaaagttgttctttctagtataaatctgattccttaccttttcacttgcctaaagttgagaatctgaaaccaaaaaagaataatctgattggagggaagcttctgcgcagatccgtttaattaagttctcaatgctgcattttaagacttgtctctccctttcgtgaaatgttttctccattaccattgatcacgtgccgggatgcatattctaatcaagtcaaagtttttccttttcctttttaaggtgagagttcgtgctgcataacataggtatgaaataagaagtgaccgccaaacataattataatatataattttggttaattccccccccccaatatatcattcgatatgttgctttcttttttcatattcaattcggtcatctaatttttaaaattgatttgatttagtaatctaattttgtttttgttcagtttaattttctaattcgtaaaattagtttaattcgatcatgttgtttaaattaacttgagtgattctttcatttaaatttgatcttagtgtctaaatatatattttatgacggtgtaaaattatcattaaatgattttgagcagttacaatgtaattttttaataccgttgactcaatttagacacagtagaatcaaaataaatcaattttaaaaagaacaaattaaatctcaaaaaattaaaaaatcaaatcaaacttaaaaaatcaattagaaaaccaacaaactaatttaacttatgattttatttgccctactcatttctaatgtttatcatacaacatggaatcctacaaatcgagtttttttttttcaaaagagaacatttttttctttattaccatttgggagtcgattttcaataattatccaaaaaagtattattttttaaaatttatgactttaaaatcgtatcaatttttttttacttttttgaattgaagtcgtaatattatttattattttcaattcataatttttaaaaaatggtaatatttgaaaaaaaattacaacttgaaagttgtaaaaaacattatcactttcaagtcatagttcttaaaaaaaattgaagtagtaaataatattacaacttcaattttttaaatattaatacgactttaaaatcgtaaattttaaaaaataattaaactaaagtgtaaactcatttatgacttctactaaaaaattaaaatttgtaacatctattacgatttatccccttttagataattatttaaaattgaccctccaaatggtaataaagaaaaaaaaatgttcccttttaggaaaaaagcctacaatggatgacacattttcttacattttacaccaactttcgtacgtttacttggagtgttgttaatacaacaatttccattaaacattagtcaaaattatatttatacaatacatttatatcatataattaaaaaagaaaaataaaattataaaatatatttcataaataatgtaacgtatgcatgttataatcaattattacatatgataagcagttaacaatgtctgctagccaaaatttccctattcaaattcaataataaccaataacatctttgtgcagcttttgttaaatgacaatgtaccacgcaacgcaagaatcacatttcaatttcgtaacaagggctgaaaaggacaacaataaaataaaaatcttgcacgtaagcagtaagcccccctccttgtacggatatatgaaaaaaaataatgcaattaagtaatacaattttacagacaaaatattattaccgtatgtcaataattgaagtaaaaaacatcatatgggaataattcagttccgtagggtggcacaaagattagcagcactgacaatccaatccctcgaaaacacctctgcaccttcttattataggcgaacaaaatgcaaagttcattaacacctcacaatagcaagcgccaaaaagttggattataaatggaaaatgatgagagatgagagtacaccatatgatatttgacagagagacaaaaaaggatcaaaaacattataagtactatagatgatataatataatagaatgaaaaatagaagaaaaaaatatataaatgttaatagagttaatgtgcaaggtggagtgatttgcaaaggattccatgttgtgtaataaacttttctcttttcatttgcacattaatcttataggtcaaacttaagtttctaaattgattttggagatattaattaaacataatttcaaaatcattttacttttaaggttaaaatatatttgtaaacctaataaatacctgaattttgtatttgttttttgataactttttttcttcattaaatctctaataagataatcattttatttttgattcttaacactttttttagtcatgataaattagtaaattttgtatttgttcatttgctaatttatcataaactaaaaaaagtgtcaaggataaaaataaaattattattttatctgaaagtaaaaatgaagaaaaaatttattaaggagtaaacaaaaaatttagatatttattagagatcacaaatatattttagcttacttttaaacatatttttggaccctcccaccaaaaattctaatataccctaaatgcatgtttggtttgtagttgaaattgttgtgttatacatttcaatgtaggtccaaaggataaaaataaaatgaaagaaaacgtaaagatcttgatccttttgtaaaagtatttttccctcaaaaataattttttagctgattttcaacatgctctaaataaattacttcaacatgacttatttttttagctgattttcaaccatgctctaataaataactagattataagtgaatattataattatgaccacaattagttataatttgatataacttgttattgtttttaaaatatagatatataacagattatgaataaactaattgcataatcaactatttaacaagttatatttaaaatcaattacataaccggttgaatgaataaaaataagttatttaaaataatcatttctataaaactagttatagttttatagatttataattataactattttttcaataaaaataaccgtaactataaaattagttataactacttgtatgattatttttttaaaactggttattttgagcagccttggtgaagaggttggttcactttgagagctcttggagtctggtttggccagcccgttccaatctccgttgtctatcttatcatgaacaatagttggtcacggaagagcccaccaccacttatgtcagatttaagttgctttgcatttaataacggagttctgttttcattctttgaacagttctcagcaatttattccagttgaggaacaaatggctataagaaatattttattctaaatgctttttcatcaagcctgctcagtgttaataggtaatctgtacaataatttaacttaaaaacgaatgtttttatacaggaaccaataacacccatgcattcagtgacgtgcgttactccactccgttgcgaacgagacttgttccaattttactgcttcaatttgagcaatgaacaccttctagcacacgacttgccagttgcaggggttctatacctgaaagtccgtccttctccttcatttctattttctaatgcagaaagaagaaccatttagatgttataatttgtgggctcccctgtcttttagcagcacaactccacttgtagccttatagcactgaatacccaaaaagcaaccgtgcgcctcatacctcacacttatcttttcgtttgacaataaattccactgtcccatcccagcagtatcttcagctccaatgcagttagcttagcgtagtgagaaatcaaacccaacccctcctcccaagactctgttgtaaagaatagttagtagagggagatcagctagtttctattctcggtaaatggcaaagataatatgattccaacttccatcagctacaccaccctatgaaactctctcatgattttgggcagcactttcttcttcgctccgttgtagcaactcctcataagctctcacagattcgtcagtaaatctctccatggcctcaaaaatgcactgcaagctagcctgtagactactgcttttgtcactctgatatatgatattctcagaaactgaaagacctttaccttctccagataccagaaccacctttcgctctaatgcttgaatttgcttctgcagcttctggtcatctctatccatatttctcacttttctctcaagatccttgttcttcatcacctgcctatgcatttctagcttatcttgttcccatatctgaagcacactcatggtaaatacatgcatggaatcaacaacttccttttcagatattctatccaaagcttgggaccactgattacatattacaaatatttgcggagccccaatcctaccaggggaaaatgggactatgccgtctggtgtttcttcaggttcatacaggagacatttcagcagccaattattcaatgctctaacataacctttttgggcacttatccagccagagaattggaatgtccaattgataagctcttgttcgagctgcttggttgcctggagatgactatcaccgctcttcttcctggatccaatggaacccagtattctggcttctctaattgcttcacactgatcatgatgacattcaagcatggatttccacattctggtcaacctgaaaataagcttatctcatattataccatatatacatcgagacacccaaacaattctcaggtgataattacattacaatgagaaaaggcaaaacatttatccaatactatgtatgaatggatatctcacatgcatgtcttatcccaaaggacagagaaaaaaattagcaacttcaaaagaaaatgagaacattaattcaaccatacaaacttaagaagaataaaaaagcgcatgggtgacaacatcacagcatgtctggaacggaaaactggatggagaatactgaattcaagtgctcaatccacttgcacaaggataaacaggatatattttaaggtttttagttcctcttgtagattggagagtaataatttcttggaaaagctcttgcgtggttgcatcatctcccctgtaaaggatgattattcctctggctgacaactcgagcacaacattatccacaaattggacagataaaccaccaaattgatcatatggttggaagttataaacatacatcagagtaaatagcaggatttatcaaaattatcagaaatggtcttagaagatggccaagtatttgcttctttctatcagcactatgtgtagattgcaggtggatttgttggatttcgtcaggatatatacatttcaccatggttatcaaagaattctgggaaattgtgcatcaatatttcagttcatttcatagggttgaaatatagaggagatgattcctatggaatggaatctcaataacaaaataaccccttccattcaatctttgtctaatgttgtagagcacataattagttcagttactggaagccaatacaaacagctaaaagtggaaagtgccactgaacaggcagaaaatgcttgactgactcgttataagatgatctacacattttgcatgaggtcattctatctcacctcaatgataatagacaagcacctaaaatagaagcacatcaaatcaaattttgtgtagaaaacacatgaccctaaacctttttcacatatttatgatccattgggaatataatgaaaaaatccaatccattcctgatccatttaattaaaaccatccaacccatcaattaataaaaaaaattagggacgtatatccaacccacccatttaaaagtatgttatattttatggatcacatggtgatggaaaggaagaagaaattggctttcaatactaataggaagaaacaccacttgttccatttttaatggatttttttttggggggggggggggggggggtgggggggatggaaggattggattggattggagcatagatatgggattatttgccatccctacatacagagttgcccatcatgaacagagagacatttaggacttgaacaaataacaaaaatggttagtttttaacatcacatacccctggattaattccttcagctgtggccacagttcttcatcccttatcttatttatagtcatagaaatcttatcaaccacctgaattgccattctaatttttgtggacagattcctaatcaaagttcgagttgaatcaactttatgaaaatcagaacccctatcatccaaacgcttcaacctgcgacacttcctatcgtgcatgacccgcatcttttcctctgcctgcaaacaaatgaacgtgcgaaaaaaatgttggaaaatattttcctataatttaaaatttaaaataaataattttctttttctcaatcagttttttctaaagataaaaactattctctatctatttattcctatcttttagaaattgtgtttgactaagtttttagtctttttatctgttggaggcgttttgcacgttattgagatttgtagttatgtttgttactggtttgttagttgtgatacttgggctgcacatttggtggttattttccccccttatatatagcttcctcttatggaaaaataaggagaacgtataggcacacacctacagcaaaataccatttgcctatttctcctttttataaaattacattatattactacaactatatgttttggagcatggtgttctttggttcgggatcctttcgccatactcgattggattaatgggttgtcgtatcttgggagaggagcgcatgcatattaatttattgtaccagtgtagtgggggaatttttctctataaggatagcgcatagtgcacttcaatctaggctcttttaaactcttctactattaaattttaagctttgtattaattgattattataaactttgtatgtgttatgattctatttgaacttattctactgctatacttattgtttatggcttcctaattatttatctaacaaaaaagctatttggaaacctgtaaacactggttaacaatgtttcacttatggcataaaagacttctgagcagttgatatcactcaaattatcagcacaggttggttacattagaacatacaagagctgatgcgaaagcagcaggattaaattgcctcacggagatgaaaagtggaaaaactgaaagcaatggaatgagattggtgaattaagatccataccttaacttcattaaagagtttcttctcccaaagaaggagcttctgaagcgtagaggaaagattgcgtgccccggttgttagatcaacattaaaatccatgttagcagcggaggcggattcagcatctttggaagtagaaggttgggaggagacaagggacaaagagggagcaacaacatgtaacatcttggaagaagctggtagacaggacgtgatcaggtaaaggtaagtgaggagcgaaatgtgaataatgaatagagagaaatgctgttaatgttaccttgataagctgcgtgctttcgattgtggggaagcttgccgacctcaaggatcttggcgatttgggcaccagaatcggaagccctctgaaatagaatctgaatctctttagcaacctcaattggattccgggaaccaggtcgccgggtacggaatgcggcgtgctccttggtcttgttcccatcattattatctccaccaaccactttcttatccaccacgtgcacctcatattctacctcctcttcgtcctcatcatcatcatcatcatcatcatgaatatcatgatcatcatatacgtcgtggtgggaggagggtgggggttcgtgcttaggaggctggacgagcttctgatccccatggacctgcttgacaacttcgtggtggtaatcctcgtcttccaaatcggggatcccctcctcctctcgaacctccctggaatcgcggctgggggtggccgtggcagggtaatgagtttggggatagtacttgtcgtcgctgttatcgaagaagttgaggaagtcccaggtggaggagcgaggaggggagggcggaggcgggggtggcttggaaacggcctggcgctgcggcgaggaagaaagtccggccgaatagggatcgtaggtgtaggggtaagggggatactggtaagggtagaaggaggaagaggaggactctccaacgtacatggtttggggactcatagggcgctgctcgtagacaattgaaggagcggctttattcttcatgtaattcatatgaagatggggatggggatgatctggtcctgagtagtaagcacctaaacgaataggagaggatggttcaggggaatgatggagggagggaaggtcgtcggagtcggagtggaagtggaggtgggagccggcggagtcggagtgagaaggagaggagtgtttggtggttttgtgagggggagaaggggagggagagggaggagcatcggttgttgttagcatgtcttgctgaatgaaaaggtttaaggagtgaccaattgccttgagggagttgatgtaggcgatgtgagctgcggccagtgcgtagcgctggtgaattgcttcgtccaggaaaccacaccgctcccggcaaagggccactgctgggagatcgtccagcttggagctggcacaccccatggctctttccttttccttttccctttcccttttagggtttctaattgtaaccaaaattgctatttaacaccacagccacagggaagaaagaaagagagagcagtagcaactatgaagcggggcagtacagtagagttactgggcaggcaggcaccaacataaaacaaccagttagtgaatgaatcagggaatcttttgccagcacggacttcttcgtccgtttcttttttttttattactctctctctctccttctgcctcgtcggtgttctctctcacttttatctttcttcaacttaatttaaacttttatttcattttaggcttcacccttctttcttattatacagttatatcaaatattttattttctattttcattttcattttcaactctatttatatactagtgtttctctcaattcatcacagtttcctcgtgtttaattaagagtgaaatttggaacataacatctgatatcatccgcgaaaaacacctaacatacatattcccactttggaagcttcaaaatttgacctttgacgcctgcctccgctctaatttatttccttttccggttatgccccttcctcctttcggttacaacttacaaccatctgctttcttattatattaaattcctcctactaggaatatcgtcgcctccttcaattctttcagctttatccgaactactacattacaattttgtttcctttttctactaaaacacgtaatttcaattcaaaaatactacaccatcttatcctctcacaattgctatatactttttaatgatactttcttaatagtattttattctaccgtatgagataatactttttatataattaaaatttatagtagtatataaatattaattcatatataatttatattttaaatttataataaaccatttaaattatgatatatattaatataaacaaaagaatgatattataatattgttgaaaaaatattttaaataactgtaaaatcaaaagtttcagttatgtattttaatttatattattgtttcatattttccctccaaatattaaatgaacaaggaactttaacattttaaaaacataaaaatattcaatgccttttcaaagtaataaacaaaagtatttaaaacaatataaatgtcatgttgccctagacgcagaaactaatgaaactatcccgctcaatcatctgtttctaataaaataccaaagaattgtccacatatggatgtgtttacggcaaacgtatcatggaatgaattgcttctatttttttgttgatgttaaagtcagatatgtagaatattcttttttcaagaattaatcctttgaaaggtcaaaaattatttaaagggctcatttatctcgataatttttttttagtttagtgaaaatgaattaatatcacgtgtcacccaatattcattcacaccaaataattcaattaaattttatattattctatttccaataaaatcttaaatccattaaatcaattgtagaatcttaaattagttataatacataaaaaccaatagtgtaaaatggaatattcagattttatatttattttattttttaaaattttatatagtaaatataaaaattgtgtaaattgatatgatatttttatttcattttattttatgagttgatattacatgacacgtcatattcattcacacaaaataatttaattaagtagattttatattattttattacttatagaattttaaattaattataatatataaggatcaatcttgtaaattgaaatattctaattttatatttattctattttttcaattatatagtaaatataagaactgcctaaattgatatgatatattttttgttaataagagtaaaaatgtaaaaatatagaaatttgttctattataaaatatacgtgtaaaatttaaatgattctattagtaataatgattaaggataattttaattgattcgtacaaataaaatttatataataaaatttaaatcaattcacacaggtatattttactattataagacatacacattcacaattttaattggttgttcaatacaaaaatttaaatcaacattaatttattttagatatatatttactgaatattatgtactatatatttatttataattttaaatgctttaaattcatcacagtttattttaatattttaaacaaatataaaaggacaattaattgattgtccaatataatttaatttgagttaattaaggtaattacaactaatataggaagcattttttgcatttttatttcattaggattctttctatgcttatatataccaacatattaaaattaaaggtcttccatacggttattttctttgattgttaatacggttattttctttgattgttttccttcgatttgcttaagataacatatcgcgaagctctcattgataatataatgtgatatttcttattttatgttaaacatgccaactctttttcttttgacttttaatgacttaaatttcttatatattaaaccagattccacatttgttcgcctaattaattaacgttatgaataactttttctcccataagcaaaaaagttctccaaactccccctcctctgttgccacacttttcctgagtattgtttgttgttggaatattcaagtcttaatactataatattgtattaccacttgttctaaaagtgtaataaggtcacaacttcaataaaaaaaaaaaaaaaaaagtcaaacaattttgctcagcagaagattacttaactgaatcaacctcttgcactgaccagctacacaacttgtatgacaatttttaagaataattgtcgcctaagtattactcctttaaatcacaaagccacgattgtcaatcatgcggccggcctctgtaaacataagccttacatacaaaactatgtattttgcaacggattttttacgttagatgtgtgacgacaagctcaaaatcacacaacataatgtctatattctctacaaatactacatcacaacctcaaatagatataaataattcatatatcagtattgttactctactaaattttgatttggcatcagaatctatgcaaatacacatccttttacttagcacataaagatgaaggagaacccaactaacacaacacgaagtaattaagtttcggtataatctcttatagcatatgaaacatttttggttaacactcatgacactatcttatatttagagagaaagttgaaaaagagaaaaattatatgtataataaattttttgatatgattagaagaaagataaaaaaaaataaaaaatattgataaaatatttaaaatagatgagtgtatgtatatcattactctatagtatatttatgtaacaattcgtttagaacactttcattaaaatacactacatttaaatttaatattagttcactataatttttaaatgcaatgtatatgtttaaaaatatttgtttattataaaatttaattaaaatataatataaattttcaaaagaatttatttattataaaatttaattatataatataaacatgtttattacaggtgttcaaaatattagttcacgcttataaaaaataaaataaaataaaaacacacaaagtcatttataaatacactagtaaacgaaaaatgatttttttaatgaagcaaacttatattaagttatgaataagtaaagagtgaaaacaagaaggactgaaatcaaacatttgtagacaaacataagatcttgatgctctagccaacctatgagaaatctgattggtttgcctactaacaaactgtatactacagttatgaatttcataaaaatttgtatcacagattcttaaaatgcaacccacttcgagatcatgaaatggttttgctttgaaagcatcaggaataacctggcaatctgtctctatgataatgttacccagttgctgatcttttttccagttgatagcaaataggagagtcttgtggagtttggctgacttggaaccaagaagttgcagcagcagcaacaccaaacttgttgtcttcattaaaaaaaacaacatccatattatacttcaaatatttcagattgaggtggaagtatatttcgccgtttgtggtgtgtgttccattcttgaagctgctgaaaagcttgctgcagagacaatccagcaggtttagtagctccatcctaaagcttctccctttcttctccgccataagcaccaaagtacagtaacaatttgctccacttttggctgttattgaatttttccgggatgtgaaaaatgaaattacgcatatcttccggagtatcaaaagcatgttgaagaatatgccacaaagaagcttccatccacacatgttgaatatgagtgcagcctaggaaagaatgccaatcattttcaataccatagtagataatcgttgcctggttgggaaacatcctctagctattctccaaacaaaatctttcatttttgcaaggatatattcaaattccaaatagccatccaattaccactttcacagagatgattgttatccaaaaaaatttccatgatacaaaaattcgaagatctaagagaaaaagccccatcttgactaagctttcaaataatcttatcagcgggagtgtttattaaacgtaaaggcatagacaagatattttcagcgtcattttgggaaaaaacattatgaataagtgcaacattacaagagttcaaagtgggatccaataagtcacttactttcatattttcgagtcccatgagaggaactgatggagcatttgaactatcattagaccgaatccatggatctttccaaacactaagtaaatggaaaatgtcaggagcatttattttaatatatttatttaatttaaatttaattattaatatatatatatatatatatatatatattaaattacattaaaaatatattattctgatatttaatattacattcataatttatattagttttttataaataaaattatgtctaatacagtatatcatgttattatcatatatatatatatatatgattaaaatatgttttagttactaataaattagtaaattttattttgagtttctaatatattttttaagttggatatacaatatattaaaatttttgttttaagtctctactgttagttaattaagtaatataaagtaagttaaaaaaattaaattataattttcgacaaattttcggtggttttaaaaccgctagaattaattaatgaaaaaaaaaaaaacaaatcttgtttcctggtacgtaaaaaaacccactgagaaacggatttaccttggcgtttagtcagtgagaaatggatccgcagatatggtggcgttttgtcactgacagtggaatcaattttttttttttttaatagtaaaggagtgattttttattataatttttgtattgtattattcccaaaccacgatttctgatttttctgttgaatcctaaaggtgtgatttttgtgttttgtgatttttgattcctctatctgactatctaacttgtccactttgatttgggttgaatcttgatttcttggtttgaatgttatttgttattaattctgagtttttttttttaatctgagatatggcttctctctatctgattaccatcactcatttttttttatctaatttttattcgtttttttattatgggatgaagattgggatttgaggaaattttttttttgcattaattaattctaatgattttaaagctatcaaaaagtataatttaaattttaaaataaatagtgataattttttagctaccagaaatcagaatttaaaattttaaaataacacatcatcacttaattaacaacaacctaaaataaattttaatatattagaaatataatataataatttttttattagagactaaaaaaaattattaatttatcataaacttaaaacataatttagcctatatttatatttatttaactattttaatttttattaaaaatgtttatactaataaaaaattagttttatattgttattatatcatttcaattctatttaatttctctcaattttgatgcctctttctttctttcatatgatgtgtaatactaataattaactcataaagctctttttgttttaataaaattaaagtaacaatccaaatggtcagcttcccatgtattattattattattagaagaatcatgaagctttgaaaagatagatgtccaacaagaaatcctgtcaagggcacttactgaatggagtgggagaacaaacatgaaatacctatgaaagccaataagattgagaagataccctatctgtaccaatcagcgaataggtgtgaggtgtcattgccatttggctcactcacacttacacactttatatctgctccttcatatcctcattatcttgttctacgggttgtgaatttagtcacatacaaatttgaagaaattgtgttgacaaaaataaattgtgtaagaaatatttaaagagaatatacacttaacagtttactctaaaatatatctgataatttaatataatatttttttaaaaaaattaacagtacaaacagttgatatttgaagaaaacttttagcataaaaacgtgaaaataattaattaaaaaaataatttgttgtgaaattttggaagataaaatactcaaactctgagaaaattttcaacagtagatcacaaatacacatataagtaaaacatcactttcaatccaaaatcttaagaaattagattaatttgtgatttagatcacaaatacacatacaagtaaaacatcactttcaacccaaaattttaagacattagattaattagtgatttttttttatttatatattacttaacttattaattattatctattatgagatttcacctttatattttagcttcaatattctcttccttaaggctttgtttgggagaggaattttagaggagaagggagggaagggaaaggtttaggtggtgatatctccttgtttgagaattttaatttttgaggaaaaggatttgaggatttttaaaactcctttaaaatcctccaaagcctaaaaattgttgttcccccaatttgggggtttttagaaggaaaaataattaaaattactatcttacctcagctacacattcaaaaatatattaacatatatttttaatatatttttacatttaaattatataattttcacatttaatatcttattaactctcaatttccctctcttaatatatttttaactcccaaacaaggatgaagaaattttcatcatttttctccctttccttcccctcccttcccattgaatctctttcctttccttcccctcctaactcccaaacaaagcctaagtgtgagtctattttatataataattttttttcaaacaaaaacattttttcatccacgagatatccattgtagctaccaatatgcctttcattgttaggccttaagagtttatccattgctgccaacatgctttccaccatttcacgacaacgaaatacatgtttggcttccatgttaacagaaagacttttgatctttatatatagacccacaagggatcctcatgcttaaatacaccacaaatttcattataatcatttgaacaggtcacctgatcaaactattgattctgatttcagttgttatagtgttgtgcataggatgagaataaaatattggagagatattaatcaccaatggattatgaccatgatgaccaggcagtaaactctatcatatattttttaaaatgctaacggtctaaaggcatttttaaacaataaaatgaactatttctcaagaatttaaaaaaaaaaaaatatatatatatatatatatatatatatatattattcgtgtgtgtgtgagagactattgtgttatatagagacaacattttcctactcaaatataaatctcggcaccaatattatattgattgcgggtggtaacgtgatttggaagtgtgtgtggtgggggggtcccaagccatgattggtaatgtgttgtatgcaccaaacaaacaacaattgaatgccataataccacgtcgttgtctcatcagtcacttcttttttttcacaatgttcttctgtttaatttacgtttctaaattctacatgcatgctagtttctaccagcatccacaaaaagcatgcaaagagaaaataacaatcatgcatcttcgtcttagggaatttccgtaatccgtagttaatattcgatctataattattctgtcgtatatgtcatgtatccagattacaatattgcaaatccttgtggactagccgccgtatttgaattgagtcggttctgtaacttttgtttgacatacaatattgtattttcgcgagggagaatataaatacggtcgaaaatcatatatctatgcaaatgtgaaatcaaattactgctaccagagtcatacagtaataatcaatattgcccaatccaataatttattttatcattattgagttgttgattggatgcctttgcttgcatttaccactccatcataagcttcgccagtactcaaatccctgttgagacaattattgcagcactccggttttttttccttcaatttttcattattcaccaagaaaatgaatgccctaccttttgttctatttttcttttaaaattttgtccaaatacttattataaagttttagtttttacacccacaatcaatcaaaaatcatcttaaaaaagtctttttgggtaaaattattcagtaagcacttattaaaaaaataaaataaaaagataaaatgaataaaaaatttataaaaactcgtccaacttataaaaaaatgaggtatataagttaattttaatttttgaaaaaaattagtttgcttcattttttttaagagaacataatacgagtatgagttaattattcgacattgtataatttttttgggtagacattcgacattgtatatattaatataagataaaatattatgtatatgggtcaatcacttacacgagatttaatatattcatctttatttaaagtgagatttaagacgtattaataattaaaaggtgtcatatatattatagatcaagaagaaaactagcaagacaaatgtaatttatggtaagtaagacggtgttgattattaatgtaatttataggtcaagactcaagaaaataagctgttgtctctcaaatttatagtctctcaaaataagctattctcatccaagaaaatgtaaattgtctttgttaccctcctccctttcctacacccaaaacctttcccttatttccatcaccatcctctcacagcacccccactcccttctccgatcttttttccttacactccaataggcatggcaacggggcgggacatacccgtcccccgcccccaaacctgctctccgccctcgcccccgtttcccgttggattttaaaccccatccccatccccgccccctctgggggtcgagttttccccgcctcgccccgcccccgctatttaattaaaatttaaaaaataaaataaatttttttattgaaaaatcggataaaaaagttaattatgtaacaaaaaaataataataacaaacccacatttaaaatatgatatcataattttaaaattacaaaacaaaatcagccaatttaattaaataaaattagaaaataatatttttattattattattatttttttaatattatttattacagggcgggggcgggggcgggacgggtatcagtaaccctatacccgcccccgccccgcccccgcttttggctaccaggaaaatccgaacccgaatcagaaaaaatcgattttttcccattaaaatcggggcggatttgggcgggtacccacgggttcgggtcccgctgccatgcctacactccaaactccaaatcctaaatctttcaagtccattttttcatagaaggaaggtttcttaaaaaatatatattagaatttgggtacttgccatacattcatctcgaaaagttacatgaaataaacatattataagctaaaattgaacatgagtcaaaagttatgtcatgtcaaacaataatagaaatataaatctgttttagaagtatacgataaaattatatttttattctatatatttgagatgaaaaaataaaacagaaaaaacaattccattgtaaacaacgactaacttactcttatttgaaggtggataaatatacccccttattttaataaagtcacctgtatttagtttaaaatattatatttttcatattgcatcacctaattttatatgtttgaaccctctcacttattgtcatgtgagggtaaacaaatatatatacccctttattttaataaaatcataaatatttatcttaaaatttaatatcggacaccttttatttttatatgtttgaacttactaccttatttttatgtattaaattcattttttaaatagattgttccaactgacctctcggatcctagattcatttttgacgaaaaaaatataaatatgataaaaaatgcaatactgcaaaaagaaatgaaaagaaacaaaagatgttatataggtatttataattaaaggatgtccatgtattataggtcaagaagaaaactagcaagccaaatgtaatttatgttattaaattattttacataaaagttaattaacgaggtgaaaacgaaggtggacactttctttttagaaaaaatagaagtaaaagagaggatgggatcaggtggagaatatccggataagggcgaaacgaaccttcagggtatttatttttttttaattatgaaatagagataaacttaaataaatatcgagaaaggagtaagtagtatgatattcatgacttctaagcttaaaattgtaaatcatttttcaacttttattttttttctacgaaaaaagtcataaatttttttttatgatgttttaagtttttttgagtacgaccttaaattagtaaattatttccaactttaaattaatatttttatttttgtattttatatatttttatttaatattttatatcttttaatattattttatttaatattttctatatttttttcttaattttaaggttttttttcttctaattatagtatattccaattagttcgacttcaatgtcggacatatagtcacaactttattttattagtatttcatttatagaaaatatattaaataaaaatataaaataatataatatactaaaatataaaatattaatataaataaatttatttacaactttagtatataatttacggcttcaaaatttttaaaaaaattaaaaagtcataaatctttttacgatttcaataaaaaaaattataaaataatttactactttcaactcaaaattagtgagatattttatgatttttctctttctaaattttaatttaaaatttatttttattcaataattgtttaaaaaaaatcctaaaatgtggtttcacctgcatataggcctaccaatcttttagggtcatgaaatcagagagagagagagagagaggaacttgttttctttccactgagctgatggggcaaggattttaatcataatgttgtcataggaatgtgggaaagttaggagagcctccaaatttcaaatgtgttattgctcttgctctcatgaattgcaatggcccccacaaaggctttctcatgaattttcatgttttttatgtttggccttgtttggtacaagtatatgtgcatgtgattcactttatacgaatcccccgtcttttctattactataaaagttttagttacactgttcaattttttaattcatgttgaatttaaatctttaaataaacccattgcattgtgttttataagtgatactaatagccgagggcagagaggaagaagaagggtacgtacgggttcagacactcacgtgcagagcacatgtgaatatgtgaatatgtgaatatgtgatgcaatgcagacccactcagtccccaccatgcatgcagtcatagtcatatttactaaatgaactgttcacacatttacttatttccatcttctataccaaacaagccatacatactgtaccaaaaacaaaagccatacagatatataaatatgactatgactatttttttaaccaattaatttaattactttataatttattttatcaaaataaaaatatttaataaattaacttattttattattttattatgtttttaaaagttaagactttgagttcattttttttattattttcattttgtctttaatattttaaaaccttctttatttaccttaattttcatctttataatacttgtttttatctaaatttttttcacgaatcctcaccaccaccgcccattttagtattgcatttttaaaaaaattaaattatttacattctttattttaatttttaataaaaaaattaatcttacaaaatttactactatatctttgttcataaacttaaaatatcatatatagtattcatgttattttaattttcaacttttttaaataaaaaacttaaccattttttgttaaacaaagtaatataatttttttataatataaaaaagccaactattaatcataaatgcactttatttattagaatatgtgttaattcataatttaatgtaactactgagtacaatttgattgtaagggagtgtgggggctgggggccgaaattaacaaaggggcaattatttatggaatttattaaatgaggataaattttaaattaatattcacaaaggggtaagttgcatggtattctacaatttttaaaaccaaattcataaattaattcacaattttttattattgaaatcataaaaaaataaatgacttttaatttttttaattacaattttgaagtagtaaatattttaatttttaaaatactatttagaagtcataaacatatttatttacaacttcaagtaatacctttttctatatctgtatattattttatttaatattttctatatttttatatattattttttatttaatattttctatatttttgtatactatttgttttaatattttttatattttttactaattttaaggattattatttattttataaatttaaaaaataatgtaaacgaaagacttaaatttaaataaaaaacattaaaatggaagcaaaaataaatttaaattacctcaatatttaagtctatatgttatgtttgatcattcaaaacgactagacacattgtgaatgtcaatcattaatcatatatataatgagatgaacaaatcaatttcaaataagcctaagaaaaactcattgtttagaactgaaagacataattataataagtgtctatacaagtaagttgatgactaatattgtttgtactttttaattttatgtttgtatttagtttgtattgttcattttatattaatgtattatgttatttttattttaacaattatttttattattaaaatattttctattgttaatattaaaataattttatcaaataaaattatttaataatactgtatgaaattattaatttatttaatgataaatgtaaaaattaatttaaaaatttaaaaacaatttaatattatgtgataaattttaagttaaaattatttgttaatattagtaacaaaaatattaaaaatattgaactataaattaaaaattaaaaataattaataattattaataattattttttaaaaaagtatgattttgaagtcgtaaatatatatgtgacttctaaatgttatttaaaaaatttaaaatatttatgactttaaagtcttaattaaaaaaattagaagttgttattttttatgtttcagtaaaaaatagaaaaataaaaattttgaattaatttatgattttgattttagaagtagtaagaacatctttaatggtatatctcaaattaaaatcgatcacttttctatagttcctatcgaactatataggattgaagatcttttaagatatttctaattttttatttgatagatcttattttgagattttaggaagagagaaagagcaagaaaaaacttattcttttttaaacaatgtgaatattgtaagagttattttacaagaattcattcttcatgttagagatctcttcacctcttttaattggagatatagtgaaaatcttgaattcaagattttgtttaagatagtgttaaagatgttatagcttttcgatagtattaatttaaaatttattcttatttgataaatttaaaaaataattaattcttttgataatttcgcggtgttggagccaataagattggattgcaaatggcaacaccaaagcgcttcatagttacgctaatggtcccaacttgaaaggacttgtcgtcacctttcaaaggattgtcattgtccattgatgggtttcatgattggtgtcagtttttggtagtggttattaagtagagccaaaaactcatacaaagtctcctaggaaaaataattagtgggagaaaagtaggaaactatttgttggtttaattatacaaaatggtgaaagaagaagaaatgtatttttttcagttcacagattaaactgtaagaaggcattctttcagctatgaaatgccacgccatgatagacaaatctttttcattaacgttttaataaaattaaccaatagcatttgtcaataaaaaaaattacaccactaacaacggatgattatgcataacatttttcttattaccaaaaagaacacaaaaatagcacaaaaatagcaataattacttaataataagtcaattgtttaaattttaaaaaaataattttttaagaagtatatataatttattttaaaaaaagcaaaaaaaaaacttttttatcaataaaaacactctggtaaaaaataagtttaaataaatgggatcaataccataatatgtggctgcggtaaacattaatgctttgtttgtttgagattctctatcatgtaaaggataaattttttcgttcagcttttttaaaagaatatttttaattttttacaataaaattttatttggttaaatgaaaaacattaaatatttttaatatttaaaaattatcacatatgtataggagtttgctaatgcactcacactaagtatttaagtatgagtacattagcaacttataccgtaaatctttggaaaaaagaatccatcatctcttcacttgtaataaggatatatcagtaatttaatatcaattttttaaaaacaattaaaaagattttaattgttttttcttgctttcttttctttttctttttttaaaacaatttaacatgtttttgagtcttacaatcttgaatttttgtttatttacatcaccaacatattttttcaagggaaatgtatttttaattaaaatgatggtataaaaataagagtctaattttcatatattgttagtaaaaaaatttatattctcgtcaaagtagaaattgccgtaaatatggcttttcaaagtgctccttaattaaaccaatcgaaaaaaaagacaaatttactaatcaagtgaaggtataataaaaggctatgataaagcccatgagaaaggcaaagcaagacgaatggttcatgcaagtactgggccacagagtcaattcaaatccagaagggtggatagtccggtagttttctccaagtgcgtttagaaaaccacacacaataaaactcaagttctctccgggtgcgaggcaccaaagccacacaagaaaaaacaagttaaagacaaaaaagagtttttgaattgtaaatttcattttttggacatgtacaactaaatctttaaaaatatctaaaatggtatggaacactgacgattctgctatcctgaacagttaacactatgatcaaagcaaacgaacgccttaacgagtcttccttctagaagcttcaaactctatacaattgctacttacagtctacattttttcccaagctgaatatatatgtacaaattcaataccgtcggtccatgaaatcattggtgagataacagagttaatcggagaagaattcttgcacttcagctaattggtccgtggtcattagaagagggagtgaatcaattttagttccattggcattgagcttattatctgctacctcagaccactcctgctgctcttcaaactcggtaatactgttgtgattttgggggtaggaaattcccccaccaccagagttttgacatatgcaagctgatgggttctcggtaaactcaccactcccgggtctcaactcatttggttctcccataaagcctacctggaatgttcgtactcgagaggcaaattcctcccacgtcctattatttctgttcatgaataacaggttcaacttctttgcatttggcctgatggtggctttatgacccaagtacctccttcttcctgctaaaattttggccatgttaccgttgttgtttgttacaaatacatcactctcgtcacaaactatgaagtctagtgcagccatgcgagaagaaaatgacacaaatggcgccaactcctccttggtagctatggtctcctttgaatgaaagtttgggaaaagagccttcaggggggctaacgtttcctggcctccatatatttcaccagatgccacgtacaagttaacttcacttccaaaacctagtgctcttagcataagaccaacttcctctggggtaagtgggcatcttccatgtcttcgaactttctcaggattacttgcctgtctcccatttccaaataagagagaatatatcaatcaattttcgtacatgtggagctcatttcttagatgctactaaaacctttacatgtaattaataaaaaaaaccttacatgtaaatttttccatcttttcctaatttcaccaagttcttttttttctttttctcccccgccataatagcaaccagagaatgcaagcatatccggttcaaacctatgtgataaaacatcagtttgaatcacattgaacttctatatgaaaaatgaaaagaacttagcgtctcaattacaaaatgcgagttaattttataacttaaagaagctgatgaaattctgacgttgatatcatgctgcatattgcattctttgctgaggaactaaatgaaccagaaataaagcttggctataattattaaagcttaattacctcaaatgtagagcaatgaaatgcttgcctttcattttcatccgctcaaccaacaatttacccatcccctgaatggaatccgtaaatttgagagcatggtaattaaccctgcacctcagcctttgaagatcttcatccaacatattagcaagtctataatcaaacttagttaaccgaacagcctgcatgcatcaaggaattcaagtatcatccatcgaatcaagaacaccaccataacgtacttattacaatagttgaagattagcaattgtcacagtatatgatagcttcgaagattttttgttttttaaataatatttccaagacactactacgtgtcactactttttttacagactcaccagtcactacttaagataatttccttattgtattttccttgagagtcaaccgtcattattgcttaaataaatttcaattttgattaatcaatgttccataaattcttcatttagttttttgttccttatttatatgtttaatcaaatatcaaatgttctactaaaaaaatcgattatcgattttttatgattaaaagctctactcacattattcatatcaaatgtcatatattttcaagtaaattcattcatacatattcatttagaaaactccgacttaaaagtgcattaatcttttagtacactctattcttaacttctattcttttaaattttaattataatatttttaataaattatgtatatttataattttaaataaatttaaattttaatatatttaaaaataatctatagaaagtacaagatacttgttagtaaaattaactatttttgctcaaccgtaaaattaacgcaactttcactagaaaagtccgcatgtttgaattagattattttaagaaacaaatatttattttcaccttcctgatttttttttttttataaaaataaggaaattagttgttaatattaatatataaccaaacgtgcactatagttgataataaaaaaaatgcgttgaggctttgatattcatatacaacagaatggaaaagaataggaatattttcccccctgaactatttatatgccaaaaataacaaaagatttcagttcgtaagagaaaaaattacccaaaactagcaatttgaaatatttatactactgagtgcatttaaggagttataaatttggcaagattaagttctataaaagaaatagataaaataaaccaaaaaaaaaaaccagaaaggcatgcagcatctaggctcaaaacaggggaggaaaagtccagattttaatggtggaatgcaggcaaataattttgaggatgtgaagacttacacgcttcctgaccagcacgggtaaaacacgatcctcatagcacttgggggtgcatttccttggaacacgcaccgtatatggagccacgaagttccctctcatatccggaagctcttttacaattctcacgtcattccggagaaatgttataaaccagtctgtatcaaatagttcagaaaagttgctgcaaaaaaatagcacacaaattaagagaccatgaatattgcttccaataaaaatatcatacatgatttacaaggcaaagacagacctggtgtctttccagaaagatgtatgatccaactctggaacaacaagagtagcattcaaaagatatgcagccaccacagcatcaattatctgcaccaataatccagccacagaaattagccttcttcatgtcacttaaatttgtatccctaaatcacatattatattggtgtctgatagccccgccagacaaaactctcatcatatcaattgaatttagagcaatagcatatgacatatttcagataaagaaagaaaggaaccatccatgttggttacatacagaaagactaggtaaatcttccaatattgtttggttacctccttgaaaccataggtattgcatatgagctgataatagatagttattagttgatgaagaagcttacccctgttctctgttgatttaaacctccactggtggcaatcagcaagtatcgatctggattcgttttgacattagcatctgcaagtgcaagaaacaagtacttacgcaatcaaattgcacgtccaataaaaaacgaatgaacacacggcttacaatttggttcaatttaaagtccgaaattaaattcatatattggttgcgagatgagatgattgggattagctttacttgcaaaattgacaccggcattactgcagccatagaagaggcgtgagtgcattgaacgccataaatcacgcctgcatctacctccacccgccttcaaagtccaaccaacacaaatagattaagcaaaataaaatgcagaatagtgacaattgcgttttagttactacttaatagcttaccggaacctcgaatcgtgatctaacttggtcattgttctgagtctgaagattgatttcatttagcggggacggagcgaacagagagaatagggcgaagagcagaagaagggatgcggagatggcgatgatgagagtgcggtggaggagccgacttcgaaggaaactcacaaccaggagtccgattattctggatttctcagtgtgatgcttctttctcttcattgctgttgctgtcgttacgtaccttaggccgaatttcattaattcgatcaatattgcgttgcttaatgctattgattgcatggaagaagaggaagcgcattcgcagcaacgacaccgtttctcgcattttccattttgtcaccttttctttgaagaaggtggagaagagacgacgacctttcaacagaaacgaacgcaaccgcacgtaaaatcgatatacctgtgagcggaattgaatgatcgatcaaatacaatgcatatacaacaatacatacgtatctaattaacccaatcgtgtcaatgagtcatctaacttctaagttccaactccaactaatcccctcgtaaattttactttctcaccaaaccaaaatttcaattaagctcgcgttaatcttgtatttaacgttgagtacttggtttcgctgtccaagtttgattttgactcaaatgtttacaatcaattccatctctaaactctaaatatggagtgcatggcaagtttcttggatgcttgactctaactaattaaccagcggattctctacctatatttggaactcaaagtctgttacattcaagctgtacttactactgttatatatattctgcttttgggttggagcaaattcttactcacaactctgttatagctttcattacgacttaccactttgttttctttcactatttacattacataaattagttttaagatcattatcaataagaggtgattagaaacagtgtgtttgttgagtattgggatgtgaaaaacatataacatgtatgtatctcattctaattatttatttttttactccgattatattaacacaagttccttctacaggccatttttattgattgtatttacaattgaataaaatattttactaaaataaacaggtagataaaactaataaatttttaaaattatgcttttacttgagtttatttcaaagaaaaagttattttttttaaccatgtttctaaaataacttttgaaaaataattatttaaaaaaatattcttaaacatgtactaagaattctaattttctgataactgttatttccttgtgtaatattacgattgaaaatcaaagggaaagagaaaagtgatttcttaatggatacgtgggcactgccaacaagtaacaacgacatacattgattgatgaacatttaaggcacaaattcttctttctgcaccttaactttattagtacttatttatgcaatcccatcaaaaaatttggttgctctttactactcttcacgtgtgtttcatgtggttgcatgatctcgctctcgcgtttcattcctctatgttacggttacgaaaccaaaattggagaaagtttattcgtaaatgtagagaggagttgaagcacaagctatctatcaaaatagatgtaattgatggaaatagtgacgagtgaaatgtgaaaatgatcaaattggtcttacaaaattttactcaagttattagttcttcttaatctattggagccttgaggctttcccggttttattgtatgttgatgaagatattattttagtagtgttaaaaagagagtttaggagagtctgagtagcatttttcattttaatattgatctaagataaggtaatgtttgagagtatctagaatcatactttaatatttcaattagttaatgggtgaattatcaaatttattttgaaagggtgcattatcaaattaataatgtatgaaagaaacatttcagggctttttaaagacttaatcattttttccattatgttttaaagttgttttgttttgatacattaagttttaaaaatttcattatgctcattttttaaatgtatctttttggtctcttttttttttctttcaatttttcgacgttagtgttatgttaacttttaattttaaaaaaagaccaaaatgatatatttaaaaaatataaaggaccaaaataaaacttttaaaacttaatgtatcgaagtgaaaaaaatgcaaaacataatataccaaaagagacattaagtcttttaaaataattaactttacatagtagcgactaaaaatagtcattatctttattttatttaaaaataactaaacaactaaaaaatttcaactcctccaacctcttccaaatttgaaaaggtaaaatattcagcatcacatagattgaacgacgtcaacacataatctccctagaaccacaaaaaattcttatactctttacaggaaaatcaaaacatttcatcagctatgctattggaaacaaaggcaggggagatcagagcaaaaagtgtcttcaacgaaagacaaaaatatgaccttatctcgccaattaattcagatatgaacgaggaagtcataatgtgactctttgtaaggtttgcgagcaagatctccactgtcgtgcacgattgggtgcacgattagactgaataaatatagaatttcccattcaatatttacaattgggaaagacaaaaacgagtaacacaaagagcggttaaatagtgcatttcattggaagatgattatgactggtccgatcggtcaaacctcatccactatgaggcattgttggtctttttcttcgctttcgtcaatgcgttgttgtcagtgtggcgatgagacaattgttgttgttaggtgaggcaacaattatggctacgtagggaggttgcggcgaagacataagcgggggcggggcaacgatctttttgggttaggggcgataggcggaaggagaagggacccttacccattgtaatttagaatgattagtgaatgaaattattatcattattaaatgattaaattgaatgaagataataataataataataatagagtgaatgttgttgttgtttgtgatttcaaattcatattttcttcatttattgagtgatttttaatttttaaatataaaaaataatgatgatttttagttaccactatgctaacttaactattataaaatttaaaatattggaccataacgcttctaacaaaaataatgtacaaaaaaatgatcaaaacaacacattttaaaaacataaataatcataataaaatttttaaaatataatgtaccaaagcgaaacaactctcagaatataatagattaaaagtgacattaaatcattttaaaatttaaaaattaacaaaacagaaatatttctaacaaaaaatttaaaatatgatatattttgaaaattttaaaacttaatgttttagaatgaaataactgtgaaatgtaataaattaaaagtgacattattttttttttaaatgaacaagttttgattttgattttttttaaaagaaaaatggttttttttatttttcattgaaatcattattcttgatcccagtaacatgaatgaatgttagctttgccggataaaatcctcagcgtggcaatgggttttgtatagaaggggagtaaaaccaggcattttcttcttctgtactaatccccctgttgtccttgggtctaattttacaatgtctttacagctttaatccctctttttgcaatacaaatatattctgtgtcttaaaaaaatgttaattttgatctctgaaaagtattttgattttgatttctgtcctaaaaaaattgaattactatttttggtttctaatgttcacttgaagctagataaaaaatatttatttttaagataattttataaaatttaataaatttatcatatattttattattttatcagatgataatgtaaaattataaaattattttatacttttgatatataagttaatctgattgattagaaagtgttttttttaataattagcggagcctaaacccagaaaaagaaaattacattaaaactaaatgtggaagaaactcctaaaacattaaagggccaacatctgtttaatctggtttggaggctccgcatctaaaatcactgcatactccctccctttcaatggttagaattgctaaaaattataacctagtcaattaatataaaacaatataaaataaaacgatatatttgattatttggttataattatatatatatatatatatatatattctaatttctaaaagtaagctaaaaatatttataagtttattttagtcggattaacttgtaagttagtcaaatcaataacatttaactagtaatttccaaatgaatagtcaaaatattaatttttgtttatttattttatgaccatcccttacctgaataatttaatccatagtgctttaaaatttcatctagaaagagctgaacgtgagcgaagcggagacagctatctatttgtattgcagagggagaggaaaaggttagttggcgacgatacgttctgtgggctgcaggtggagtcgagtctgcctaattatttgatatttatttcgatgttgatggattattgaacttttttctttcttgcagtgcaggcggtgatgctcatggaggctatccatttcaccacctctcaataccaacttcaatatcaatatcatggagccttccccagaagacccttcctgcgcaagcgcaaccatatcagttactgttatggccaccaccaccaccaccaccacttcctgcgccaaagccccagcctctccgctccgttcatagcacttggcgctaaaccctcttccttcacttctcaggaccaacaccattcagattctgcttctgtggatgtcaaacgagagcttatatctcttactctccccgcccttgccagtcaggcaattgaccccttagcacagttgatggaaaccgcctacattggtcgacttggcactgttgaattggcttctgccggcgtttccatatccatctttaacatcatttctaagctttttaatatcccccttctaagtgttgctacttcctttgttgccgaggacattgccaaggcttcctccactgcagatgccaaaacaaaacaacaactctcctctgtctccactgctttgctattggcactctcccttggcttttttgaggctttagctttatacctgggagctggagcttttctccatttaattggtgttcctacagtatgttttcgccctctcctttatgcgttttatttcttgtatcctcttccgagtatatcatttgtcttctcctttttcaacagcaaaatccaacatatgttcccgcacgacactttctctctttaagagctgttggcgctcctgcggttgtactttctttggctcttcaaggcattttccgcggttttaaggatacaaaaactcctgttatatgtctcggcaagtgtttgctttctttcttaatttctccttttcaataccttttctattttctgcatgtactctaatacctttactcgcaattcatgaatacattattgttattattaactagctcgcatgcaactctaaggaatgaacaaaattatcatagcatgtttgctgaagagtgagagggaattgatattttagttgattggaatacttgtgacttataactaaattacatatcccattgccaagagactccttgctatgcgaaggtaaaggggagggatattgtacgcagtcttacccttgcatatgcaaagatgctgtttccagattcaaatcgatgaccaacaagtcaccaaggcacaactttatcgctgtgccaggactcgccctctacttgtgatttataatcttgaaaaataattttagattttgatatcataaatgttcttgctgttttactttctttttaaaaataaaaaaactaacataccacagtgctcctcatttcccaaaggtatgggggaggttaattgtactcagtcttcccattgcatatggaaagagattgctttcggatttgagcccatgaccagctgtcaccaaggcataattttaacattacactagggattgccctcttttactttctttcaaagattgattaaatttaaaaatcattttcattttcattatattgtatgtatgtgtgtgctaattcctctttcaaaatgcaggcattggtaacttttcagctgtcttcttatgtcccttacttatgtattactttcggctgggtgtaactggtgcggccatttccacagtcatctctcagtaagtccttttcaaaagcattacttttttctttatttctttacttgattcaaccctaattatgatggaatttttgtacctcagatatattgggaccatgttgatgatctggtgtctgaataagcgagctgagttactacctccaaagatgggagacctgcaatttggcagttatattaaatctggtgaggatttgtgtctttcttattatgtgttgttaaaacctgagatgaaagagtgtgtttggccatcctcttaaaatgattttctctttgttgaaaaagtagggagaagggaagataacaactaaaagctaaatgcaatctcaaacactgtttacaaaacactttccaagcaaaagatctcacctccattttttttccccttgttgtttgtaatatttctatttaaaggaattagcattaagagaacaagtgtgtgtttggaatggacacattactaattttgtaagctggcccaagttgggaccagaaaaattattgttttagagagattattaatttatgtatgtttaactttaattgcatggacacatttctcttttctttactgtgtatattatttagctttctgttaggttattgtagatgtttcagttatgatctgtgggctgttacaggtggtttccttcttggaagaacacttgctgttctttcaaccatgacattggggacatcaatagctgctcgacatggtccagtagctatggctgcacatcagatatgtatgcaagtgtggttggctgtttcccttctgacagatgcattggctgcatctggtcaggtattgaatcatccattacaaaaacttgtatatttttctttatcattttatctttttaatttttcccccttgtggtataatttcctaaatttctttcaatctagtaaaaataccatgctgtcttgcaatgaaacaagtcgagccaacaaaagccagacaaaattctgggtgcattgtttgaacctcttgggaaaattttcagtttgcttgactttgaaactttttaacattttaaattcatagattcttttaagcttggcctttacttcgttactgtcttcttgtttgtatatgcctttttgcttatactgctatattattatttataggcccttattgcaagttctgtatccagacatgaatacaaagttgtgaaggaagttactagttttgtattaagggtaagcgcttttttttttttttttatggattgaatttttagcctttgatgcctttcattcattagttattcttagattttatgtaagctatagttgttttactatgtcaaataaggaagttatatgaaattatttgagaacctgatcatgcctttccagattggactggtaatgggtatttgcttgactgcaattctgggtgcatcgtttggatctttagccaccatttttactcaggactctgaagtcttgcaggtggtcagaactctggcattggtatgtatggtattgctgattgatttgtatgtatttgtttgcatttgtctgtgtctgcatcaaaattacattgttatctgtgattgttgctagtttgtcagtgcttctcaaccatttaatgcactggcatatatttttgatggtctccattatggtgtttctgatttccgatatgctgctttctccatggtaagttgtttacttttctaaatgtgtcacgtttttctcttctggtatatatgcttcttgaggttaacttttatgacaattgcttcatagatgttcgtgggagcagtctcctctgcattcttggtatttgcacctccactttttggccttcagggcgtatggctgggcttagttctcttcatggctcttcgtgcggcagctggtgctgtcaggtaaaatggcacattaattttgtgtgtattgggaagaaatgtttcatgttgtttctatcttgttttaaaataaaaataggttactctacccattgtatttgactagatggctacttcaaccttcaccctctactatttatccatctttgattagaatattttcctatacatcttgggctgacaattaatttgatctgatggtatttatatgatagaagtatgcatgactgatcatactatactattatagtttctttatggaatggtgtataagtgccatggttttaaccttgtttcaattgttaaagtgctttttgaaaatctgtgtctatagttgacatcttctacatgggttatcaaatcttctagtgaaattgtaaagcgttcattacatgaacattaacaacacctttaacccaaactaattgaaggcggtggtagatgaacccaatgatagatacgaggaggttgaaaaaaaaagtaaaagcaaagaaggggaaaagaagaaagggggatatgatgaagaaaatgactaaaaagtgaccatctggaacatagggataacaacatgtctaaccctccaccaagcttattaagagaaagaaatatagtaattgagtgtatcaccctgtcctttcagtagatttgctgatgctagatagtgtggttccctttttgaattgccaggttgtgcttttaaattttttttccccttttgtggttgaatcctttgtgcttctacattttcagattactcacaaagaatggtccttggtggtttctacacacagatttacaaattgcggaggtcagtttctattttacaattcctatcatgtctctgctttttgattgagtaaagtatagttaacatcattgctggggtttattttctctcgacttgtgaaaataatattattatttttacctttctgtccttggttttgcttatctactcagctgctatattttgtgcaccaaacagtaaaaggttatttctagaaaaaaatcttccttgatggagtatattagatgctagtagaaggtgtaagcaagctagtaatgttttggaggtggaaagcatggttcaagattattggatctatcttacaaagtgatgagaaatttattgcagagtttgaagggtatacatatagggttgaagatggtcagatgaaatggagaaatgctttaggcatgatttgtgattacaatgtgaccagaaaactataagactaatgccgctcaatgatgggctaacaagagctaatgttgcgaaaagaggaatgttatggtggattagtggacataaagtaggagtagcacctgaagagatgatagaaacttaactaaggtcgtttgatcatgtaaatcaaatgagcatagttcaattaagggaggtaaagaaagatctttggtgaaaccattcaaaaagaccttgctccaactcattgagtacattggctttgtttgatctatgcagctgacctaactaatgggataaggccttgttgtataccttctgtgatccttggttaatactcattttctgaagtttcaaggtgacttttaatctgattgaaaatgatgttacctgtaagtcggaatgtgtatgttgatgctgatagcctagtgtcctgtttgacaatgtcactagaaagagcaaagataatattagtcagcatgatcatggcagtgtgcccatttatgaagagttaatttttgcttcttgttagtttattggtgaactagggcatgcttaatcacttaaagcagatattgaggaaaataatttctaatttatttttctgtgttgattaatattattatgtgatattgctcttaacattctggatgggatattcatatctacgagatttgttatcttgatcttgtaactcatgtttgcaggtggtctcgtgagtctttagatggagaatatggatgcaacactggatgtgacattttgaagaggattctctccgttggatattatatttagatgtgtagataatttaagacattttagaagcactttctgggttctctcaatgaaattagtcaatgttactttgtaaaggaaaatggtttaatttagtcaaatattatatagataaatacacacgaccttaattgcataattttcactatctaatcacatttattctagtttcgttttaagcatacttgtccggactagaggatcaactgcagaaaagaatttgtatcatatatatatatatatatcagcctatgaatttgaaactcaattgaaattacctctaagtcatgtcagtgtttggttttttacggtattaattctttcctacttttctccttccttgcacttgaggtgatagcatgtttccaacaaaaaaaggttcctacgtgaaaagcggagggggtggaaggcagtgttgttcgtttcaatcaacattacattacagattatgtggatagagaagcatcctttgtttgagcaaattgacctcaaacaatggacaggttacaagtgactttggttgagcaaacataattacatgaaaattaagccgaattattatagggtgagccttcaaccctgctgaaaaatagcaatagaaaatgaactttgattacaaaaaactggcggaggatatttgaaaaagattgtgcatagccatgggaaggtgtagtctagtcgagattggcaatgacagcgtcaacaacttggtgtgtagtgctgtctccaccaagatctttagttctggagttgccctccgaaatgacacgcttgacagcagtctcaaggcggtcggcgaatgaaggaaactgaagatgcctgagcatcatggcggaggagagaagcagagcaacaggatttgccttcttctgctccaccatcttttcctttccgacatttccagccgaagcaccttgctcaaacacagcatgatcagccccaacgttccctgcagtgcaccaaccatttatttacttcttattcaatagaatgaacgattattattgcatttgtattcaattacctccgggcatgacaccagtgccaccggcaattccagctgccgtattagccactagatttccataaagattaggagtcacctgagataataacacgagaagagatttagattggaaagggaagggaagatgaatctatagtaaccaattaaactaactaaccataacatcgaactgctctggtttggagacaagttgcatgcagcaattatcgacaataatctcgttgtacttgataccagggtatttggttgctacttggcggcaagattcaaggaagagaccatctgcgagtttcatgatgttggctttatggacggcggtgacttgcttcctgttgtttaagtatgcatactcgaaggcatatttggcaatacgttcggagcagaacttggacataaccttgaggctctcgacgacgcctggaacgacctcgtgctcgagaccggagtactcaccctcggtgttctcgcgaatgacgacgatgtcgacgttgtggtggcgggtgggcaagccgggcaagttgaagcaattgacgagggaagcgtagagatcgaggtcctttctgagctgaacgttgagggagctcacacccccacccaccggagtcctcaaaccacccttcaagcacaccttgttcttccgtattgaatccagcacctcctccggaacacgcctcatgtccccgtgcacctcgtacttctcgaagtatatgggggcgtgcatcgcctccatcacctgctccaccgcctgagtcaccagaggcccaattccgtcccccggtatcagcgtcaccccccgcggcgttccgtcccccggtcgaggcatgtacgtcacgctccttcttatttccttcatcccctgctgcaccactgacgctgacattcttaatttacttcttacccccatctctctctctctctctcacacacacacacacacacagcagcctcggctcagaaaagaaaggaaaggagacgaattgactaatgataaacaaaaaccaaaggttctctctgcaatttgcactcatgcccctctcaagatattttttaaataaaagggatctctcattttgttttataaagtaaaacaggaattcttatgccacacagggaggggattaggttagggtaagggatcaaatcaaatgtcgtggattgtgaagaacagatactgggttctgaggcatggcaagagcattcccaacgagcgaggcatcatcgtttcctccatggtttgctttctcttaaattaaatcaagtccaatctaataatattattttcttagttattgaattgaatcgcattggcaggagaatgggactctccccgaattccaattggcctccgacggtgttcatcaggcccaactcgctgcacaatcattccaaaaggtacctcaactcaattttcaatttcaattaaccacgccaccctgactgcgctgcgcaggaactagaggccaataatatcccgcttgctaacgtacgcatttgctactcccccttttcaagaacaacccataccgctaacgttgttgcaactctcttgaatctcccttttgatggaccccactgtaaggtaagcccttccaacaacttgcctctttatttatccctcaatcgagtctcatttactaagcactaagcaggtcatccaagatcttcgagaacgctattttggtccttcttttgaactcctctcgcatgataaagtaagtcatgctcaatgcccactttgttctgctgcctactgttttgccaattcaccttaatttttaataaaataaaatctctttctctgcatctttttttgtcatagagatcttgtatgtttggaacattagtcaggttcaggttctaataaactctatcgttgtcactattctcacaccaactgtagtttgcaactcattgattacttctttccaatcttcaacagtaccaagagatttgggatatagatgaaaaagatccatttcttgggccagaaggaggggaaagtgtcaaggatgttgcttgtcgacttgcaactgcaatggccactatggaatcaggatttcaagggtaaagtcttttggtattctttgatttttcagcatgaatgtgtgcaagccctgcatcgtagttttgttttcaagttgagtaaattgattttgaacttttaaaacgtaattggaatgtgtatcgaaagtaatcccaaccatacattattggaaagtgcaaaaattgattttctaacggcaaaacaaacaggtacctagtaggtcttccaccagtggttgattgagatgttcttattttgttctttttattcatattctatcagctaatataattcggttccacatcttgcagatgtgcagttttggttgtcagccatggagatcccttgcaaatcttgcaaacaattctgcatgcagctaatgaacacaaggaacccacatataatgacttagcatcaatactgactgcagttcaggtggcaccaatcttgtcccagcaccgcaaacatgcactgcttactggagagctcagggcagtcatttgagatgtcagacccctatatgatttcatttcaaaatacaaacacctccccagtcatttttttaggaacagggatctaaattcgttttgctccctattccatttattactttatagattatttagcaaatacaatttcaatcaggaataacatgacatccgatagcaaataatcattatcacttacacgtcccattatgggagattctgtgtaattctcgattgaatatacgggctggcctgcaaattaaatggtccaaaagtttgtcctgtgtctgcatggcctgcagggtaatgagccattctgtggtccaaaattggtttttagaatcgtagtccgtgcgggctcagtctaagcagttggaccacgagcctcagcccacattccctgctttcttagtgatgtcttctttcacacacttttattagataatgatgtttagattgatgataaagaatgaaacaaaatgaattgaaacataatgggatagaatatgttggattaaaatagaatgaaacaggtgttattccattcgagcaaaaattgtgccttgtctatgttgggcattgtcctaggtgtatattcttagaggaggataatcttggactgttaactttaaggtttggttcccttcattctcaccaagaacttaggagtgattgtggagaatccatgatgaccttcaaaatcatgatggaataatgctcgttctagagcattatgaactttttgaacattataatactaagtcatttaagaagttattataatatttaaattaaatgttataaatataatacataaaaataatcaatagtttcaattgaactcaagtatatagtcttgtatactatgattacttaaatcgcaattaattaaattaagtaattaattcattttatgagaaagttttaaatttatttattatacttaaatcaattcaaacaaattaatacaatcttttttgtaaaacctatttgatttatttatatttcaaaacatcatataatagtcacttttaaactttgatgattattagtttaattaacttttaacactcaagcttcacatctttgtagttgtttttctttaaaaataaatatcattacatccaacgaaatatctctattgaaagcttataaattaaatataaaaaaaccacctcatgttgtactagacattgtctctattagtaaaccatacacacacatgataatgagaatttaatgttcattttgataataatattgctaatataaataaaattaaaatgtattactaatgaaacatatacatattttgatattaaattttaattaatatttaaagatttctattgaaaatattatatttatgtaaccttaatagatgaaaaaaatatataattaaataatatgaaatgaaaaaagattaaaaaaatagtgaaatgacaagttagttaaaagaaatgattgaaatgaattatggaaataaggaatagaaaagaattaaaaaaaaaaaaagttgaaaagaagaaaccgccagaggagttgcagtagtaaccgtgaggcaggtacataaggaaatgcggttccattggaaaaggctttgattgaattgaggaatgaagagggagtctgattgttcccggaagaagcagaagcggaagcggttaatggaggatgcaggagggtggaaggggaagacatcattatggtcagagtcagaggcacgaccctgcacggagtgcggcaagaagttctggtcttggaaggcactcttcggccacatgagatgccacccggagcgtcactggagagggatcaatcctccgcccaatgtggtgaggagacaacaacaaatgagccaggaagaccacgaggtcgctgcctgtctgctccagcttgccaactccaactccaacgccaaagcgagttgcaacaagcgctgtcactgggactcatcatcttccaattctctctctgtcctcactctcgatttgaggttcccactctagactacactctctttgctctccccctttatccctaacttctctcatttccttacctctacctacttttccaatttatgcaataatcgcatcgatctattcattctctctacattttagcatgcaaggacacttatacttttcctctctaattctttctttcttgacaaatagcatgtcggcttcattctctcctattatttatccttcacaacacaccatcttcattttctatttataaacatttatatctctatccatgattttaaaggcatttgttaagtctctttttactcattgtgaccacatgccaattacaattgcagtcatttcagctccattttcttgcaataatgaaactccaactgcgactattttaaaaccttgtgcgtctccttcgtagtacttacaaatatgaatctcctaataactagaacattaacaataattatcaattcaagatatgtggatgtaacctttgtagtttgtattgtaccatcgtcatttatgttcaagtttcatataatatttaatggatacctgagaagttggtctgcttatctcccaagtggaagtggaaatgaagttggacagcttctctaagagtatattttaaaagatcaaaaaatgtgcatgcccagcataaacgaccattcgtagtagtttaggggaaactaacagtagacttttcgaatggatcaatggatggatggaacgtacgagcctattattttctattgcctggcgaaatctcacattacttagtttcgtattaaaggtattctattcaactgtgaattattcctatcattctgcatcttattttcacaagtgcaattcagactatatttggattcacattaagggtgaaatacgagtatataatggaattaaaaaataaaaacaacaattaagtttcattatttaatttgtttaaaataaattaaaagaaatatgataaaaatgcattttgctccatttcatttattatttcttctttttcttccatcttaatttgaagggaatggaatgattttttttttttcatttcattataaaaatatctaaataataaaacaataactttatttggtttcattttttttaatgcaaaatcaatccaatgtaaaaaaaaatggtcaacacacgtcaactctttctttcatctcactttcactctatgcatgtctctttctatctgtcttcataagcaatatgaagcaacaaaaacttacacatgatcataattacattacaaacctttcgtaaattaaagaagtacattacaaatcattaaaagtcaagttagtcatacattatcaatgttgacatttgttagttacattaatgtagagtcacccatctctacttatgactagagaacgtttgagtttggaataggtgcaaaaacaatgataaagtgggcgtccacggtccaccccagtgactcactgatcaacaaccttcgtaaaggactaagtgtcacaaggacataatcatacatgtaaattaaagtattaatagtaaaaggatatatatgaatgactggttgcaaacgtgattatatatgttggtcaaggactgcaaaattgaagttaatcaaagtcacttgaagctagcccctagacttttccctcactcgccaaggattcaatttaccacacctctagggatatctagtcatatgcataccgtgagtttactattaatagagaaaaattaaataaagtaagaaaaaagaactagggagagcacataggccagacaaggaagatagactttgtatcataaaatgtgaaactttacgaagatgatcgaagtcttgaacgtttgttgaacaaatgaataatgaagagaaacgctcttggaggcaagcctggtctcttgagaatggaagaagtactgtgaacaaaagagggaaaccgaagaaaattaaaaattctgaaagaatttgaaatttgaaagattaaagtgcaacaaaaaaactgcaaattaaatagccctttttcaaagcaaatacaagatagggacttattaatattttcatcagtgtcattagttgttgcatatatatatatatatatatatatatatatatatatatatatatatataacgaataaaacaactcttaaatatgcgtcatagtgaagccagcctgaattaaaactcaagggttggacaccaataacagtgtcctacatgcccatgcccaactagcattaactgtcacccaacaattgaaaaggtaactcaaatcattataacaccgatgctcagatgaacaaaggtttattactacaccatgattaacaaaggttcaaattttaacatgattgaactaatgattcgattgtcaaagcaacaagagttctttactagaggttcagatgctacttaaagatcctagatgacaagtttgtcacgtttccttatcagcatgccaagtttggtggactcttgtttgaggtttacactattaggccaaattcagtatgatcaaacccaggatagttctaaccactcaaatcccttatagggccgggactcgggagacaaatttaaggcctaatacactattcaaagcctacatgcaccacatagtgcattttataattatatgttcaaaagcaaagtatcctcatcacttgttcacatacttcacgtacgtcaggtgtttcatgatatttttgttaaaagggctcactctctattaggattatcagatggctgatgagctcgaatggcattattattataactcacctgcatccgagaattataaataaagtatttttaatatcactagataaacattctattccatatattgtcatgttgttgatatacatactaacttaaatgttgtgtgtctttccaagtattcaaccttgcttccatgctagatcagtatcagtgtggtcactttcatcaacctagctaaaagacttgaggacatcatataaaaagctgaagcaatgaagttatttcattttgtccgtttatttattatcatatatatatatatataaactgaagcactgaagcaatgaaggatacgatatcatgaatagatcgtttcgaatctatagcccaaggaattccttggttttgaaggtataaacttgagcgtttgatttgataatatagatctgcttcaaatgtatttaattgttgtaaatattctacccgcttcatcttacgtccctcataatatgatggatttttcaattaattaaggaaaaaagattaaaaagtaattaaagaagggaaaaaatacaaatgaaatcaatcacgtagagcaggatttcttctcactaataaaatacaattacaaaggatcagatatctaatgcagatgcaatacggattcattaatatccatcgcgggacccattaaaatttctatatatatgggaaaattaaagaacaatgacatttgcatttaaaaagtgtcattcagatatttgagagaaattgaataaatattgtttgactttcaactcaattaaaaaaacagaggaaaagaaaaatgccattgattcaaatttcaggttcaagatcttaattacttgacgaaatatgagttgcttaataactaatacaactgagatcatttttttttgcgcatgaacaagctagtaatatccaagcttaaattatttgaactttttttataaaaaagattattgaaagtttccaaaaatccaaagaaaagataatagaagtggggcttcccttattggtagaatatatttatttcagggtggtgccattaaatcatgcattatgcatataataaattagtagaacttcatcagtttttatttaaattatagactatagaaatgagtctcacataaaattgtttcttgaccaaagcatgtatagactgggctcgattatttcatatacagcagcaccctttattaattaatgccgtcgaagatgataactgaagaagcgattaaagcaaacatctaatattaaataataacgggatttggaaaaattggtttgaatcaacggcgtatgttagtttatgggttggccagaggctactattctactgttatagctaatgaaaaagactatatatcaaacaataagatagagagaataaaagataattgttgataagatccctataagatatggaaatccataacatacatagcgaaactgtatctatgatttaatgcgagaatctaaagccttacgattgcctatctcgtaaccatgcatacttatattacttaattaagcagatccccttgacactgattgccggcatgctcaaatttagtttaatttggtttcctgttgatcagacatgttccattgcaatcaaaagtatttaaatactaaactaaaattgtgttaatgtcaaatctatagtttctagagcctaatatctctatttcgctacgagggaatttggaactcgaggaaaaacaactcaaggagaagatcccaaggaacctcgtaagcaccttccagtcgatctacaataaacttgccattattttaattttcttgcttttccacatggacatatattatatacggagaccataatcatgtatttcttggtaaaaaaaatagaagaaaggattgggaaagaaatagaaagatgttaaagttaatttatttagttttatggtcagtagatgttaaaagaaatatctcatcagagaagtaacatattgaaaaggaaaacgttttaagaggtgttataataaaaggttgtccttttattttaagatgcatgtttataaaaaaattaaaaaaaaaagtaaaggataaaaaataattatatataatatcctacatagtgttaatgttttaagtgtattataaaatggttgtgttgccctctctattaaaaaaaatgttatgttgtgtcaagttcaagtaccgattctaagcattagattggcattaatttcattcataattatatttttgatgagattatgaggcatattttgacattatatgtatcggaaaattcaagcttacttctatattaaccaatgagtagtatggaaaacattagttctgacaaaatagctccctgactgttcattgatatagcaagaaacatgtatacgttttcattgaaaagtgtcatgtatatactatataggaatgttaaagttaacagacttatgttaataacaggattaatatgtactttttgtatatttgaaaataaaatttaaattttatatttttcaaaaaaataatttgttagcaatatgaattaaaatagtatttatccaattaaataatgtgaaaattaccagaagaggaaaacaagtgggttgggtgtctaaatttcagttgtaatccacagcatctgactgggttctaacgtcagtgaagaaaaacgataggttacatgtcaaatcattgaaagatgcaagtggacgtgtcaatcgcaaaaagaatatcatcattaaacgtataccatgtggtccattattattattattattattattattattattattattattattattatggacttcaattagtttagattaaaaatattattaatgttgattattatgttctgataaaaataggaaaaagttatgggtgaaagacaaaattaaagagaaaattaaacaaaatagaaaaactaatagtttggataagtaatataatgaaaaagaaaaaaaaagcgaaatgaaaatgatatgaaacaaaaattaggtatacagatataataatctaatcagaaaacttggatacggatcatgcgtacattcaagagaagttatactgtagtgtgtaagaatgaaaaaaaatagagagaaaagacaacgaacattttgttgtatattttgttgatatttaaaaagattaatattttttaattttcttactgaaatatttttatttaaatatagaaaaaaattataaattaatttactacttattaaaaatgattttttttgtttgacttgatcaattagactagttctcactttatttttaacttggtcttaggtaattattctcattaaaaaatcttactagttttgttttcccaaattttaaaattttccttttttcatcttttaatttgatagtgtaaatattttatattattatttaattataaattgttatatatagtaaattaatttatttttataataattattgaggttttattttttatgattttttaaaaaaaattagatatgtctactatgttttgcaagattagctaaaataaaaataaaaaagctaaaaactgaaagttaaaaactaactaaaagttaatattaaaagcttgaaagtgaaaattgttatggtaacttattaatttataagcatttgataaaattatttattgaagtaagtgttgaatataaaatgacataaatacacatgtttgcattgtatttttatataaattttacttttgttattaaaaatatattttgaggtccttataattttttaattttaaactcttgtaatttatttatcaattacttttaattattattctatctagtctcaaatataagaaaaaaatatcagtgtatcttagtcttaaatgtttcatatcaagtttcaataaaggtagtttagaagaaaaaaaggtttatttttaattgtgattgacataacttaataaatttaactagttttcttaattttttttaaaaaattaactaattttcttaataaatatgagaatagttttattttattttttcttataattgagatagaatggagtgtatttttttatattgcatattttatattcatctaatgtaattatatatcttaaaatattttctatcaaatgtaaaataaatttaaaattttatacgttatttcaatatacatcatgtttttgttatattaattagtttaatagttaaaatattttgaagttaaaatttaatagaaaaatattataaataatataatgattaaaataaatagtataatatcaaaattatttcaaaaataaaataaaaaataaatttatcatctagtaatatcaggaagtatgatgcaaaaataataaaacaaatattgtaattagtataatgattaaaatagtgtaatataaaaatataaaaatattaataataaataaattaactcattatctatcattatcaatatgtacgtaataaaaagataaaataagaaaatcatatattacgtaaaaagataaaagataaaacctatcttatgagtgcaaaagttttaccttatatacagaaaagaataaaaaaatattattaaatattttaagaacaacgaaataattaatatgaaaactaaaagttagacattaatattttaaaaaagtattacttgcaagttaaaaaaaaaacattgtagacttttaaaataatttatttatcaaacattaataataagatcaaataaatttttaaatcgacaaaaaaagtttttaaaaaaagcctatgaaatgacgtgctaatcataactttcgttataaattgattttattttttcctacagtagtctaggaattagacttctaaaataagtgttattttagattattttataaaaattaaaagataaatgaaatagtatattaattttataaaattaattttattataaatattaaatgaaaaattaaaatagtatttattagaaatattaataaaaataattaagattacattaaaaagataatataatacttattttagaataatttttttctccatattccaaacttattttggaacagcagaaatacttgtttttgtttgaacttacccttatcgtaatttcctgaattatacttctaatagcatgtttggtttaaattcacttctaacgtaattattaaaaaatcacaataatagtgaagtaattaatagtttctttaactttttcaccatgtttatcataattttatgaaccaaaattaattcttatttatcgtccaaacacattactttaattattattttttattctctgaagcaaacaaagcatataagtcagccttgcattaaactttatcgcaattcaagaaagtgattcgcacgaaattattcattgtttagttatttttggttgtgatttgtgagtgtaaacagaaagacaccaactttgggaattcaattacgtgtcaagaatatattggagtatcaagtatcaacagtatacagtaatatccaccctctttcctccatcaatatcaaacatcaatcattatgattattatattattaaatactcttacgaatttcgactaatataaggttatgctttccgtttactatataataatactaacacttttaaaagtaaaattggttgaatgacacttttctatttaattataatcgatagatgtttttttaatacttattttattgtcatccaaatggagttaataaatatttaatgaatgtaaaatattattgtattttagactaaaatatctttatttaatactttaatctatcacgcatttacggttattaacgtgaaataaggatatatttgaagaaaaaaaaatattagattgtatttctaaaacataaattattttgtgataaaaaggtaaatatgcatatgaggaggtagtaaaaaaatatttaatatttatttaaataattaatataatttaatagtatgtcccaaaactaaggattaatgtattcatacaagatcacaaatatcaatccggattggaatcaatcttcctatagaaataatgaaaaagccaacaaaatttgcttaattgcataaatggccaatatttttgtaattatactaaatagtgtatcaatacttttactcaaacttactaagttttaaatctatcacaataagtacattttctttaatataaaacaaacaaatcctaaatcatatattattcaaatttcaagatagtaatttatattttcctataaataattttggaataaatcgagtcacgtgcgaatctacaaaacctattcatttctaaggaaaaatttaatggagaagatatattgcatattttcaaaatataaagactttttttaaagggttaatttgcattttctttctaatataatagagcaattttatattttaaaattaaaatatttaataacttcttattcgcatagataagtcttaaagtgagattatttttaaacaaaaaataatactaaacttatatattatgttatctatgatacacgtgttagtaaagtacatccagtttatgacaaactatttttgtttctcgccaaaatgaagaagcggctcaatcttttaaactctgtaactataattaaattttaggtaaaatatatttttaatttctgtattgtccttgaatttttaacttggtcaacttgatcctaagttttacaaaaagcagtagattttgtctctttttatagtatttgtaacgaatgataaaaatcactgttcttttaaagtacaagaactaaattgctcaaagttagtgagaactaatatcagttcaattttattcgattgtaggctaggttggctctacgcacatatactttaatttcaatgcgttaatactgtattttattattattatttttgtgtgtgttcttaatgtgctgtattcctgttgcactagttctcaattcatttttcaaatatatttttccttctctttatcatacaaatttttatattatttttaattcatcagaaattgaaagaagaagattcgtgggccgacctatttgttaaaagggatttctttgctccgttcactaattagtaattactgtacatgcgtaagcgcattaacaatgacccacctcgacaaaaagtaggctaagctttcttagtcttagttaaaaataaattcttttaataattgattgcgtcaacaattgattattaatattataactaattatattaaatcaaaattatatttaaacatattagggtgaaaagaaaatttaagaaaaaagttaaaatatgttttaattactatatgtaaatataattatgtttaatttttgtcctccgatttttctggttattataaacttttaattacttaaagaaaataataattgtataaaaaattatacaacaaagtgtacaatcaatgaaccaacagaaataaagagaaatactttaaattttaaatttaataaataagaaaatagtaaagatagaaaaaaatgatgttgtatagtaacttgttatatgaatttttgtatttgtatcacatctcttattgtaaaaaatttgtgttatgttaatttatcgggatattgtaaacaatagtaactccgatgaaatattgagattgatttaataaacacaaatacacattaattagtcacacacacatccactaaaagaaaataacttttagcaacaaatgaattgaaggttgacatttaaaaagtgatgagtcaagtactttttttttttttttatcagtgaaaaagatacaaagccaaagcacagaaaaacataactaaacaaactaattgcctctagggtacaagaggaccaaaacgcgaaaggttctaaactattcgactcaaactttgctagccagttagagtgatgagtcaagtacaacgattgataaattgttaatttagtcattcttatactttataataatatttcaatggataaatttatttcaattcattgtaggactaaaaatttccttttattttgtaaaaaaaagttttctttggtataagttatatataaaaaaatattattcaattttttatatatattattaaggcttaaatatgttttttaatttttaatatatacttgaattttgcattcgctccttaataatttttttcttcgcatttgctttctgatatttgaaaatttttattttaaatctctgccataagttaagtaatgacatgttcattagctattttgaaggataatttgtggtgtttttaaaactaacagtagttatttatagaatgaaattacaacttttggcggtatggtttaaaaaccaatagaatcaattaaagtaataaaaaaagctcacatgcaaaagaggccaccttcccttactagtgtggcaagttttgttcccttgagatttgtatcaacaaataaatctctatctagaaacaacctcatatgccaaggcttctcccttaccactatctccaacattgagcaaaactatctcgttgccgttgtccaagttcaatcatcggcatcgagtagaacctccccatcgacaccactcaggtttagtccaatgccaagatcatgatttttcgcctcgaaacctagatctaagacatcctccaccgaagattgtatcgctttgtcaccttgcatccaatatttaaattggttgttcaaccttttacattccctctaagtgtatttctcttacgtctattatggagttccccttggatgattgattggtcgctattaattgaaatgaaaacaatgctagagtgaaatactaatctatatgggtagcatatttggtagcagaagtaatttttatgatccagttgcccattttatgaatggagggatatggattaggccgaggaaggagtcattgccaaaaaaattatttgatttttactttcattgattttagcaatttttaattgtcagaaattgtaatttaaattttgaaatgaattatgatggtttctagagtagtcacaaatcgtcttatcaaatgtttaatggacatgtcatcatttaactaatagtatcaaaattgttcaaatatgaggagcaaatgcaaatattttttttttaagaaacaaacactaaatttgaacatatattagggatcaaaaatatatttaagcctattattaatatatgtcaaaattaacacaatatatattaaaaatggaaaaaaaaacatttcaacattcttgttcgaattgtacaaggtaatatgtatttttgatttaaaaaattatattgattaaatacataatatataaaattattaaaaagtgaaatacaaaatttcataattgacatatttatctatgatatgtatgtatcttaggatttagaagaagtaaaattgatatccattatgaatattaaattggtttgctttcattcttcatttttctttattataattttgagtaaattatgcatgtttcttttcatgtttaaggaaattatatattttttttttaacttacacatatttcccatgagatttaaggaaattacatatgtctttcttctgtttataaaacctacacaaactcttaaatgtcgtctaaatatttgacaataataattcatgtgcgttgataattttgattaaaaaagactaaaatatttttgttgtcctcattaatatgaaaatgttcagacttcgttactgcaaaacaatttatctatttttcgtactcacaaaatttaaatatgttatttttcccccgaaactaggttcgaatacatgtatgttgttgtaaaaggtgttaaaattttcaaattttttaaatcacttatatgtatacacaatgtaaaaaagttgaaatacaacactttttacaacgacatatatgtagatttagatgtaaaaaagttaaaaacctaacactttttatcataacatacacttaggttcgtatatattcaaacctagctctaagcgaaaaagtaacaaatttaagttgtgtgaggacaaaaataaacaaaaaaattaaacctagctctaagcgaaaaagtaacaaatttaagttgtgtgaggacaaaaataaacaaaaaaaattacagtcacaaattttgaacatttttatatttatggggacaaaaaatatatttgaatctttttttgtcataattgtcaatacatataacttgttattgtcaaatatttaaatgacatttaggaataggaagatttgggtaaattttaaaaacaaaaataagacatgtataattttcttaattaaacataaagagaaacatatatattttgtttaaatctaaaaaaaatatgtataatttattctataattttttatggtgatttgtaatagtaaattgatattcaatccttatcagaggcaaatatggttatgcagaataaagaataaccgagttctaatgtgtaaggatgacgagaatatgtttgacaagattttttttttaaggttatataaaaattatttctgatataattaattttaaaataattaaatttacttaaaatatatttaaattaacaataattatgaattatatttaaatactgtacatattttctatcaaaaacgtactgattattattttttgaacgataaaacgtagctttcgcaataacattgaaagaatgcgattacgaattactgcgagctaagaagttatccctgttgtatatcccgttggttgaaaagtaatttaaactctattgtccggctggtcttgttcgtacggtgacccatttcacgacacatgtcagaattatagatccttctccatatatgatttttatttattgtttttatacatgtaaaatttatttacaacgtcaacagttcaagctatagcaaaaagtactcagctcgtaggtggagacaatctcaatattatattccaaatgctagatttttttttcttctttcatgttacaatggacactgcttgctactgatcaattttatttttttattatatatatatatatatatatatatatatatatatatatatatataaaatgatcgcacaaagttagaatctattatttcatgtatattgttttaatctattattatataggttgatcctagcgagtttataattaaggtattttgaatctatgaaatgatttaaggaataaatataaatatattatttaatatgatggaggaaaaaaaagaaaaatgtcctaagtatcatttatgattaaaaatgtctctctaaggttacattttctgtttatcataaaaagtgtgagaaataaggttacgtttttttttttttttttttttagaaaaaagggcccaagcatccatgttgatggagctagccagccaggaattggagatgcatattacgtcaatgaattcaccaatgaaacagagaagaatctttttcaattttcgcggcctcaacttggacgttagaattaatatattatgacctttttttttaattaaaaaagaatctaagaattccgaatcgacgaatgaagcttaagtattgttgcgatccacttgtatgggtaaaattgaatgaagcataaatttgtttcggcgatgtggtgccactttacgcaatttcgcatctctggtttgctgtaggattggcatgtggcgcacaagcatggtcctctctctatatattctttttgttttggtcataagtaatggtgctgtagactgtagtgcagattcttcatcctaatgatctcccactattatacagccggtcatgcataattatatattaaatattatacatacaaagaggtgccactttagcttacttcaattcattaatggccagacagacatccctagcacccccacactcctgtcaatcattttttttttataacaagtaaggtacttgctttgagttttctttagataataaacaaggtacttttccatgtatttacggatattttatatttaagtaaattttaaaacaaaagtatttaaattggtaaataaaaaatgtcattattttatattcaatatgtgataaaattatgtatcttaaatacaataaactgcgaccaccaaacacattagttaattgatgtgaagttatttcaacttaataagagatcttgatgagttccagtattaaatatataattgtgctaaatagttaaataaatgattttattatttatagtatgtgatcctatttgactcgaatgtaattgagtctaataaaaaaatatctatgattgatctagacagaaaattacaataaattataataatgtattttcattactataacaaatatcttattttatattagtgttcatgttagaaaacacactttgaaattttttccaattaaaaagaatcaagaaaccttaatgaaatctattctacttaacttgagtgtgataatgagaatatatcacacctatttatatcatgtgttttctaatgattttgtcatcgttttctacttacatatatacaaggagtgatgggtatcacattactcctacgtaagtgtataggtgtgtatgaccccttactcacgtgataaaaaggttttaggatagcaaaattggtcctaagttctttgcattcatggcataatgattgtttgtcttgatctgggtcatctttaactctttaaggattcagccatatgcaaggattcaacccttaccttgtatcccagtctgtgtgtatctaactatagacactataattccttaagttttgagtttaaaagacatagacgcttgatatgattaatcaacttggtggaatagtccaattagatagaaatacataattaatgagataaaaaatatattaaaaagaaaattatgaaaacaattattcaaataaaacacaatttctatatctattaatttaatacgtgtccaattttttttaaaaaaactttatttcgattttatgtgaaatttaaaaatgaatttaagtaataaattttgaaaggaataaaaaaaaattaatacaggagaagttatgtgatttagcgaacatgatgaatcttaaaaaacctttattcaagtgaaggcttaaatttataatataagaatatattacataatatatttttctatgaaaaatatctttaacttataaaaaataataaactaattttttccttgaaaacttgtaaaattatatttaattttattactttttaagtaaaaaaatacttttttattttaaaaaaataatctcaaagaaacatacccagtaacttgaattcatctctatatgttgctttcatcatgagaatgacttgatcttattttattttaatttgctgggtgttgtttgtaatacaggaagcagagcatatagtatatagtatacatgaaggatataattgtataatttacagcagtgataagcaagggaaaaatatgtatatataaataaataccggacacggtgagagatgtgagactgagggggcactctctggtttttgcttaacggtgggtcctactgaaatagaagaaagaaagagtttccattccttttctggttattatataagaggcttgtcgatcggtcgcatgtcgagtggagctgagctgagttgaggtaatcatattttctcatcaagcaatcttaagtttaaggtgagttagcacttgatggctcctcctctttctgggtgattaaacttatataattaagtgttttatgaaatgtaaaatgataggataggatcgaggaagcatggagatggagtatggcgcgtttgggagctggtcggagtgtgaagaagagttgattgaggagttgctgggacaaggttgctgggtagaaacgagtgggagcagcgaggccatgcccatggggaagacatggtggattggaccaaaggctaatccagggccatcttcctccgtcaaagacagactagaggctgcgctggaatacttgagagaatacacaaacaacaacattcagatatgggttccactgcggaggagcacaggccatgaacatgggcctgggcctgggcatgggcctgatgagtcggcttcgattgcttttgaaaggaacatgaaggtgaagcttcggttctttagaagcaacgagtacccttatgagggatgtgtgggggttcctgtattggaaagagggagtgggagatgcctgggtgtcctccagattgaaatggaggatgaggtagttggagagatgatggaggtggtgaggtgtgtgtgcaaggcgcagaaggtgcctttggctctggcatgggctccatgcgtccaacagcaacaagccaagtcctgcggccattcaagggatgagaactacgtgtcgactgtggagagagcgtgctttgtgggggaagggcacccccacctcttgggcttccaggaggcctgctctcagcatcaccttttccgcggacaaggaattgttgggactgccttcgcaacagccaagccctgtttcgccaccgacataaccgccttctccaacgccgaatatcctctctctcaccacgccaccctctttgacttgcatgctgccgtcgctattcctctaactacttccactgcctcttttcatttcgtcttggagttcttccttccccgagacttccctgaccacaaccacttcctcaactctttatccattctccttcaccaagcttgcctcgctaccttccatcttgctctcatccaggatcatcatcatgtttctgcattcttgcccactgaatccccatctcaggcctcctgggttgcacacatggtggaggcccaggcccaggcccaacacaaaggtgtgtgcgtgtccttggaagaagaacccaaagaggagttcaaagtcaccacaactcactactgcaactgggacagtactgccaccagtacttatgaggcacatgaccaggtcgtgtttggggaagaatctcacactcacacacacacatttggtgggaagcgtggcagaaaaccaggcgagaagagacgaaccaaggccgagaagactatgagcttggccgttctaagacagtactttgcaggaagcctaaaagatgcggcaaagagcattggcggtgagagatatgatccattaataattgcattaattctttgtctctctctactctagctcttgtttaatgaatgaatgaatgcatgcatgcagtgtgtcccacaactctgaaaaggatatgcagacagcatggcataacgaggtggccttccaggaaaatcaagaaggtgggccactctttgaagaaacttcaacttgtgatcgattccgtgcagggtgccgagggtgccatacagatcggctcattctacaacagttttccggagttgagttctcaatcatccaagtccaacaacaactcatcttctcctacagcagcagcagcagcagcagtagcagcacaaagccctcaacaacccttgagagtgaaggctacttttgcggatgaaaaaatccgttttagcttgcaagcacattgggggttcacagaattgcagctggaaatcgcaaggcgcttcaacctaaacgatgtgagcaacggcagcaacgtggttctaaagtatttggatgatgacggggagtgggttgttttagcctgcgatggtgatcttgaggagtgtaaagacttgcatacaacatctcagagccgcacaattagactcgccctctttcaagcttctcctcttaatattctaccaaatacatttacttttccccacaccaccgctaccccttcttccaccctaggcgtttctttttagtactgtaccatcacatttgcattaatttctgctttgcttttacttgttagactcattttatttatatctattacttctacttaatttgttcttcaaattctaacattaccttatctacactttattcacaaagctccatattagttgctccatccaactatatatctatatataacccaaatttatattcatataaataaagtaatcccgctgcattagattgtttctctctcctaatacaaaggaaatgatgtggggttggaagggacttaagtcggctcttgaaactgtttgcggctcgatttcttaaagaataatgattcaataaactgaaaattttggaagggaattcaatttaatttttacatgattgccatagaatcattgctagtgtgtcgttaaacttcaacgttatgacatatttgattaagagatgctagcaatatattttcttatcacactctattaaatacatccttctttattattggttgattttattgaaaattacaagattttatgagacccacttaaagtataatttcatatttttcaacaaattttaatcaataataaaaagtatgttaaagattaaattttaatcaataataaagaatttataatttcaaatatattttacttaaactttatagttcttttaatccacgatttaattatacatttaatattaatatattacgttagtaaatcaagttgacctattcttatcccacatatcttatttggtcttcatcatgttagatttgggttcacgcataaatgatcctaacacaattttaggtaggctagtaacaaagatgagtatgtacgttgtgagtcctcattttcaccctaccaataatattattaaattatgaatattatgctatttttgattaatattacttaatatgttatgttaaaaaaataaaatataatattttatgaggattaaaatcaaaaatttgaattttatgaagattaaaatgaaactttaaattttatagaggctaaaactaaacttcaaagttttataaaaataaaaatatttttttaaaaataaaaatgaaaaagttatttgacacgtgacaatcatatcaatgtgctaaacatttgataaaaattatacattttcttaaaacaatattttgtattttgagggataaaatttgtttagggactaaaatcaaattttcaaatttttagatggacaaaattaatttgctataaatattttttgaaaaaataccaataaatatgatttaatttattatattaaacatttagttttatttttcagttaagttattttaatgaatatataataataataataataacatagtatgacaaaaaagagagaaatagatataaatgaaggatgtcaataagatgtatttatattatttgaatgttcaaatattttgattttataccgcatactaaaaaaataggtgaaaaaatgaaacacgtcatacattgcaaatagcttcactgactactttgttagagccatttattagaaatctgaatggaaagtgaattgttagttgatgattgttagaacacatgggtatgtttgttttaccgtttggccactcaaacaaatgttcggccttcatggaacgacatacatatttgtttagcaatttgaactacacttgagttgaatgtagatctcatcaaaatgagaccgttctcctcaaagcaaccacatatagttcctttttcgttcaacgtgtagtgatatcaatactaaagacaatttaacagcgccataacaaatttggtcacgtaatttttatcatgattaaagtaaaacaatcctatataagttgattttcttggtggtatcctcattgtttaagaatgataacagtagccaattaataataattaaaaagaaacaaaagtatatgaatatttataaacgtatatttgcttcaaatatcagcaaatgttctcggaattatatacacaccaacgtaactgatgatcaaacctaccaaacatcagaaattacaaaaaatcagcagagtttctccgtgaccatgttcagatacataagcaatgaactttctcgatctaaaagtcaaacgaaaagataatattaatcctctataatcaaagcaaattttcttgttcattaagtatgtgatcacgtagttaaaatctaactttcatctaattagaggctgttctgatgaagcagaaggcatgtcttctagctgctccttaatgactgtatatcttaacggaggaccaaacaagctcaaaaccacctgaaaaaaaagggcaggaaatgtgagatgttttctaattagttattgtgcacgtatattttttgggaataaaaaggtatagtgtagaatcccgacgaatcacactagaaagagagatccgaaaactgtataggtatgtgactgtacaattgaagatgacttaaaaaaattaattggtactatctataccaacaagatgcatctatttttcggtaacccatcacttaagaatttcatagttaagcgtgcttcacttggagtagtaatgagatgagtgattttctgggaaattttccaaaaagcatgtgaatgaggacaaaacacactgaaaaatcttgtattggtttgtgggatcagtcattgatcttagaaataaacagaactcattttcgaggtcttggaaatggctacctacggagggttctgattaacaaggatgttgagtgaagtaccgtaatgtgagagtcgccgaaaaatcgaacatcagggatgttacatataggggaaaggtaggctgtcctatataaggtcaaaacataccacaagcctcagcaagggcttacagtggtgctaaatattaacagattgtccaccaaagaggattgctggcagtaggaattgaacataagccgtataggtaaagtgctttcattcctaccggcagaactaatcccagtggggattgtatggattaatgacaatgtcaaacgtgtaaggcttgttgaacacattgtgaaattgaatgccaagtgtgaccaacaattaaaactcgcaaaatggaatcgaagcaaaacctatttcctgacgttaatgaaaagctagttatttatactttatagagcaacaccaaacaccacaaacttacaggtagaaacacaagaccgtgtaagaagccaatgagaaccaaggccagatacatctggaagtaatacacctgcaaagacccaaaaggtactttaacatttcttgagcagacaatcaagtttggagccaagggtgatatgtcacataccacaaaaatttctgatgttgagaagcaaaggacgaggactccaactaattttgtaagtgtgattccactaccaaacaaagataaataatacaaaaagaaagtgtcaacaaaataatagtgcaggcagacactaataattcaaccacgattcaaatcatttttgtaattagttataaatggtatacctgcatcaattctctgacaacagatcaagagttatatcaaagctacactactaaataactactataagatgaacttttaatcatgcgcataacatttcatctttgctgaacctttagggttaagacgaggaaaaggggaaagaacaaatgatggcaaacaatgtattttgagattgataataagatgtcacacacaaatacaaatgcacctatttataccattaaaaagaccgagttttagaactaccagtacaagcccaaaccctagcctaggcccaccactaacaaccttcatatcttttaatattctccctcaagcttatgcttatgttacaagttgatgcacaaattcgatacgcatccaatacggtggttactgtggttcaattattttaaaacatataggatacgatacatgtaaaaatacatatttagatacatacgaaaattacgtgatctaatccaaaaacttagaaactagtgcctccctcaataacaaaacactggcaacatccaccttagtggccctgtcaacctataaacttgtttccaaaataataactatcataccaccgagtaagtggcctctaactgggtttatagtatataccacccaggaacacaaacaaggtcctcacctagaacatcatatgggtaggcattgtcaaccggaagtcctcaagttttgtcactctagtgatatggtcaaaatagtgtatataattagggggtaatccactaactgatagcaacgctgctattacagagaacaccagcagaccaacgaggaccatcaagaggtcaacacacctcagtgactacaagtaataccagcccagataaagacaaagcaactgaatattctcactgcctcatccacaaattcagcatctaattctgttattttctattgcaaaggggccctgattggccacagcagatcctctgcatgtatttatctttaaataccattcagtgaatgagaataagcagagacttattatcctatttactccatttatttccttacattagaactgtagcctaacactaaccctcaccttacaacctggttttgagatagaattaggcccaaactcaaaattctaagatggtacaagagtctatccttattccattattgggtcacctaccatattatccacccatcaaacccaattctaacatggtaacagagcctatagtgtaaacctaaattttaaaatggtatgagaacctatcctagcgattgttgttggatttatcgggctgttattggaccacccatagatgtccagtcctttgaacttcatgttcaagatgtccagtcctctgcgtaacagggggtgttaaagatcccactgaccagtgatatggccaaaaataatgcacatagtggggtggggaggggtggggtaaggctacaaatattacaatccatgatctttccaaatgccacaatacatatagtcaacctgaatacggaagcccccatggtacacaatgctgtctttgctcgttggctcctatcccccaagcttacctgtgaacacatgtatacaagatcatcagaaaatgtgcatacagcatagtcaccaaaaggcaggtggttcaattgcataaaaggtctccctgaataaatcagtgtgtcaatatttccctggtgacaaagcagattgaatttcacatgttataggaattataaagtgacacattgacaaatatcactgtttcctcaaaaagaccaccataccatatgggaagacccgtcaattcatagagcagagaatcagactaaccatgaaagcatgtactatatgcacacagaactccacagcaattcctattgacataataaggtttacaacagacaccgcattgagttgaatacccaaaattgccattacaccctgcaggagtcacaaagttcatttgtttcattctgtaactaagaggtaataaataggatattgaaagggaaagcaaatgaaagatgaaacgaatttgcaactgtaagataaatgttaccatgagatccaaaattatcatgatcagaacaagtaataagattattgaactccacacgctgcatttaatagcaaacagaaaaagaatattatgcttaatcttgaactggagagaacaaattttcaagttgactgtaaatatacaaggctcaagtatacctggatgtgatgataagacagacaacaaaaatagcacctgttgtatcaccataagttatttaatgacaaacgaatttgactaaagaaagacacagacttgatatgatacattttcacacaagtagtagttgaagaatttatgtccgagaaatggaaaacaaaacatggaaaaaagtgagaagacacgaattagattttcactttccaattttggtccaatcagaaatatcaagagggaggcaaataagtacaacccatgaatatgtagtctaaatcccgatactgaaatctttcatacataaaaagcaacagaagatcctatatatctttcaagtggaaaacataaagtggtttgatgttgataaggcaacagagtactccatcaaagaccatagagatagaatttaaaagtttgaagccaagaacacaagtataaatcttctcaataaaggcttaaatttcaacatataaactgcaaacaggaagggaaactgaaggatcataacagacagtccagcttatacaacaaggttgacaaacgagtatctcatactgtgtgcatgtgttatttaaactgttttggaataccaacctagtgctatgctaatgttgatcagggctaacttccatatatccaggtattgttcaaagaagatataaaacactgagtacggaaaaatatccatctgcacaagagaaacttaatcaacaagaagtggtgatccacaaaagaatcaacaatatgagacattgtatgattttagtcattacaaaatgcttcataaggatgagaaaatggtaagtagatccataatcatatcatctaatattttgttataaacttaataccaacaaagagacagtcagataaaaagtgatgagctaataccaacagagattgagactcaaaggtcaagtgaaaacaaggactcccaaataaaatattagattggtgaaagacagaaataacacaataacaataatagcagtaatagtagagtcaatcctaggaaaaggttcataaatgcagttcaaataaaaaataataattacaaggagaaaaaatatgtgtagaccatattccgaacattttttgatccagaatgccaaaacaactcagtaaaaatgcataatgccattgacgtccaaacctttaaagatgaagaaattcttgccgagaagtcccttgcagctcgtattgcattaacatagtcaccctaacaagattttcattagaacaaacagagaaatgtatgaaaaaaatatgccaaagcaaagaaaataagatcatcacttattatcacactgcatacttgtctattaactggtgtgtgataagtacggaactcagaagcttggatgacaccaccctcataacctgaaatccagttataagcaaaatctacatattagattttcaattttgagaatgttacagcaaatataaatataagttttgtctttttataaagagggagtgagtatttttcaaaccattcagatctacactgttggtgtaagctccatgaccaccctttgcacaatcagctgatggcagtgcatcaagaaaccagggaagcttctctctgaactgtgctgtagatggacgatcattaaccaaatccgagtggcggaaacactaggaatcaaccaaaagtgtcagtcgctttactaattcacccttttgatttacagtcacatctattaggaaagtagtgtcctatgtaataaacaaaaaagtttagagggagaagtatattactgttgtacagtctttacacactccacccaacccacatggcccttcatctggtaaacagcaaggcggctgaacaaggacagacatttactattgtaaacgaaaaatatacgatggtacattgagcaatatttaattagatttatcatttatacaattgatgtagatacaaaaacaaggcaggagaaaagagaaaccatatatacatatacaatgtgcatgaatataagttcaaaacatgtaggagagaaggaaagttgagcatgcagcatgcaaatattatccaaggacatttaaagaagcacatacctgatcatcaggtggacaataagaatcatttgtgaattttcgacagcaactaaaagcttcaggtgatatccatacaagaaaatcatcaagccatgaggcagctggtttggctatgtagcttgatgttggcactaatgatgctctagatatctgcaatgttacagaacaatatatacagaatccattcatatatgccaagataaaaaagaaattacattacaagtgtagttatgtacaagtcagccattcaacaatataaatgaagaatataattattgtaattaatagggtttatttctttcataagttagcctgtacagtttcttagactctaccaacaagtcgtatgtccgagtggtcctgggctcggtccccttaagcaaggtctcgggtttgagccttgtggatgaaaaaaatgtggttgggaggggagatcctactaaaggtggtcagttaggttctccggcggagattaatcattagtaaaactagtggatactctgcatcaatgttatggtgataaaaaaaaaagatttttatactcttgagtgttggacatttttttagtcccttgaaattcttgaattaaaagtaacgtagtctatatatagaagtggtaatcatcctttgtaataagctgaataagaaataaacttcagccactgtaagagtaagtatactctatactcttatagccactttctttttcaaatcttttaggtttatcaagtaggtatcagactcttgatgcatcaaaagactagcttccttcttgcagctatcttaggtagctttcattttcaccttggcaccttcattgtgcccacagcccagaaaatgctaccattatccaccactgccattgctggaatttttttttttccagcaggtttctccagcaaagcggacgtcgctgatggggacccaaagttttagctctcatcagatctgccatgttcccttacgcacgcaaccagtagccatgcatttcaggtgtgtgtacaccacttgccaccgccaccacagaacaggacaccggccactccctgttatgtttcaggatttgatttgtcctaatactgcctcttttgcagctgttagaaagcaccatcttctcattttttttggctgtgattgaaaatatgttttccctttttgttttttttaacatgtctgatgaaaaacaacttctctatagtctcttaggcccaaagatttaccagtgttgcaaggaagggtcttaccatcttcatgagcaaaactaccttcagtgtgagcacagctagtttgcaccatgataaattcattttttatgaatttatgtgcatgatttcaaaggaaaaattgaacaaaaataaaccataaaagaatatttttttttggaaaacccataaaaattagattagttttagtttagagatatttccttttgtagatatgactttcatgaggagtttccttaattttttaggaaaataaagcaaaacacttgcaatttgggtacagcgatcacacatgaagaaaacaggaatgctagattgtaaaccatttgatacccaaacgaccaaaatatgaagcttcttcctaatcagggggagccttattagccagttcttgaactaatgtcattggaatgcagttgtttggactaaggtacattaaggggtgacaaggaaagggcctagtttatatggctaggggtcacaaatattatactatacttggatgccaagtgggcaaaagatgtcagtgacaaatgttccattcaatttcaggctattgtgttcttatgagaggaatcatctcatggaagagtaagaagcagaatgttgtggctagattgtagagtattgcaccatgactcaccccacatgtgaacttctatggctaaaacacttgcttcaagacttgcaagttttaagagtttggtcttaggagcttgtttgtgataatctgccctatatctcattaaatctagttttttcacgagaagacaacataagttgtttgccactttatagagagaagatactttttggcattatcaatacctctatgagctccaaagatcatctggctgacattttaccaagtcttcaagaggtcctagaattacatatatatgacatggcttggggggattatatttattttatttctgtatttgatatttttttcctaagattggttagatattattgatgtaatctcagtcaatctcttagtcttagagttctttgtttccagtatttactatcatttacacacttccttcactgagttttctctcaagcaatcaataaaatattcagtttttactagaactaatgaatggaggttgacactaataatcacttgttgaagaacttgaccattgaattacctcatttaaaagagaatttgaatcacagtggctaatggagcatagctggtttgtgtgtttggattccaaactgcacaagagactcacaggaaataagttcaaaagttcagataatacacttaattgatacatctataagagatttttaacgtgcaagcacagtggaggaaaataatgatatacaaaattttctttccactaattctatttccttttttattcaacagcagcttgcatgcctaatgcatcatttcagtttgtaaataacacaacattgaattgtcttcttaaaagacccatcaattaatagagataagtacgctaagaacaataaaattaatcaacctgtagttgtaatcctttacaacaaaatataagggtggtccaactctaaggtactcagatatgttactgaaataaccctgaaagaaaaaatgaatgtaagaggctggctagtacaaaatggaacatgggaaaacaaatagaaacttaaacctgaaggtaggaatcccgtggaagagcaatctgttgctcaagaccaggttcaatccttgtgcataatgcctgtcaaaataaaaggaaacaataaaagcacaaatagaatgacatttccgaaaagggtcttactgaaaattaatattttctcgtttcccaagaaacttacaatgcttgctaaggtaaatgcagcaaatacggcaatgaccaagattttaactccccatagtccaagaaatggtgcatgaacctcctaaattcacacgatgatagtagagttaattttgatcagaaaagtgatagcctgataggaacacaagatggaaataaagagtgaatttttctggattgaaactgaacagaacaaggaaaagtaattcttgtccaagggctgcttccctttcacaaaggataattcctttcttacaaatcttcaaattctttgaatgccccttcgaatcttattctcccttatttatatgattaatcccctctaactaactaactaactagtcctgatagggcagctatcataattattggaatattacaattcacgatttgaatcatgtgattcagctagctagcaatttgtatcataagatgaatctcaaatgaatatgaatcttattatccattaacgaattggtgcaataatcacacgagtcaatgttcattatttatccttccttttctttcaccaattctcatgaaagaaatcgaagagcatataagcttaaattgataaatgaaaaggaattgaaggatagcttatcttatggattattgcactactctatttgtcactcactcattcaatgcatgcactctaattggttgtttcatttcttcaattccatcttccaaaatagaggtttcatatactcatatataacttataattttgtttcacgagactaatgattaagttgttttatctattttgaatataaaattattacatttaagttctaacactatatattatctatgttgtaaatatgtaaataatttaggatttctctttcacaaatgatttctctttttcttacaaatgttctaactaactgaatgcccattccatccaaattcccccctatttatctagctaatccactctaacaatgtaaaagttatatggcgttatgttgagaattttttgcctatgaccgccaaataaaattagaaaacaacaaaattgaattcataaaacatgggtaatacaataaaaatcattttttagtttacacataatcaactcatgaactaaatataactttaccttcatatatcgtgtcagtaatccatctctttcccgcctaacacctacactttgattaggatatgattagaaccatatataagcaaggagagagaaaaagtttaaaatacaaagtacctacagaagctgaaaataattcatgattatgcttcaatggaaatgttagatataaactgtgtgaatgtgtttaatctacaaggtggagacttaagagtgattttatatccttaacatgtttgatgtttcattatgtgagagtcctttcaagttgaagcattgacaaatcacataacattcatacgtagtgctgaaattaaatctcaacaagccaaaaaaggacaacaaggatcaaatttataaccactacatggagcctttgatatcatgtcaaagaccaacccgatcctaaaagcttaaggcttattagatagagtaacaagaatgatttataagtccaagtaaacccctcatgcaaacgagctttgggcttgaagcgtagacaaagcaaaagggcccatcatagatgcataagaataggagcataaatgatcaacttattgacaacatggtcataaaggctataccaatttgaaaccctaatacccaaaagcctaaactgtaagatgcaggcttagcagaaaaccaatgtatacatgccataactcagatgtaccttcattttgctccgcagagggcggattcaacttcacgcatggaaagcaatcaatcctattatccttggccctcataaagtctaatgtaaccaaagctacaaaagcagtaatctgtagaaggaagtccagtagaaccgccaaagctataaaaaagaaaattcaggagttaagaaatcttaaaaccactttttaaaggagttgtatatttcaccctcctttttatgtgtatagatgatgtcgattcagttttctttttgtccaaagtacagggtgagaggagaaaaatctgtaacctgcaatcatggagaaaacacgacatgctggcatagaaacaaatgatcctacagcaaatgctagaatctctgataagctggccagtgttattgaaggtccaacttcacccattgcattgcttatttgttcctctacaggtaaacctgagggttgccgtttcacagcatctacgattatacacatgttatcaacaccaacctgatcaaaaaaatgaaaatccaaaaaaaacaaaaagtgaaatctaaccacacttgcagaaaagtaagcagggcaggagagttataaaaattaataaaacttgaatgtagagaatggcccaaatttagaagaaaggttctgaattatctttagcagtcagcatatatgatacttatatacatcaagagagtatttacaagacaaaaaaaaatgaatttaagctatttcctatggcactattgctcaaaggacatgaaccaaatataacaattcttaatgtttactttccaacattctaataattataataacatttgttatcttagcgattgttgttgggcctatcatgccaattgctattagtctgttatcacttatcagaacatccgcagatgtccagtcttgcaaacttcacgctcaagatgtctagtccttggcatgagcggtgtgtgttggagatcctacatcgactagtgaaacgacgaaattaaagtatataagtggtggacatccctcaccttacaagccagattggtagtgttgagttaggcccaaactcaaattctaagaacattatattacttgctctaaagttgttgcataagagtcatgcaacaagcttgtttcatacataattaactcaaggacttcaaagaattttggtgaaaatgttaacagctccaggatggctcttctccctcacaaaatgaaaatcaacctaaatgtgttttattctttcatgaaaccttggatttgaagctttatgcagggaagctagattatcacacacaagcttcatgaattgctctttacaaacacctaactccttaagaaactattttagccatacgagttcacgcattgcaactgccattgcttgatgtcagcttcttctttcccaagatatcagattacatccaaaatgaaagcagtatcttgaggaagaatgcctaaaggagaatctgccggatcagcatcatcatagtcatagagtaaccatcttcctatagctcttttatgtatctaagacctgaacagtggcatcctagtacgagtcacatgtacatcaaaagaaatatttgaactagttattgggagaaagttcagttacccaatcattcttcaatattatttaggatctggtaatggcttcctctatcttggtaaaagctttatgctgggagccatgagtctattgacatgcttacacttggtcatgccagcctcctctagaatatccaaggcatatttcctctaggaaatccacattgtgcaacttctatacccagagaaaagcttgccaacatccttaaactgaaaaggcttgaacaaattctgcttcgagcattcaatatcatcctaatatttattggtgatgataatgtcctctatatagacaagttaaatgtattgaccaagagattggcattgttaggaaatggaataattggcttcacttctagtcatgccaaaggcttgtaatacaatactaaaacatccagaccaagtgcaaggacattgcttttgaccatatacaaatttgcaaagcatgtaaacttaggccaaactcctgctgagcaataaaaccaatgggtagttccatgtgtacttcctcctataaatctccattaagaaagctattcttgatgtcaagttgttaaggaggccaacaaaaatgacatccacggttagaaataaaagaacataagcaattttttgacaccaaagagaaagtgtcaatgtaaccaaggaaataagtctggaaatagcctttagccaccaaatgagttttcaaacgatcaacaaaatcgttgaggcccactttcattgcaaacactcaacaaaagaaattatttggtggttatgaaatcaaatattgtgtggcattatattgtaggacagacatctcatcaacctttgtttagtgtttagccagtgattgagtgaattttcatttccaaagatgttattttcaatgaaaatcagtttccttatccttctctcttttcctctcctacttccagttctacacctactgagttcatttaaccaccttacctgtcattgagtcagtttctcatcctccgctcaattctaatccttcttcctcatcctctcctgaggctccccactcttcaccttctgttgaggcttccaggtctgataatgttgtctcctgaccttatgatcctgcacagtctcccatttggcttcttctgcctctgttcatactgatacagtgctgtctgatgaccctcttcagttgtctccaactgaatctcccaatactccacaacctgctcatgtcagaccagacaatgtgcatcctatggttacaacagccaaagctgacatagtgcagccaagaattcatccttccttgcttcttgttcatactgaagccaagtcagttaaacaagctctgagatacaaagtggtttgctgctatgactttgttgaagtttgggttcactgacagtaaatgtgacccttctttattcatttacaagacttcctctaccactacctacattttagtatatgtagatgatattattatcactggaaattcatttacactcatgcaaaagttaattcagcaactcaatgcttcattttctctcaagcagctgggctctttagactattttttggggattgaggttcattcattatccagtggagcacttttgatgactcagtccaagtacattcgagatctgttacagaaaaccaatatgctagaagcaaagcccatttcttctcctatgaactctagctgcaggctctccaacatggttctgatttactgcaagatccctccttttacagatcagttgttggagccttgcaaaatgttacaaaatcactcgtcctgaactcagtttttctgttaacaaagtatgtcagtttatggcttctcttgagtctcactggactgctgtgaaaaggattttgaggtaccttaaaggtacccttcattctggagttattctgtatcctgcctctcttaataaccatctttctcttagaggctattgtgactttgactgggcttcagacccagatgacagaagatctacatctggtgcagctgtctttgttggtcctaacctggtgtcttggtgatcaagaaagcaaaaggtggtttctaggtccagtactgaagcagaatatagaagtttagctgctgccacagctgatattctctggattcagactcttctccaggaacttgcagtcccttattctacacctatcatgctgtgtgacaattccagtgcagtgcagctagctcataatccagttctccatgcttggatgtgatttttgtccgaaaaaaggttcttactaagcagctggtggttcagcatataccaggcccagaccaatgggcagattaacttaccaagcctttgtcttctactaggttcacatatttgagctccaaactcaatgtagatgagctacctttggtttctcagctccattgagtttgcggggggtgtaagtgtaaataataataactaaccttagtttttctactgtagttagttaactgttagccttagtcagttgacagtcataactgaatctcagcagtataaatactgttcttgtaagagatttcagtggctttgtattttcttcttctgtctataatacaaccaaacaggcacttagtccattcaacttgcataatacttacataagataaatatggtatctctgatggcagttcataaaattatcttggtaatgataaaaacaaagacttacagctaaaaccagaaaaggtatgacttccattatgattagtgtcgattttactccaatagcactgaaaaatccaactgatccaaggacagaaagcataactagcaaaacccccaaaagaccaagcaatacctggataacatcaagttgaagaatgagaagtattagagtaaatagccagagttgaagaggctacccataacatttgaaaaagttaaaattaatttctatcatatctgcatcaaccacatgagaaaagaattggaaaaaaaaaaataatccagttgtgataagcatgaaaacctacacaagaattcaagatagaatgtacattataggtcttctcattaattatggtaaaaaatggtcaacaacttaaacctggtccatattagagtagaaaagggaattctactcttctactctaatagtccaatattactatcagcctttgtctcccatcttacaccactaatgacacaggaaacagaaaacccctttgaaacttaaagctttaggcactaaagtaaattgttaccgaatcttcaaattgaaaagtgaactgctctcacaaataatgaagctcccttgaaggctcacataatggaaccaaaccaaaacagctctgacaccaacaaatgaacttaagatcttgagagaaatcagagagatcatagagaggatatagtttgagagaagtaagatgtaagatccatgagaaactattgaaatgtgaatactctttttcattcattcagattgaaacccaaagggttcattatatacaactagttctaatactctagaatattccaccacttattctaatactctagaatattccacaactaattctaatactctagaatattccacaactaattctaatactctagaatattccacaactatttctaatactctagaatattctacactccccttcaagttgggagatatatattaatcatacccaacttgctaatcaaatcctcaaaggtgggcttgtgtaatcctttggtaagaatatccgttgtctgctctttggtaggtatatatgacaaacatacactaccatcctccaatttttctttgataaaatgacgatcaacctccacatatttagttctatcatggtgaattggattttgagcaatactgacagcagccttattatcacaatacaatctgacaggtagggaataagagatcttcaattcctcaagaagtctttttaaccagattccttcacaaatatcatggtctagagcccaaaattctgcttgtgcactgcttctggcaacaactgtttgtttcttacttctcctggtcacaagatttccccagacataggtacaataccctgaagtggatcttctgtccattgccgagccagcccaatttgcatatgtatagatttcaatcaacctcttgtgtcctctttgaaagaacattcctcgaccaggggtgtttttgaggtacttgaggattctataaattgcactaaggtgtttttacttaggagaatgcatgaattgactaaccatgctaaccgcaaatgcaatatctggccaagtgtgagataagtagatcaacttccccaccaacctctggtactgctctatgtcaacttctttcccatcttcaattcccaatttaatattaggatcaattggagtctctgatggcttgcacccaagcattcctgtttcttgcaacaggtctagaatatatttcttctgagttaaagaaatttctgccttactacgagcaacctccatgccaaggaaatatttgagaactccaagatctttcagttcaaactagtcagctaaactgcttcaaagagcttatctcctcacaatcattttctgtgacaattatgtcatcaacataaataatgagaatagtaattttgccaccatcatagtgtttataaaatagagtgtgatcagtctgagcttggaggaatcctcttcccttcacagcttgggtaaacttctcaaaccactctctaggggattgtttaaacccatagagagacttcttcaacttgcatactgaaccgtctcctttttcaaaaccagatggtggatccatataaacttcatgtaaatctccattcaaaaagacattctttacatttaattgttgcaagggccaatcaaggttggcagcaaatgatagtagaactcgaatagtgttaagtttggcaactggggcaaatgtctcttgatagtctatcccatgagtctgagtgaatcccttagcaaccaatctcgccttatacttgttgatgctattatctgcattaaattttattgtgaacacccacttgcaacctactattttctttcctctgggtaatgctacagattcccaagttccatttttttttagtgcatccatttcttcaaaaactgcattcctccattttgggtcatcaagtgcttcttggatgttttttggtatttttgtattgtctaaaatagtgttgaaagcacgaaaacctggggataacttttcattcgagatatgataagaaatagggtgagcagtacaggatctggtaccttttcgaagagcacatcgaatagacttaggatcgagcttggacctttgaatgggaggaacatgtacaaaagccacacagccaaacaacttgagaggaagggaagaatgagccccaaaaaaaggaaaggtgtcggtaagacaagataaaggggaatgaaaatttaggacacgagaaggcatccgattgatgagatatgatgcatgcaagacagcttccccccatagatatttagggatatgcatggtaaacaaaagagctcgagcaacttcaagaagatgtctattttttctttcaaccatcccattttgttgaggggtgttaggacaagaactttgatggagaataccatgttggttgagatagtatccaagaacagaattaaaatattcagtaccattgtcagttcgaagaattttgatagaggtctggaattgagtttgaatagcatggaagtttttaaaggtggatgcagcatcagacttatcctttaaaagatatactcaacataccctagaatgatcatcaataaaagtaataaaccaatgagcaccagagatatttttctcatgggctgggccctatatatcactatgaatcaaggtaaatggagaagaatcatgacgaactctaggaggataagaaacacgaggatgctttgcaaactgacaaatatcacaagaaaaagaactggattttttattgataaataagtttgggagcaacttctgaagataaaagaaatttgggtgtcctaaccgacgatgccacaacaaaacatcattacaatcatcagacaaagataatgagtggtgcgcaaaaaaatttgtttcattaggatccttttcaaaatagtaaagcccttcttcctctctagcactgtcaattttcaatcccgaatcctgttccagaaaaacacaagcatggaccgagaacatcgcaacacaatttaatcagatgtaagtttgctgatagagatgaggttacaagtaagagagggaacatgaaggactgagttcaaagtaatgtgttcagaaagtttaatgaatccctatccagcaatagtagagaagctgtcatcggctgttcttattcgtggcagttaatagtaaggggtataagaacaaaacaaggttgcattacctgtcatatgattagaagcctctgaatcgagaatccaacgattactaccattaacatggaatgtcgtaccttgttgagcaacaccttgttgagcaacacaactagttgcttcaacaaattgagacatcaccttctgaaattgctcatacccagccttggagatgaaaacaccatcaaaattaggagaggcacgaaactcctcactcgtattattagaagagtccataagtcacctcaaaccaaaagagggtagggcttttttttaaaaaaaaaaaaaataggcttcagagttgcacaacgataacaggaaaacctgctcttgataccattttgaaatgtgaatactctttttcattcattcaaattgaaacccaaagggttcattatatacaactagttctaatactctagaatattccaccacttattctaatactctagaatattccacaactaattataatactctagaatattccacaactaattctaatactctagaatattctacataaacacaaaatttaaagaaaatactatggactctgtcaaaaacaaatggcaacctaagatgaacctaagtctccatacttgaacaaacaacatgatagcaaacgagaatatttacaatgatcaactagtaaatccaaattccaaaataaactccccatgtcataaaccaactattgcaaaagctaaatttattagatgaaaacgtgaaaattttatattacatctctaacatgcctacttatgcaagaacctttagggattaaagtgtacacatgcagaggctcacctacctttagctgaaatttaactttttattagaagaagtagggcagcaaggaacctctacatcactcaatcatagatgctcagataccatgtcatgaaccaattatcccaaaatcttaagttattaggtgaagacatgtggctgttttatattacatctctttatattacatctctaacaccccaccacaatgataacaaatgtcaaaacatgcaaattgtttcctcgtcaactctgtgatcctttgcatttattattattaatgttggaaataggagcattaaatgataattattcttccatgtagtttagttattgcatttagcttagttgaattatcttaggaagtagttctcttgataatagcagttatttattatctttttaatcacaattattataaatagatcactctgctaagtaaaattcagaaaataaaatgtgtttctctattctcattcttttttctctcatctcataattaatggtctacacttcaactctactgtgtagtttagatgcttggaatccccatgagcattagttaagaacattaacattaagaagtacaatttagcacgtattggcacttatattatgcatgtaagtttttacttttgaatatacacaaacaatttagtgtcacagggtatactagatgggatcatgggaaaaggacaattgaaagcttcaaggaaaataacataccttggacgagaggaagaaagaagatggatgaggtggtctatctcccaaggtcaccgatatataagcaaacattacaatatagctcacctaataatatgttggagaagacatttattgtatattccaataaagcacatcgttatgaagccacaaccaaactaatcagtccattagcttacacacaacacaaatcatgttttcacattcagttgaaagaaacagaaatttcttacaagtattgttatgacatctgcagtgctttctctctttagttcttcctcaattgaactttcacttgaaaatgacaaggtaagattgctagattgcaccattggcagcaattcgtccttccaaatgtaaaattggttcaaaatatgtatggataaggaatgagaagaaaagacagatagtataaagtacctctagcattcagctagcatatctgtaatatcatgcaacgtgcaaaagtacacgcactcaaaaaaataagcatattatatagacacttgtactaggacaatataatcaatttaactcaaacctacttataagtaggtatctgaaagcactcgtgcacttttccttatttcaaaagttgacagtggatgggtcaacatttactttataccaatatattgcctacaggctacagccagatttagaggcatgcatatcagtaacaaataaacaaatctgtattcagaaacatacttcactagaacatgctagggtaactaacaccgagacctcaggtttttctttcctagagtcatctaacaatcaaaatctaacatctaacattataagtattggagaatacttactcggtccacttttctttttgcttaaactgatctgtaaaggctaaactacagttagtagttagtctatagttagttagttatctgttaggacagctgtttgacagcaatcactaactaactcaggttagttatgccaatggaattgattagaagaatattagttattaattggcacaaattgcagaatatctgttattattggcacaaatttgttggccattcaaaacagcaaatcttacatcattatactgctgtaattacctccttaattagttatcccagctgtaggatagcatttattgcagattggctatttaatgcacagatgtagaaatcaaattgtatgagcactatttgatgcagaattctccacaggagaacacacagtttttcatctgcaactttcttagtctaataagttaacagttacagttgtttaactgtctatataaattgaggtgtaatcatctttctgttgggttgaatacaatcaacaatttcacctcactttagttttctgaaattctcttagattcttacagttgtataaggcttccattctatggtagggttatgcaccatgtgatcaggaaactaatatgggatacaaaaaaaaaattatacatgaggcttactgctaacttgcttttaaagtaaaaacattcatatataaattacttcacttcaaaataaattttacataatcaatttcattcaaaattaattttgcaaacaaatcactcaaacacactttatgtgctttaaatgtataaatgggtcaatgggaaagtgattttcttgggctttagaaagagaatgtgctcatgtccaataacagactaatgtgcttagtttgaggcccaaattaatatgtctcttgaaaaataaaatggtaagaaattttatgtgctgcttgttcagattatctgttgcatgtgagttacagtatgtagaaaggaattatgggaagtttgatgaggacatttaaaagtttgcaaatggataagaatagaattttctgaggtgcaacaggagtggaatcaaaggaaagtattgacaatttactttaacagttcaacttcagaagcaacctacaagaacatggaaaaaacttggcattgcaatcattcagggaagatagtttggtcaggtatttttacctcattttttggtaaattatagtcgtgaaaaatggaaaatctcacttggtttatcatcttgcccaaatttcttagagtgaaacaatcaggtagcatttcaaaatacaactcgtccagtatttcgtatctgccaatactaaggcttttctaaatatatttaacaagctgggtatgaataacatctgtgctctaacttaagtaggagttagttgtattagtgtgagagtatctcttgccctttgctcttctaacactatcaaagactaactccctaaaaagcaaggtgctttttacccagggaagaaaagaccccaaaagaagaagaagaaatagcagtgtggtgatgggatagtacagatgaaaggaagagagaatgaagttaatattttttgtaagaaaaagagagaatggcattactctctggaaagaatgaagaggcaaatgaggtcttttttctgggacgagagatattcatcataggatgagggacttttcttcagaaaatatatttagttatttctatttcttaaaaaaaattacttactctcaggcatctttcagcttttgattgatcagattagatttttttttgatcagcaaagataataatattattggaaatatataatagcagtacaagtagtactactgtgattacaacctaaacagaagcaactcagaacaaaggtggcttaaagcattggctaagacaccagcgttctgaccaactgctaggaacaaaacctccccaaaaaacagaaatttagaattatacagatatgaccctcccctgagcatcaaaacagtccctcaaattgctagaccaatgataaaaaggaatggcaaaaccaggctctaaatttttgagccacgaccagcaaaaaaaaatggagtcttccatcagctttagaccattaaacacttcattatggtagataatcctgttcctatgataccagatacaccaagtcaaagcaacccaccaaatctgccacctctgtgacttaaattgacagaaagagtgttggtggaagtgctcctttgggacaacagaaaaagccccaattaggtttacccaagatcttgattcccaccacaacggcataattttatcacagctgaagaataaatgagaggcatcttccgcgtaatttctacaaaaagggcacatcatgtccgtgacttccacatttcttctgcttagattagacctggtacacaaaactccaacatctaggtcatcctaaggttgtttcttgggagagtcacactagtttggtgccttgtttgtagggaatagttaaccaatcaaaattgttacacttacgttgggttgtttatgtcaaactgaataaccaatctagtggttatttgatccttatcagacaataagttgccaaaatgctcctcaacaaaatgtccccttggtttcttcagttaattactaagtttaatataccaccaaagatgacaaccaattttctttcaataatcaagaaaacaacagcaacataaggatttatggagagatgtcaaaaataaaatgaaaatgaagattttgtgcatataagctacacaagaattaataactgcaataaatatatttagtagtcataccttagctaactggatgaatgctttttcccaagctattgccttcccattctcatctccaacttttgtaattgcattattgacagggtacgtgataacaaatgcagaagcctagaataggtgaatcagcatagcagtaacacataaaaagaaatctatgctaaaattcaagattcttacctcagaataattgtttccagaaaaccctcccaaggcagtagttggctcaaggggagccttaaatgcactaaagcatgtttcagtagaagtgtaatgctgaaaatgataaaataaaataataagatttaagtcttattaaacacaagctatgagataaattcaccataatctataagaagtaattatgtatagaagcaccaacggagctttctacattcaatgcatttgacacactacagctacactatttataaagaaaaaagaaatgaaaagcaggtattccttccatacctatgcaaatatttcaacttgaattagtatgcttattggaatttagtgtttcttaacacattaatctttttgttttacaatatttgtctgctcataaagtaaaactgttttaaattaaactcgtttgaataacaaaactaaggtaatccataatcagatcacagaagtttacctgaaaacaatactcagcatgttcaacacctccgtagttgtcataattgtcagggtccatttgaaaatactattagaataaaataaagacaaaaaaggaaatcaaatgacggcttctaagtatgccaaaaaaaaagaatagtaaattgatatagaactgaataagaaaagccaactggttgtacaacttacagataatagaagccaaataattaattattcgcaatacacaattcaaaagtactacaggaataatttggaaattagtgggttggacctgcaaaatgctttgagtggcacattcgtagcctaaaggcttcaagcaaatgtcactcagagatactaacaaaccagaataatttgcacgaattccatcaacctgttggaatattgaaatgtaaacatattttttaataaagaaggccccactaagcatacaacagctccatttaaattctagtaagtaaaaaaaactgaaaatcaaaacaccttttcctgtatttcgaaaagcaattcaatattttcttctgttatgatacttggcggtttgccatgcttagattcagggattgtcgctattatgagctgaaatatacacaaacaatattttaaaatgtgatttatttcagataaaataatagcaggaaataagaaggcaacttaacaaaaacattaaaaaggaaactatggttgacttcatattctccgcaaagtacatgttttcgatagaaacggaaaactttcttggaaattggaattgcatcagcatcaatatcaacataataataaaatcaaaatgtcttatttgataaataaacaaaacatatctattgagatttgctgagatatttatctcattcatacttagttagtcaatacagctgtgtacagctgtcagttggttagtacattgtcagcaactgtcactagttagttaggatctctgtgcctatacatatctcagtgtaaacagagactctttgagcaattgtaatttctcctttgatatcaataatatcagtttatcaagatggtatcagagcacttttttttttttttttttttatcagagcacttgaattatcacacagcaccataggagtgaggtgagggactgcaagctcaccaagaagagtctgaatccacaaaatgtcagctgtagcagccaaggcttctgacctcagcctcagtgcatcttaggaagtagtggtatcttaattgctcccttgtaaatagtctttggcattaatcgtcattgtaatactcttgaatgtaaatagatcatttttctgtgtggaaaatacattcaagtatctctcgtatctttaaggaggtttcattggatcaaaaagtcagaaatttggcttctatttggcataaatcacatggtctttttaagggaggggagatctcccttgtagatatgttcagggattaggtagcttcgtttcattgaggattccttatttttcaaactctaattttgttctctccatcttaatatatttcttcctttatttatttattttgttgggggggggggggaagagagttggtaaaggccaaacatgcaaatgagcaggcatgctagataactcatttacataagagggagcctagatttcagtaagtagatgacacacatggaattacgagaccagaaagaaaagtacaataaattacaagcaaactgaaacctgttcaattctgtagaatggagcaaggtggctatcaaaaaactctttctcttcagctgccttactcccgggaccaacccataactgcaacacaaagaagacagcaaggccgatattcttcaacttcaagaagaaaataaggattacgagcatatatatgttccttttaaaacttattgcagttgaagtactagaaaacattttgttgtgtgttggagagggaggattaaagaagaaatattattaaagaggcagcgagagcaagatacccatttagagaataaatgtcctccagcaagtaaaagaacaagaaaacaaacacaaaaaccattccacagaaaaatcatgattatatatatttagaatattgagaattctctaaaattcaggaattaaggcccataaattgactggtatgtatctatccagaaagctcaagaagacaaaaaggttgttgctataagaatgaacccttggacagtatttttttttgtttagaagcacttatttggtaccataagcctttatgaaaatatttttcttgacattatttataagtataggttcacagtgtaaaacaattttaatttgcttgagctattatgcaaaatgtgcttaacatttgagcatatgttccaacagctcatccaaacatgtctaagggtagattaaaaaaaacaaagtaacagcataaaaaggataaggtagatattatttgatagccaggaaggagataaaaaaaatggatgtagaagttacagaagcaaatccaaattgtacactgtggagataatatagatgaaaatatggtaccttctcaggccgggtctccacctcaaaacgaagcagacccaaacaaagcaaaacaacaattgtcaatgaggaacaaagaacaattgtgggttttctagcggcccaccttccatatgtcctgaatgcataaacaaaatcaaagattatgtaattgtaaacctagcaagaactgctagagccaccgacctgtaaaagctggacaggcatccttgaacaaaagaaaattgcaccacattctgcccttgaggatctatccgttgcaccttttatttgacaatacaaagccaacaatatcataatgagtaataaataaaactgctcattatacatgtgaaataaatcatttaactctaacacatcttaatatagaattgaaagaggcaaattgagaaacaagattccaggagttaattcaggtcccacagctaaaccagaagaaaacacaacaaagttgtattacagatgcattatccaaatcattttacataccatgtataaccagtgtttcctagaactccaagatcttaaatgaatttcttattcaatagaaaatagctccctagtccctacttatgttagatgctaagaaatttagacagtgtattcaagggtagcagtcctgtgcagttaaaatactgtaatacaaaatatggttcaacaaccactactatgcatacaattccagttatcaaaaacagactctcctcaaattatcttcaagtttaagcaggaatggattttggaaaacaatgttttcttttgttttttggggggaggggctcaaaagagttcattatgagagaaaagttgtatgagagaaaagttgtacagagatggagaatcagatatcaccctatagcaaggggagtgattgataaaaaaaaaatagcatagaagtgttagcagtccctttgcataataatacaaagaaactccttcaaaagactggtgaggtgaaacctgaaaaaatgttataaaaaaaaaaaggagcatgtaacaggagaaaaaaaaatgaagaaagaaaacattaagtaaaattaaggtatttcactccaactaaaagcagcatacaccaggcaaaagaacacatttcctaagcaatttattctgctttgcacatccaaaaccttgaggagggattaaaaactttcttcaaacagagaatacaaaagacttcaatctgcaaagctgcttcacaatgtatgaaaagatgactatttattataaaaaataaactacacataatataaatgctaacggaaagggtcttatgtatttggtgatttggaatatcatttatttaagagaataaataaaggttccttattattgggaaaaacccaagtcccacaatggctagagataaggcaaagatagaatatataagtggggggcaaccctcaccccatgagctagcttttggggtagagttaggcccaacccacattctaagacctatacttagtgttaattgattaacatttgatctctatgagatagttggttcattacatagtattaaagtctatatgaccaagtagtctagagttcgcccttgcagctcccattcttttaaataaataagttgaaattaagcacaagacaagcgaacctgaacattatctatgtttcaagcccaaagagctcttgcatgaattgatatgcacagattatttaattataaaatcagtcatttgacttcacctaacaattagcttttgggacagctggtttccacaattataataataacaagaagaaatgaaatcttccttctgaatgccaaaacgatgggtcaatacaaaacaagcttttaaacatacctctgcaggatgagttccatccttttggaggttagcaaaactactcccttcaccaaccatatcatccaataagggttccgcaccggatccaagtctcctccttcctcttgtcctttgcagcaatgcccatccaaacaacacgaaaaccaatacaatgtacaagatggccattgaaaaatctacacatctgacctgtaggtatcattatacgaaaaccagtttcacatgtatcaaaagctgaaagacagtttttcagtagagaaccaattgttccactagattatgattcataaggcattacttttaagaaagaaaaaacagagaatttattcagtcataaagcaaatgaaaattaattataaagaaaaaatcagcctctattgtttcaacctttagagatccaattctaatggagcagggatcttttcttggtggagaaggttctgaacccgagcaaacaggtgatgaaggacaatcaccacaagagcagcccagcgaagtgtcattacatgaatatacagatgcattcataagtttcataggagaagagtcaagaatggttgtcttaaaaagaatagaatacggagaaccaggaaaaccaggaggaactttctgaccaagaaatgcaaaccactctggcaatgacaatcaaaaacaaaacacattagcagatgaagagcaagtataatacatgcagataaagagaaaaagaaatattctaatggtatgaaaaacattagcagctacttagtaccaaaataggaacaagaaaaggtatgtctgcagcaacttaggaggatcttttgtatttttttatggctaaacatgtatatctgcggtctacctcagaactacaaacatgacatacaaggagcgccgatcaaaaaaaaaatgacatacaaggagtaagctaacattaaattaactccccattttcccatttattgttgtgcaaaactcaagatccatcccaaattataggaaaacatgcacaatgaacatatcaatactcaatacacgaagggggaatcgttctaattgaaaaggtaagatcacttaataacagagttcatatatttcatacaataaatccacccatgttataatgaatcacctttaaaattgctagctccagccccaacaaaatctatggcccttgtattcattgtcccaaactttacatccttacatgattcatatagaccttctccaaaagtttcagttatgtaataatcaatgccatccacagtcatattaccattaacctgaaatgaacataatatggtcaatatcaaattataatttcaagtctagagtgaatttataagactaaatcacatgaaaaaaactgatttttctatctatataataaaacaaagtatttcctataatattttttttttatcagcaaagataattatatatagatagatgaaaagaaaacaacacagtacaagaagtactgctgtaagtacaagctagcagaaacaaaacagaacaaaagtggcttgatgcatgagagacatgctaaaacaaagtatttcctataatataatacgtcataatgtcatatgctccttaaaacattacctgcctatttttcatctcttattctaaccattgatatatttttgtacagttgattcaacgatgagttcttgttgggtttctaacggaaattactactgcttgatttggagtcactgattttctttccaaaccacctcattcatttgctttgtttgcttcgggaggtagcgctaggtaagttgtcctctttcacaaaaattatttgggtgggccaacgtgatgttgcctattaataatgcaatttgttttgatttttccccctatattcaccaatttagttactgataaaaataaacacaaaaatcttagcccattaggtgaggtcatccacatggatcacacaagactattcagcttgataaaagaccatatcttcatggatattattcaccatgagatcccttcctcttaacaacttcctccaatgttcttctaagtctcccctctcccccttttcacatgctaaaaaccatgcaatctaatctcatcactggtacttctagtggtcttctttatatgtgcccaaaccaattgttgcctactaaagataaaatataacaaaaaaaactggaccttatatcaacaagaaagctacttgggcttaataaaaaagaaggaaaatgacaccagcagcacaatggaaaattattactatagttacaagtcatccattttggtacatatataaggaacaaggcaaccgtgctagtgcacaactcaacatactagttatttataaatatttgaactaagtttcatttttcccaataagtctacataaaacactaacatgattatgggtgcaaaacatcccgcatgggcattgaggttgcggagcatggtagaatgttaggatccaattgcaagatataggacttgagtctcacattggaagtatgggattctaggggggggtttataaggctttgggctctccaacttcaacagttagcttttgtggtgtggttctccaaaggtttttatcataaacatgtaacattaacaaataaaaacacaaaaagcatcaaatcattacattcttctaaactcttttaatgaggaaagattggttagttataggagcaatgaggcatgattaagaaactatagctaaacatatgcagtttaccaataccaagctaaacaatattgcaagttcactaaaatcatcatatttcacacctgaattagcaattagcatttaacctaataactaaagttttcatttatgatttcatcaatagataccattatttagctactttattgttgtattttttcattttaaacatccaccagtggagaggaacctactgtcataagaaaagaataagcttgcaatgaggatacaagcctaccaacggatttttttttttatcggctctagagactatatattattttcactttatttctctttattataaactcggaagcaaccactacataatttgcaatgaagctacagatacataaaataattgcattaatggtgtgtttggttgagaggaaagaaagggagggaatggaatgcaatggaatagagaggaaatatttgaattgaagttgtttggtaggtaagaaataaaaggcatggaacccatactgaaattcaaaaatttccagacaacctaacacacatgcaccctacatttccacacaattctcttcctttcttctcttttccatggtaaccaaacaaggggtaaagggaacactggtctggtgaataactggaaattttactccccaaatcgttcagtattatagacttcctggaactccaaaaacagcatctccaaaccataaaaactaacaaatagggtaacatgcagctaaaagaaaacaaatgccaaagttgtacagttacattaaaaagatatatatatatatatatatatatatatatatatataaaaacctagaagcacagaaaacactcctgtaaccataaatgagccacccaaaaacttaaaaagtaaaaaaaaaaaaaaaaaaaaaaaagtgttactaaaaaacaagttcagagaaggaaatgcctgacctcagaaagagaagtcacgttgatgaataaactctgattaggagagcaagaaagttcacaaaaaagattcagaaaattcctcaagcatgctggacagcccactagaattggtacagcctgcaagatacaaagtttctgttactgcataataaaaacagaaataaacaaaatactgataagggtctaggtcaatatgtcatcatgtcaatgaggtgattaatgagagtagtaaaagaaaattcataaaatagccagtccaacataaactgtatatattctccctcatctcctctatactagtcctgcatattagataagtttttgggatacccccggccaagaaaaagataaagcaatttatcataagctagaaatggttaagagcgagctaatgcaacagacaacaaccaaaatcaccgagttaaaaaacttgcctgttgaacctggactcttagtgtgtcaaactgatccgcagtgcaacaaacatttccagttatggtggggcacaaactttgaattttggcagacagtaggtctgatggctggagttagaagattatagttaaatgaagatggtgcggcattaattagtttagtaaaaaagagatgaatgaattaccttgacagaaggggaaccatatgggcaattgagagccttgttatcactgctttgaccgcatatatcatacattgcgcagtattcttcagaatgcttagccctaaagagaaattattagtggttcggaaaaaaagaatctgaatgtagatttagccgtacgtacctataggtttcatgttgtgaggtagcaggcgaagaagagagtaggaatacctacatcaacatggacagtggaggtgagtgtgatagtccaagtcaaccaaccgatcaacagggaattaagagaaagagaaagagaaaggagaggaatcagttcttgcctgtaatagaaaagcaacggagaagatgatatccatagcaacgccgatcagatgatgaatgatgacactgctacgctacttcattcctcaactcaactcaactcaactctatgcttgcgtcttcctctttagacggaacctacaaggccagttattcaacctttttttactttttttcatttcccacggatatttttctcttacgtcattggttcctgaatttctaaattcagtcacattaattcctgaatttaacattttcccacggatatttttccatttccatttttaacgactaagctaattgtttagtattttctcttaaaacaattaattttgagataattacatcttacttactatgttataacttatttttcctctttttttctttcttatttctcattctcattcctatcacattcacatatttctctttatttttttctcttctcttagtcttattcatctttctatgtccaaatttgtacattaatattattcttgatttcttgttttcatgacatgacatgatcttatgaagcattaaatataaatactcccaattaaagtttataccttagatggaaagtttattttataatatatatatatatatatatatatatttctcatatttttttgggacccacttaattgaaatatatgataaatattttgatacatttgttaaacttttattgagtaattaatctctattattttattgaataaatcctactaagcctgatttaattttcttaaaattcctatgtaatcgttcatctaactaaaaaaatgagtaaatacattgtttattatttttatattatcatttaattacaactcaaataaaattatcttacataaagaataattttaatcttaaataataaaaaaactacattccaaaatatgaataagtactccaaaacttattttgaaatatctatttttgaatgtattttttatatttaagaatagttattctgaaatagggcaatatccttgttcctttttaccctaatagacctttcatctgcgctgcaccacccccagcctctccttcatcactacctcgcaaactcccaagagaaaacccaacgacatcgtttcactccacgtctgttctcatcccccattgcttctccgccgcacttgcgccacaccttttctgtgagcttctccaagaaggaccacaaccatagcctcaagccgtagaagcaaatcgacattattgaagaagaagggcttcttcatggggatggtcgccacaacggactttctcgtcggtgctagtttcttgtgttggttgttgggtgagtcacagtggtgcgatagtgttagcactaggaacggcatcggcgtcagaaatcgtgctatcgaggcggaggcgacagtggaggggtcggttgtgtagatttagggttgagacttgtgggattaagggcaattttgtccacacaatttaaaatggggagtgcaagaagaaaatgccagataagatataaactaacaggcgcacagaagaaaatgtccgttacactataatcttgaatatgttacgaagttagttgtacaaaaccgaagctgctttgtaattaatcattgtttctggactcttctctctttcaccagtccatatatacgtaaacaattacattgtctctagatagactcgttgaatttaatgcaaacacttccctgataatgttgtactagagacctctccatttgtttagcagaacacacaataatttacactttacaatactaatacagtaatgcatgacttacccgtacaaatctgtgagtccaagaaatacataatgaacaacaggcaaactcttaaacggagagacaaataacacaagcaaccaaagggattagttttcttaagagaaactaataactaccgtcctgacgtggagaacgatggtgcacagcctggtgaccttgacgtccggcatgagtagaacggaatttaggctccacaggtttctcattggcagcttgaattcgctccaaattctccaaaacgtccttcattgatggccgatgtctgggctcagatgcaagacatttcaaagaaagctgagctatacggaatgcagctttggatggaaattttccttccaatcgagaatccataatgcccttcaattttcttctgtcaagcaggtagggtttcacccactctgttagattttgttgcccacttggacgattggtatcaagtgctcgtaggcctgttagtatttccaccaaaacaactccaaacccgtatacatcactctttacataaagatgccctacacaaaatttcaaggttacgtacactaataatcaatttaaatttccagcacccccacaaaaaaacttgaacatgacaaaacagctggacaaaataacatcacttgctttaaattcacgtttcaattgggttattttgtatctaacagcttataattcaaaaattactgacagagttttgaaaacacaagaaaaaaaatcagttttaccaaatatgcacatgcaccacaattagaacagcgtgacattacctgtggccacatattcaggagctgcatagccgtacgtgcccatcacccttgttgtcacatgggtttgactagctgaaggacccagttttgccaagccaaaatctgatatctttgcgttataggactgtagcataacagaaattaattaagttgaccacccaatagtacacactaaactaaaacgatttctgatgttgaagatagaaaataagtaaaacattaatttgtttcatcatgctcatagcatggcaacagcaaatatatattgtgtatgcttattttgtgcagaactcaccccatcaagcaatatattggaggccttgaagtctctgtaaattactttctcggatgtatgcaagaatgcgaggccacgagctgctccaattgctatcttaagccttatatcccaaggaagtggttgaacagcagaaccccctacaattaaaataatgtagcttttagttgaaaatatacatttaatttgctatttcaattcatgtttgaacttataatacacttgccaagacagtggcattaagcactcacttccaaatagatggttttccaaactgcccttttgcatgaattcatagaccagaagaagctctgattcctccaaacagtatcccaacagcttaacaagattaggatgagaaagacgtcctagaaaacttacttcggactgcaccaaatgaatgaaccattagtttaatagcaatttataagtgtacgacaaaacagtttgatgaaacaagtaacaaaacgaaaggagggggctggggacacaaaccaatgccttcattttattacaataccataatatattacacaatttacacatgatgaaactctccagctacactattcagaaactccctaaattcagcaattcaactgcttttttctgtgaataatgctacccacacggtgacatggggatatttccagatttgagatcttagaattctgtttagtaaagcagtcaatgccatccaagtaagaagcagtatgctcattctgctacgctttgccttcatcctaaaactaaaagggaagggaaattgcattggtacgacgacggttattatttgagtttcaaaattctaattcttgttccaaattattgcttgaaactgggctggagaagggtgatactaccaaaaagtttttgtgcataaaatatcttcttctggggacgggggctgctcatagctagcggagtacattaagtaacaaaaggatatgtagaagtaaataaagtaaaagcggtttgattattatgaaggattacctgccactcttcaagtccttgtaagctttcagagttgagtttttttacggcaattactgttccgcttccaccctttgacgtggccttttcttcaagccaacccttgtagacttttccaaaacctccctccccaagcactgtatcagctctgaaatttctagtcgcagccttcaactcggcaaaagtgaagatcctcaaattggaggtaggtaagatctgtccatttggataaggctgaccaccgcttgacactgagaacttgctatttatggagctgctcccacttccagaagaagtagtagtcgtagtagtagtagtatagctgccgctgctgatcgcctgagatgtccccgtcgtacctgcacatgggaaatcataaattaaatgaacacatgagaaatcaaatgaattgagaccaaagaacaaaacaacccaaccaacctgtactaaggttaccggtagttattggggttgggttgtgaggtggagaaccccagcaatttcccattgaagctgtaccttgcaccctgcagaaagaataattttgtagctcttcctcagtgtttaaagttgaacaccggtcgatgaaagctttcttcttccttccacacctgcctttggtcttctctctttttctttgccttcaataattgaatttagctttgaagagcctataggaaatgtgtatggtacagtaaaaggcaaaactttaatggaaggatgatttattaattgttgttgtattgacatattaagtcacatgtgcccgggatcaagttataatacccctgttggaatggtggaatagtggtgaaattggacagtgtctcctcttaaattttcgttgaagagaaagagaaatcagcttataagaacagaaatggaaattagaaagaaagtgccgcagacagcaactaaaaagaagaataggagaagctagctttgtcttatttgggtctaatttgctttctgtacccacttttttttctgtagtttcatattatatttttgaaataagcttttgagttttaatttaggtagttgctatttacaatcttttttattattaatatattttacttatattatcaaattcaattgttattttggatttttcaatatagaattatggatgaattttcttaatcaaataattttagttatatacatatatataatataattttaagcgggtttataaccttgtacataaaatattgatttaaattttctttaaaaaaaatttcggggacagccccccaccactaaatctgtggacataaattattttttacaaggttaaagtgccccccttaatttattttctggatccacccctggactgggtcagggtcagtgagttcaacgtgggaaagaggctcactccttcgcaggtaattgctgccagtctacacttgttatcccagtcaactttcgtagcttggtttggcgtggggagagaggatttagtcaaatcagaccaaagtcattttcataattctaataaattaacccaatctcccgcgtttagtttacatcaaccataaaactgtgtcacagaaacccatatcccttctccccgtctgaaatagtcttacacttttacgaatttctgccagagttatgatgccgttgaatataattaatagacgagttttcgacagctcacacctgaattcgattacttaagtagaatgcctacacttgaatcaaaagtagcataggaatagaataactaattactaatttgcatcctagggaaagctgtgttattataattgttattgacctctttaaacaatttgtttttggtcaagacttaaaattaatgtcattttctctctcttttcttcttatctactgtatttatttattgtatgagtttttttattatgaagtttatgtagaaatataactgctcggtattatcaaatcctccgtacaagttgcgaataaaaaaattctttcatgttttcctttattccttattttgtcttaattattaaattaataatgtaaattaattaagctcaggttggaagccaaaaaattcgtgcctaaatttgaaaggctttaaaaaaaaaatactttttatccagtctttttttaaacccagttcgcttaattttcccccacacttttgtattttaaatgtaatttctgtacaatggagtgtaaattactcgaaggattttcgttgtgacgggaactcgggaaggctgcgcagaagctcgtacgttccatgaaggattttccgagtcgacgcggggataaaggattggggaatggtggtgaagatggggatacagtggatgcagggggcgctacgcgtgttctggtggtgaagctgaggattggggaggtggcagaggcgagttcagtggtggtgttgctggtctctgtgtggaggagagggagattttgttggtctctgcggaagagagatgaacaacagagggagaaatagagcacttgaggggaagaggggttaggataaatcaataactaaaatccacaaacctaattttgttattttttgaaataatttgaaatctgttttgaaaagaagaaaaaattcaactggcaaccattttatccaaacacgtttcagttttcaaattatattttaaaatcgaaaatggcaaactcacaaccatcctcaaccggacctaatattttttcattgcttcttaattaatcattataatataacaattagtattcattacttcattattttataattcacaattagtattctaaaattgttttacaactcaattattagtttgagtcaatctccaaaatcaaaataaactatcatggcctgcgagtgaacaagagtgatgatttggaatctttttactttttattactcataatctcttacatacaatacatataaaaaaattagataattactaatttttattatatatttatttatatagtctggttggttggatttgatggaatttaaaacttataaatccattacctaacccaatctaatttggtgcactaaaaaagtccaactcaacccaataactcaattaaattccactgcacatgttttctttcccaaagaacaattgctctacaattttgggctaaaaaagtcgataaaactatctttaagtaataattatagaatttagatgtctctatactaaagaaaagtttattaagttctgtgtgaatgggatgaatgatttaagggaaacaaattaagaacttttttaaaataaaaaaatagtctttatactttttatgaatttttttttcttcaaagttttatatcattcaatttaatctctatattttatataaaacttagttttagttgctcttcataaaaaaacaccttaacttttgtctaatgtgacaaataaaatattttaaaaaattattaaaataaataactgtgtctaattagacaaaagtactttttataaatatttaagaaacaaatcatatttatttattaaaaacttacattttttaaaattatttattttaattttttaaaaatttaaacaatctctctcataacttacatcttgatttttctgaatttggagacaacctagatgagggtagacaaatccgttcattattttcaaactttagagtcaagtttgtgaaaagacatgctaatgtattgacttatgttcttgcatgagcatctacgtcatgcactaatctaaagtttatctattatgttcgtcattatatttcgcagtcgattattaataatatgcttgagtttatagggaaaaaaccaagtatgtaaaaaaattagatttttataaatatttaatgatatatatatatatatatatatatgtgtgtgtgtaaaattgaggggttcattgtctattgtgaatattgtattaaatatttgattttttttcttaaaaaaaaaagcatatttgatatttatgctgtttatagttattgagtttaaactctatcttcattaaaaaaaaaaggttttaactctatctattgtagcctcttaaaaaaaaactctatttattgtaatttttagttggtgtgtattaacatgctacaacaaaaattaggacaaaaaatcactcttttagttattctaactaattaattttaagtgtattgtagtaatttaaaattgaataatttaacaaataaaaaatatttttctctatcctttatgttctgatttaagttttttacatttatatgttctgatatttttgtcaatgattgaaatttaaaataaattttatgaattttcgtatgcattaaaatcaaaattcatttttagatttatcaactatttagaaaatagcattttataaattttgagatgttacgaaattcaaaattgttaggttatttataatttttttttcatttttaattgacaaggtatgtgagatgagagaagaggcgtgattttttatttcaaaaaaagggaaggataattttgatattttgaaaattgaaaaaagggggctgtgttgggggaaaaaatgacctaaaaagaaaaggccgagaaataaatgaagaaaacatgctaaaggttttcgaccccgatagtctaagaaaatataacaagagaaatgatattcacaccttctcatttttactaataaactccattttcaattgtaattgttttccaattcaccatgtttcgttccactatcctccacattcaaaatcctaatatagctataattgaagatacatatcaaaagtgactaaatgacatttgctaacaaaaactttttggatgatagcagggtgctttgaaaagggtatcatgaagagtgtttttgaaaattgatttctagaatgaatagtgacttacaatatccaaaaaaggatatatttggatttgaggtgagtcatagagtctatctctatttatatattatgttcttaacaattctattcacatgtcatggtctcacaaatctttcatcctcactctctggcatgggctcggtcttgtccccccatataccagatgtagttgtgtatgtcttacatatcaagacatacactttcgtgatcatgtcatcatgtttcaacaatttaagtatctaatatagatacaagactaactttttggagtgtctaaattggttgagaaataaagtgattatgataatgttatttttttctctcatgacctaggacacaagtccgtgatcaagataaactcaataacgagttagttaagatgatccaaaattttacaagtattgagcgaccataaatacttaagtgagcaagttggtttataggataagtcaaacaggatgatccaatacaaaataaaatacttatttttgataataaaaaatgacctaaaatcatgaataaaaattaaaatataatttatatttttttatgtattattataaatataaactttaattacataaaaaaaaaacttagaaatagtcgcagttggcgagggtctccccaaaaatgtgacgaggggtggtatttttgaaattcagacagtaaagagcattaaaattgtccgttgggcgaaaaatgagaatcgagggatgatctgtaattttgttgttgggtgagtgtgttgatcggattcgattggaggcaagcaaagtgcaaatcaagcggttaatcaatctttggggtacgaaatttgatgtttgttgagcttttatgaatcacaattaaatacatggtgtgatctgaaaaggcaaaggagaactaaaaaagtgtggaatctattgaaatcaggcggtgctgttgaattctgcaatggcatcggcagcgcctaatgtcgatctcttcgatgcctattttcgccgtgcagatttggatcgagacggccgtatcagcggtgccgaagccgtctccttcttccagggctccggtttgcccaaacatgttcttgcgcaggtctctctccctctattctaattcaaattctgcttattatttgatttacttcacatcaagtgccaccaagcatttcagagcattgttttttttgaattagttagtcactgcattagaaatctgttcgtctaaatgctaaatacttgagaaatcacactgacctgtctgtgtgtctgcagatttgggcatttgcaaaccaaagccagagtggtttccttgggcgggcagagttttacaatgcccttaagcttgttactgtggcacagagtaagcgggaactaactcccgaaatggtaaaagcagcattgtatggcccggctgcatctaagattcctgctcctcagattaatttcagtgccacagtatctccacctgcacctgcgcctgcgcctgcgcctgcacctgcacctggacctgcgccacagattggtcctgttagtcctttatcccaccaaaatcttggaccaaggggggcagtttcaaatttgagtggtaaccagcaaaccctcccttctcagggaaatcagtttgcgaggcctccagctgctgttgccactcaaggaatggctcgccctgaaacccccggcatttccagttatggcaagatgggtggaactccagaagtaactttctctccagtagcagttagaggaactagtcccccatcaacgcaggaggggtttgggtttggatcaaatgtggcacggccacctggccaatatcctgcctcccccataaagtcatcagatcaattggttaaggattctaaaccagtggatacttctgttaacggtaattcttccgattcattttttggaggagatttattctcagctagctcatttcagcccaagcaagcttcttctccacaaggattttcttctggcacttcagcgctttcttcagctattgttcctgtatctggaggaaaccagcattctactaggactagtactcctgattctttgcagcgctcacttgcaacccagcctgttggtgcaaagcttcagcaagcccagctggtggtaaaacaggaccagcatgcctcactccagacgcataatatgccgaattcatctggacttccagggagattacaggattctgcttccagtcaatcccaagctccatggccaaggatgactcaaactgatgtccagaaatatatgaaagtattcatggaagtagacacagatagagatggtaaaatcactggggaacaagcgcggaacttgtttcttagttggagattaccaagaggtatttttcttctacttccttgcctttttgtttggacagttggcttaaaacgctatatatatttttctacttctctagtgttctagctctacatgcattaggaaatcaactcaaatatgattaattaaacatatttccgaactaagttggatttgatagcagttttttgtgtctgtttggggtggggggttctatttagttttcacatcctccatgtgtattacttttcatggctagctaatttcttgaacattatgtttatgccatgttttatatttttcagaggttttaaagcaggtctgggacttatcggatcaagataatgatagcatgctttctctcagggagttttgtattgcattgtacctaatggagcgacacagggaaggatgcgttcttccagctgtacttccaagtaacattgtgcttgatttaccaactactggtcaacctgctgctcactatagtagttggggaaatccatcaggtgtgtgcccaagaattagcaggttttattttactactactactacaatactactattgtagattattactgatataacccttcagataaatgataaatttatatttttctcttatttttgtgtctctgcccccttttatcttttgaagcttttcaacaacaaccagggacaactggttctggtgctcgacaagtgaaccctgctgcaggtcggccaccaaggccggctgctgtctctcagtcggatgaaggacctcagaacaagccgcagaaatctagaattccagtcttggagaggcacctcattaatcagctgagttcagatgagcaaaattcaattaattcaaagtttcaagaagcaacagaagctgataagaaggtgcttttatttattttttgaatcatttctgctgttgcactttttatagggctaaaagtcatgcgatctactctcttcactggtgccttcagcgactttctttacatgtctaaaccaccttaacaaattttctgtcattttttccttgataagtgttacattaatatctcctcataatctcatatacaatcattccatattctgttcttttttctgtggtcacatcctttaatattatcatttcttttactctcacttttttcttttattgtccctttaaagttcaacattcactactgtagatagagtatattcagtaatataggaataagataaaagttacctttcagcttagtaggttctttgcgatcacaaatatggggaatgtgtcctctatgataatcttttcaggtcaattaatttgaggatgtggtgtgatgacattaagttatttttggtttcagtcatgaagcatgcttactctttttggctgatgattgaaacttacagctacaaaaattattagctgttactggtatctttgaagatagcgtggaaagatcatattgtagattgtcatttgcatgaagcatatcattattgcggtccatgtatgcttgataaaattcttgtggttcaattgaacatagtcaattctcatctcttcattttctttgttaaatgcaggtggaagaacttgagaaggaaattaaggagtccagagagaaaatagaattttaccgtgcaaaaatgcaggaacttgtgagtgttttccttgcttacttcctttgtattttattaaggcctgtgtatagaaaaagtggttctgtgatgcattgttttagagctttctttcagaagttactcttttttgcttctgagaaaaccactagagcagcatttttgaagtttttcttttttgaaaatttacaataatataatcattgtaaattcttttaagatgccattttaattaaaaagcactttttcttcaaaaaaataaaagaagcttaaataaaagaggtttaaaactctagtctggtttatctgagttctttttgtactgctttagtctcttttatgtcatccaaacatggtgaagaggtggcaactggatcaataatagctgaaacttttactgtacagggttcgccttgcctagctgtccaagctttagatttattttagaatatgcttaacagattaacatttgatttgtgtacatttatactgtatcttgatttgcaggatgagctatataccatatagatgtactgatgtagctagtagtagtaattgtgaaatgtattttggtcaaaaaattgttcaccatcatgatttattgtactttaggaagaatgcatcttacattcttacaaagagattttactgtcaaagctttaagggtgcaaaatatatgcagattgttttaagtatatataagaacatattcctacatcccatggctttgttcttattgtcaatatccagatttgttaaccaaactaatcattttttactatagatctgctgaacataattacatatcacctgtctgcctcttgggtttcctgtcctattaattttaaggaagtgaaaaagggtctcttggaaaggtcttttacttaattgttatgcattaatagatgctatcccttttctttcagcttttgtctgcttctgcagatacctaggaactactggaaaaaaaaaagcctatgaaacagacatgttcttttgtaacccttttgtactatgaaattgtggatacctagaagagtaaagcatataaaagctatcttccattttgttcgtatggttaatagtgtcagtgtcaggttaatacttaatattcatcgtttctttttcttttcaccttttttaaacaaattacttgttcttttgccaataaaaggttctgtacaaaagcagatgtgacaatcgtcttaatgaggtcatagaaaggatagctgctgataagcatgaggtatctttctttagaattgcatgtgtttttattacctcaataatcataatatttattatttgctcaatatattaatttcaggttgacattttagcaaagaaatatgaagataaatataagcaagtaggagatttatcatccaagttaactactgaggaagccacgtttcgtgacatacaggtgcaatgaaatatggctttatcttcaattgatagcttataagcatatatgctaaaaagtttgttatttttttttacctgttttgcttcattgctgtcaaatgatttttttttttttttttttttgtgtaggagaaaaaaattgaattgtaccaagcaattgtcaagatggaacaggatggaaaaggtgatgcaactctgcaggtacattttaatattaccaggtttgtgcatccatgttgagaaattgtgatcaacttatgtatctcatttagtcatctgaaattttcaggctcatgttgatcgtattcaaacagaccttgatgagctggtgaaatctctgaatgagcgatgcaagaaatatggattacgtgctaaacccactacattattggagctaccctttggtaaattcaaatttataattggtgttgttatatacttccagtccttctcaatctttttcgttatatggtatttagtgcatttgttttagatatcagctttgttttgtaatttgaggaactggccttcagttgctgaattactagttttgaatcagcagtaaaattatttctgccagtgaaatttgatacaggttgcttaatcaagtggcattaaatatatacagtttattctgattttatgtaatttttaactgattttgttgcaaagctctgtttgacaagctctataaaataccatatgatgatgctttgtaaacaatcagttaaaggttacataaaatcagaataaactgtataacctaatcaagtggcatttaatatataaagtttaggaaatgctccttatcatgaatgttttctcttgtgcaatttttttagggaatcaatttactatacaatattattggggaaaatccaagtcccacatcagctagagatagtgtcaagatagagtatataagtggggaacaaccctcaccctatgagctagcttttggggttgagttaggtccaaacccacattcttagatggcatcagagcttatcttagatccattaacgggctacccaccatattatccacgtaccaagcccaaaagtgctgggcgtgaggggatgtattggggaaaacccaagtcccacatcggctagagatagcgtcaagatagagtatataagtggggaacaaccctcaccctatgagctagcttttggggttgagttagggccaaacccacattctaagaaatatgatgatgctttgtattgatgcttatataattatatggttctttgtagtagttgctactgtacttgctatcaaatgttgggttaatgcattgattttatgaaaagaagggaaacttgaaactctctgatgtttctgagaacagtatgcaagaaatgctatgcatttccatcttcaatacatttgatttaattgatattggtggtgttctattaagtaatgcttatttatttatattgctctgacaaaaaactttagttgttggctttctgtatctgtatgattgcatttatctatcatgattttaatgaagctaaatgaatctgaaagtaaaactgagagagaactaaattgaggtgaaagaatattgtattcaacccaaacagaaactgagaacaatacagtttatatttttttttttttatcagcaaagataatatattatatatatgaaaagaagtacaagaagtactgaaaaagaaagaaaaggccatcagtaagcctaacaaagctttggcaacctaatacatgataaaacctgaattaaggtgccaaagatcaagctagagaaacccacttgatggcaaaagaaaacaaaagttatagttatgtaactgtcaactaacttgagttagttagtgacagctgtcaaacagctgtcctaactatctttctaactaatagcagtctaactaccaactatagttagactcacaacatgactaaaagaaaaggaagagttacaccgggtaagtatactcctaaagaagctcagaaaactttttatagcctacaaattgtctcttcatttttgttaaatgaacttgcttcctttttgttcacttacttgctaagtgcattgttagcttttggatataattatcatgtattcttgttttgctcattttagtcgggtcccatcatttctctttgctttgtggtgctctgcccacaaaccccatgtgctccccttagtatatattatattgaataatgcaataattatgtgcatatcgagtttgttgtattctgtagcctcactccattttatcctgcaaggctggcaacctggtatccaagaaggagctgctgactgggatgaagattgggataagcttgaagataaaggtatccaaaataaccctaactagatatgataatctgttaattgaataaaaataaaaatgctgtgccaattatgtggcatccatcattaattacgaggaatttttgcacaaggttatgaaaccacatttttattttatacgctcttattggatgcctacctgcctaccttctgtatcatcaaactcaattggatttcatttgcattttgataaggatatttttttgtcattcttataatttaaggggttgatctcaaaaagaaaacttgtttgtgaagtattaaagtctgtattacttgtttcttgttttgcttagtgtttttcatccttccatctgtattttcttctgcattaataaaattgacagcatgtatatgtgatacattatgatttaatgcattatcatttttttactgttcttccttggttatttgcacttttagtcctagtaatcacatcagatatgtttcgaaagttgggaggaaagggaaggcaatgaactagggaaaggaaatagagggttatataaacaaatttaccaaattatgtaatatttttatgctaaattgcaatattggtcccctttaatttatgatccgtgattttggacccccaatttttttccacgattttagtcaccacattttagaaaatccgcaactttggtccaatcctcaattttgcatacatttatttattttattttttaattttaattaattaaattatttcttgatacttgatagtaccttaagttaatatgttagatctagggtttattttgggccaaaataaaagaaataaaatgtatgtaaagttgaggattggactaaaattatggatattctaaaacgtggggaccaaaatcacagatcaagaattaaagggggaccaaaattgcaatttttcctattttttatgaacctattcaacctaattgatgataagtccacaaatacaaaaaataaagaatatagagataataattaaggaaataaatgcagacaatatctcttcagatcagagaagaaattgcaacattgaggtaagagctgaatcttaaggcatgcctactcatgacagacatttttaatagctgaaagaaaattataatatcagaagactaagcaaactgatctgcaacctttgtggcaagtaaataattaatgggtgagggataatgaaatttggtactcataagttttacaattggttgcagcatcaaaagacccaatagaatctggccagtcttttttctatttgtaaattattctcttctatgcactcacagaccttagtttctatcgctttctctcttctatgcactcacagaccttagtttctatcactttctctgcttgcctatacctctcttatatctatatttcttttacactaagtactttgtttgctgatgaactttacttagctgtactttgttgtgtcattattttctaagtgtagctgttcatctaaatgcaagggatcaattttgaacagttatgtagttcaggagacaatgcattccaaaaataggtgtatatttaagagatattataagatattgattgaattgaaataatggttaactgatacttgtttattttctgacctgcatctgttcttgtttggattatcatggaaaggactaaataaattttgttattcactattcttgcagaatttgtttttgtcaaagaactcactctcgacgtgcaaaacattatagcgcctccaaagcaaaagttgccgtcagctgtgaacacgaaagctgtgaacgcggaagctgtgagcactgacagtcctacatttgctgcttctcccaagagtgatgataagtcagaaaagccccagactaccaatgaacagggagttggcaatggatttgtttataataaaagtgatgatgggtctgtaaaaagtgctcccaatagtccatttgcaagcagtgctatcggaagcccgcatggggattttgattctgacattagaaagacagctggtgaagatagcttactccgtgatcaagataccatacaagaaacccaaaggtatggtttttaagatttattcaccagtttcccaaatgctggccaattgctcatttgatcatatatttagtaggcgtcctcttattttgctgaccattaatattctttatgcctttggaaggtcatggtatttttaataataataatatgatcatcaatattgttgttgttgtttttgttagtgtcttaaataactttttgtttatatgaatttttattattcctaccattgaatatttagatattgattcaatgaccacacacatcaagttttatataaatcagatatttgtagttatgtaatcttatactcaacatttacttatatttttacaaaaatattttatattttaaattaaatttatttaacgaagtatcaaatagttttataattttataaaaaattgtagacttgatgtactaaataagaacttttaatttaacaattggattaataaaatttgatatatagagttattgaagggagtaactttacaaagagttactcctcctatagtaactcgatcccttatctattattattattgttgtacaaatatgttgtactcctccactggatgctcccattagaacaaaagtttgttaccaagaagtcgacacaaaaagaggtagaggtcgaccgaaactcacccagggaaaggtaattaaacaagacctaatagagtgggatatagattggcggacgatgtgtcttaggatggagtggataaaagttataagcttggtggagggttaaacccattagtatgtatatgttccagtcgttcctttttttttagtttttagttcttttcctcttcatttctcccctcctcctttcatccttcttctattttagcttatttttcctttcttttgtcttattttccttttttcttcccatctccctttctctttctttgtctttttttccaatctatcattgggttcatctaccacagaccccaattaacttgggttaaaggtgctgttgatgttgatgttgatgttgacaaatacggtggcattatcgttaaagactccttggtctacacccaacaacttattcttctagaagatttgtccttgacatggttttacagcctcttactgtttggataaaagtttgatttgtgctgccccatttttttcaatcatattataactttagcacaaggaaaaatgagcctgtgcatttccatgcttcaactcaaagggattttatgtgagtgtgtgatagagaccccacggttagcaagttttcaagagtcattcataactgtcatctctcatatgatgtgtttaacagagtcacaaattgttgtatatcatcactttatagattttggactatcatatttttttatacaagtcatagttgaatggtgatactatcatcagcatacacacattcaggttcaggttgattcaggttctatcaaatgaccctattaaaatttttaactaggtaaggatcaagctaaagttgtgtcttggtgacttgttggtcataggttcgaatcccgaaacagcctctttgcatatgcaagggtaaggttgtgtacaatttccctcccccttacctgcgcatagcgtggagcctccgagcaatggggtacgtagtttttttttttttttagggatcaaactaaacctgtttcaacccgtcctatgaacatttctagtgcatgatacggactttaattcccaaatttggtttgaaattgattttgacatacatgagtgttaatagataccaatgtatattttgtttcatattttcacatagtatggatcttttgatgatgcaaaataatttacatataatcttgcatatgtagtgatcatggtggtgtcaaatctgcgttttctggagacaaaatttttgatgaaccaaattggggaacctttgacacaaatgatgatattgattcagtttggggattcaatgctagtagcttcactaaagaggtatgccaattctcacaccttaatgtcttggccaaattattttttatttcaaaacacgtgtttgccagttatatatatatataggtgtttgtgtgtgtgtttaaatttctcctgcactattctttcttgtcatgaccactggtggttgttgaaatatggagtatatgtaactaactgaattgagatgtaatattttgaaaacactaacccaacactatattctaatacagcaatgaatgctaatattcaagtaagtaacaaatgttgtataagtaacatgacaagactctttacacaataatgatattcctaatattctaacactccccctagttgaagattagtatgtcggcatcttgaaactttgataggctcaccaaagcacacaatgttattagggttcccaaacaatgacttaaatacatttgaccaaaaaagagcattaatagagacaacatagtgattagattgttagaatgatgctcatctggaagatagtcaagatgttacatagcctatgaaggaaaatattactggaaagatgcatactaggaaattgtcactattgagaacagtcaatgtggtaatacaaatcatcatttgaggtatgcatatttggaaagaatcaagatattattgacaaaagcatatagagaaaggctcaaatacactaaatttcttctaatttatctataacacattattgtgaaactttaaactgaataaacctcaaatttgttgagatccgatatcgactatagatacaaccatagtagaacaagggcttgaacaatggtaatttcaagagctagcttttgcagttaagataggcccattcaaaacagaattttgagacaaaaccttgatcatgtttcatttggtagtcttcctccacaattcaagtttactatatttctttcttttcttcactcgtcaactaggactatgggccattttgtttaaacttttttttatcagacccttttgtttaaacttgaaaaaacaatttataagaaagcgcttcttaagaagtagataggaattaggatttgcttcttaaaaaaaacagaacactgcttattttaagaaaaagtagcttagacaaacacatcagaaaagaagaaaactgcttattttattaaaaaagtgctttcttaaaaaatgagcttaaacaaacagacccatatatataatttgtagaaagtgtttattgatgttgagaagaagaaaaagtaagatacataattgaatccatgtgttagtgtacacagcggggtgtattattatatattatggtctatgggtttaataatttaattaaagagaaaataattacctaatttccataattatgtaactcatagaattacataattaccataattaaggatatttatatgcagcaattgcctaattaccataattgagacattgactcttggttgtgcctaataagcatgtgcaataccatgatagaggcacgaaaagttgacccttggtgcaagactacagttatattacaactctattagttcactcgctatttattgcctaagataaaaagttggactctaaattgaccttggtgcaaacctattttgtaaggaaatctttttttgataactccatttcatatcctttacaattttcttatataaaatacaaactccttatcactagagttttacattggacttcttgtggtaccctatcataggatttttccagataaatgaagattgtgctggtcttttgtttccttttatagatttcaatcgaaccaagcattagttggcctccatgtggttgttcagaatatgacttggatgttaaggagatctaaatggttacattacgtgatacttgtgatggaatatgaagacatgatgatttagttagtaggaattcagagcttttataagattttatgattgtgtcttaaaatcaaagggatagatgtgtcattctttgcaaaaaagtatggaagccagtttgcaaaggattgatgggatcagaggagaaagcataatgtaatctgaatgtgctagatctgccagcccaaagatatataattgaatatatttgaagattgactaaaaatactgaaccctcaccttctgttaatgtacttggtaatatatttcttaaatttaacattttgagttgcttgtacgtgtttgatcaatggatatttatactctagcaatctactcattactttccggatttttttttttttaaaaggagagagatcttgatagagctgggaacaactatttctttgattctggggaactggacttaaaccccatcaaaacaggttcaccacaggctggtgatgtcttccagaggagcagtggattcagttttgatgattctgttccaagcacaccactttacagctcaggtagctctccgcaaaggccaaaagagtggttggaaactgcttttgacttctcaagatttgattccttcagaacacatgatagtgtatctttgcctgctcgggagaagacagaacaatatgattcagtacgcaacagtgtggattttgaccatgctcatgggtttccagcttttgatgactcggatccctttggctctggcccgtttaggacttcatctgataatgaaactccaagacgaggatctgataattggagtgctttttagtttaggaattccacccgatgcattatttctttttgttttcagactttccgactgttgcctctggtggagtgggttgtctgtcttgctatctggaacctgttatgtgtaatgtatttcttgtatttaatcttgtgtattccttgttcctcactttttctttagggaagggcgcaggtttgtccccagtccagcaatcttacttcccttcttaaaatgaaagtgaaggcctgtctatattttttgtttgttggttgttaattttccatagtcccgtagaagagattgtggtattgatgactatctgatttgagtgttgtttactgagcggaattttattatgattctttgtcatatatgtggtgaagtataacttgaacctaatttgtccaattaaatttagtgaaatgtaaacaatatactttttaacacaattttcattattaactgaacttatttcacgtaattattagtgactgaaattaatagcattcctcttcaatctaatttcgtcagaactcgggggttggttctgattttgtagtaagttcttattggagagattactgatcaaattatgttgtatttgggtggaagattttaaaattaaaaggaaatgcagtaaactaaattgtcatcatctataaatttattgtttgcttagtcattaagaaatttaaacaaatttaaacctactctttattttgaaaaataattcgagtaaagtagagtatggttgaatctacaaaaattaaaagaaaacaagaaatataataatgtgcaaacaaagaaattgttagaggttcaataattagcatttataagactagtccaaattttcaagcctcgaaccaaaatgggatggaggctgcagtctcaaattatagatgtaagttattcctctaattttattcaattcacaattttaattctttatattttataaaaaataaaaatatttagtctctctcttttactacattgagaattttggcctcaactatcaattcaggccattgactgatatgtttagcgttgactgcggtgacatgcctattttttatttaaaggtgtatagtttttagttaattaattaagataataaaaaaactgaacaaataaaaattgtttatatattttagtttttaattaagttttattaaattaaattttgtcgtgatcaaaacattaattaaaagtttaatattatagtgtcacgttaacaaattaatggtcagcattttttatttaatcgtcaacgtcagttgagacttatgggatcaaaatcctccattttataaaataagagacttaaatattaggaccaaaatcatattttaacctacatgcatgaatatgaagaagctaaaaactcaaacaaaacaccaaggttgttggcgtctaagttatgccatttgaattacttcatagtggatattgcttaattgggagtccttgagcaaaagatgaagttggtaacagtaatatgacgtttggtaggttaatcatattttataattggtgtacatgtgtaatcccctcataaattattacctaacttagtctttttttttttttttttggaaaatatgtaagaatatatattaaccaaaatatagatacaaaaactcagggtataccctgactatacaaaaggaggctcacctgactatacacttgccccaaaagaagcaaatgagcaactaacaacaaaagaacaaacaaacaagctagcaaaagcccatttgctaatacaagtgcttcaggtgagcaaatctaaggatcatgaatttaattctatcaatcaagtcagccaaaataaatcggtgattatcaaacaaaatgcgattcctgcagttccaaatgcaatacaccacgtttgccaaagcaagacaacgaacgtttccctgaattcctgatgtagcccgcagatgcactatgttgttcagagtgccctggagcgaaacattacgtctcggaaagtttgcccaatcccggatgtgagcccaaactttgagggtcatatgacacttgaagaaaagatgatcatttgtctccgtttcacggttgcagaaacaacagatggatcccttattgagaaaaggggctcggtcaagagttagcaattttctgctagcggccaaccaaaaacagaaagcctccttgggggggatgcagtttttccatataaccttggcccagaattttttgggagagggatttctgagtgcatcataggctctacgagggttgagagtgccgttttgggtccagctgtgcaactccatctcagcttggttggcatcaccagctttgatcagcaggctgtctctaatctggaagattcttttaacaagcgctgaatctgaatccgcacatttatacagccatgcggaggttcccctcaagtatatttgatgaacccacctgatccaaagggattgcttctcggagacaatgtcccaaaggattctggtgagcaaggcgttgttccagcttttaagattgtgaagacccagccccccttcatcctttggactgcaaaccaacttccaagccacgagagctttcttcctccctaaaccgcccttgccccacaaaaaattcctactgaaggcgtcaattctatttaccacagccataggaagaggaaacataccaatccagaagttaaccaaacccccaataacaccccagattaattccagacgacctgcgtaagatagaagcttctggtgccagttttggatatatgtcccaatccggttcaagagaggggaataatggcagacatttaatctcgatgccaagagggggataccaaggtatctgatcggaaacgagccaatgctgaaaccagttagagtaagcagctcggaaagagtatcatcgtcaacaccagccgcgaaaagggaagacttggcgttactaacagttaagcctgagaccttgcagaagctgcacaatctgccataaattgctgccaccgacgggtagtcacctctggccagcaggactatatcatccgcaaaagccaggtgagtgatattgagcgcagcacacattgggtggtaattgaacaacatgctgtttttcagatcattcaagtcccttgaaagaaattccatacagatgacaaacaagtagggagagagaggatccccttgtctcaaccccctctttcctttgaagtggccataaatgcgcccattgacggagacactaaaagaagttgtcgatatacactccattatccatctagaaaagatgtccgggtagcctagggccttcagcatccattcaagaaaatcccaggataaagagtcataggccttgtgaaggtctatgtttagcatgcaccggggggagctacgcttcctgctgtactttctgataatttcctggacaaggaaaacattgtctgccatgtttctagctttcacaaaagctgcttgggctggatcaataacgtagggcaaagtaagcagcagtctctcagcaataagctttgagataatcttgtagattaagttgcagcaggatataggcctgaattgggtgacctttgtggcattttcagctttgggaatcagggctataaaagtatgatttatctgtctgaggagcttcccggaattgaagaaatctgacacagctgcaacaacatcagtcccaataataggccaggcttttttatagaacatggcgttaaacccgtccggaccaggggatttgttgatgtccatattagaaacaatcctccagacttcatcaggcgtaatgggcttgagcaaatctgggataagagtggttggaaccttggctcctctgtcaataacagcttgagaaggaatttcaccttgagctgtggtgccaagaacagaggaaaagtaagctgagaattcagcccctattgcctcttgggatgtagtaacacttccatcatctcgcataatggccgggatgaacttagcattcttctctttgttgataagagaataaaagaacttggtgcttctatccgtttccacaagaaacttgttttttgccaattgagccaccttcctggactcagctagacgcagctctaaagtgccagctctgttagtggcagccctgaggatattctctcgagaaggagattgctgggcaatataaagagacttgaaatattcctcttcagctctatcaattttgtctgagataccactatactccatattgtagaggtttttcaaagctggcttgagcattttcaacttcttgcaaagttgaaacattttagaaccaaacacctccctgttccaaatagaagctaccaaaggaataaatttattgctgtcagccgtggcattgttaaagcggaacgccgaatggcctcttctcctgctagggtcagaattgaccatcactgctgcatgatcagatatagacagaatgtccgacacaaaggcataagattcctgataggagcacagccagtcagcattacaaagggccctgtcaatcttgctccaggtggtcccatttgtccaagtatactccccaccacaagttctcaactgttgcattcccaggttagagcaacattcccggaaatcagccatttcataatccgatactgcagacccattctttctgtcatttgggctcagcacactattaaagtcacctagaataatccagcggccacctattctgctctcaaagctctgcaaggagctccatagaggccttcgagcagatatggaatgcaacccataaacaaaggaggcccaggaggtggtattggagattttacagagaatggagcattgaatggcttggggggataaatccagcacatctaaggtcactctatcatccttccacattagcaggatccggccagcattgtgaagtgagaaattgtgaacataattccagcctgaaaacttcttagtaatcagcgaatcgacacataagcttttcagcttagtttcaaggagggctacaacatctacctccttcaagcgcaaaaatttctgcacctctcggtgcttaaggggcatgttgaaaccccttatattccaagcagctaaaatcattgttttgggcgggaagaggtctccccgacacaacctgatttagtctgcttcctctccttcatttttcctttttggctaccagcaattccccctgggatcagaatctgtttcttctctcggggtcctttccgaatctcatttcctgcatctaagtacatcttggccttgtcacggtttctagatttctttttgatgaaaccatcatcactattatcatcagagcaatcctccactatggccaaatccttcccagcgtctccttttgactccttatgcatagctgctagagggcaagacgcgtctcctgtttggtggggatttgaggtgttcaaatcccctacttcctttgaggctagctcattgtcagttttcttttgggcctctggctccaggttctggattttgctctgtaatagtacatctttctttaactcttgttgaacatttctatttccctgcatctgcttctcctcccccccattagaggtggatttagcatccttacaacttttcccactgtgtcctatgactttgcaatgattgcaaaacacaggaacagtttcgtactcaatgtgttgcatgaatgtcttccctctagatgttttaatcatcacctcacgcaccaagtcaagtgatgcatccacctctaccaaagcccgggcgaaagatagagagcccctcgtggctgtcaggtaatccgttcgaataggagttcccactctggataagattttcgccaaagccgatgggttccacaactccagcggaaggttcctcatcttaatccaaactgggaatttgctaagttcctcatctccaaagttaaaaagttcaggcataattttaagcagaagaggcctctggaagatgaaataagggccatttgctagcacataatccctatcctcctcagacctaaacttgaaaatcagccacccactatcatggtttgagtaagagtattccaccccccatttctcacagcattggagcagggctttcttgcccgggaacctccccgccacataaccaatcagaccaaacccccaagccctgcttagaggctggatatcttcatcctccaaccacacaaagtttgcattgtccaccggcactggctcgagaactaagcctttggatggttgtcgattttccttaaaaaggtttacccacggagttgcaccatctcccttatcctcattcttttcctgactcctcctctcttcatccttggaagaggcatcattatcttcagtctgatccacatttgtatccttagtgcccagagtaatagatgctgtagcactggccgatgaaatttcagggatatttctttcaggcaaattgtcgaacacatggtccgcactgtacccgatttcctcctggtttctgttctcttccctcctctctggttcactcaactgaacctttctgtccggcatttcatcgaacagttggagggcttcgaagttgggagattcaatggtgtcccgagagtcactctggactaccacctccttccccttcatactggtacccttatgcctcgactgcttctttccttttcccattaatcactcactggaaaacatacccgaagcaacagagaagtggacaaacctgcaaataaacccaaaccaggaacagtccaggactgctgttcctgggcaagatgaagagaccacaacagagtactgcctttggcagagtacaatcaatacacagaatacacagagattgcggaaacaggaattacaacacgattacaactaataatcaacaaaaacaataacaacagccaacttcttcgacttttgtgcagctgaagcaccgcccaaaccactcactccgatggcctaaaccatagggacacgcccaagggagttcagaatgtgaagctacctaacttagtctttaaatagaaagtttctgggttaagatcaaagagttggaaacttgtacccaaactcacttgaaaaaccaaaacatacatgcattcagagggaaagatgtataaacttccaaaaagaaaatataaattcctcttggcatcataaagtgtgaaagctgtcgagatagcaaggacacagatatattcttgtacaaacttgaaacgttgaaattaagtacgataaatgaaacgtcacaatctgcttgcattcatgtcagtcaaaatggcccttgctgtgctcactcagacaccgtcccacttactgtgttggacgtggccctctacccgcgtgacgtggggtttctgctttcattgcctcccgctacagttaaagctatcactatctcttcaccactcactctacattccttcatattgtctgtctacacttcccattcaaatcaaacagcagcagtagtagcctctctctcgacctcctctacattacatatataattatgaatcatagtttctggatgaatttgctatgcgttgcattattaacattgatcctattacatggagcatcaagaggacatgatgatgtcgtcaaaatcggtgccatattcacttttaaaactataaacggacgagtttccaaaattgccatcgaagctgctgagaaagatgtgaattccgatcctggcatcctggtgggacgtaaattgtccataaccatccatgcttccaacttcagtggttttcttggctttattgggggtatgtatatgtatcacttcctgctcctgcttgcttgttttattttatatatattcatttacttcctaattcattccagccctcaagttcttgatgaccgactcagtagctataattggtccacaatcttcagtaatggcccatgtgctttcgcatctcgcaaatgagctccatgttcccctactcttctccacggctctggaccccaccctaacacctctccagtatccttattttctccaaacagcacccaccgatcacttccacatgaatgccgttgccgacctcattagctattttggttggagagaagtcatagcagggttcagcgacgatgatcagagtcggaatgggataaccgttttggggataaacttgctgagagacgctgtaagttgtcttacaaagcagcactgcctcctgatccgactgccactccatcccctgttactggtcagttagtgaagatcaagagtatggagtctcgggttatcgtcttaaacaccttcgcgcaaactggtctgttggtttttgaggtggctcaaaagctaggaatgatgaccaaagggtatgtctggatagctactgcttggttatcaactattttagactcaactacttcactaccttcagatacatgtaactcaattcaaggagttattaccttttgccctcacacccctcaatccagaaaaaaaaggcatttatctcaaggtggaaacacatcagtaatggctcaattgggttaaatccatacggcctctatgcatatgattctgtttggatgactgctgaggtactcaattttttttttttttttttgatcggaatggtaccatttccttctctaacaatacaaacttaagtggtacgagggaagaggctctggatttcggtgctttgagcgtttttgatggagggaagcagttacttgataacatattgtgcattaatatgactggattggctggacctatcaatttcgttcagatagatctcctctaaatccatcatatgacatccttaatgtaattgctacaggttataggagtatcggctactggtctaattactctggcctctctataataacccctgagaaacttcacgcagagcctgccaatcgttcaatttcaagccagcatctaaaccttgtcatatggccaggaaatacaacagaaaagcctcgtggatgggttttcccaaataatgggaggcaactgagaattggagttctcaacagagttagctatcaagacacggtctcgcaaataaatggcaccaatgcagttcaaggatattgcatatagatatattcctagctgccgttaaattgcttccctttgcagttcaataacagttcattctgtttggagatggacacaagaacccaagctactacgatcttatcaacatgattacttctgatgtaagtaatgctcactacagagaacaaacataatgtagtaatattttgcttttatataggtagtacctattaaatcctttaagttatcctcaactgtacagtctcatacctgcacagcctctggatccctctcgttcgggtgtgtattcgattcattcatgtacccctcccgctggtacctgccaggaaccgctccttgtccgtgcctcactgcaccggcgatcactcctcgcgctcgtcagcgcccgggatgttacatgcccaccagcttccgcctggttcgtcctcgaaccacaccgtactggtagagaggccttgctctgataccacttgtaacgcccggccacttgcgtccctacataccaacacaagacttttcagtgtgctttgtcctcactcacacacttcctgagaaacttcccaggaggtcacccatcccataattactccaagtcaagcacgcttaactgtgaagttcttatgttatgggctaccgaaaagtagatgcaccttgttggtataggtagtacctattaaatcctttaagttatcctcaactgtacagtcccatacctgcacagcctctggatccctctcgttcgggtgtgtattcgattcattcatgtacccctcccgctggtacctgccaggagccgctccttgtccgtgcctcactgcaccggcaatcactccccgcgctcgtcagcgcccgggatgttacaaccatttactccacagatgtgtggtgtcagtgtgtcactgcattttttttcctttttgttggagcagtggtgtggattcttgaacatagaacaaacaatgagtttcgggggtcaccgagggaacagatagttacagttctttggtaagtactcttgtagcttgtgcacatatctagtctggtcataactcatctttgtatgctgttgcaggtttagtttctcaaccatgttctttgcgcacagtaagttgtccacccattttgacagttcatgtcctattcatgtttgtggctagaaacagataagcttctttattattgtttcaggagaaaacacagttagtccacttggtagtgttgtgttgataatctggccttttgtggttctgataatcaattcaagctacactgcaagcttgacatcaattctcactgtgcaacagctgtcctcaccaataacaggaattgatagcttgatatccagcagtgaacgtatagggttccaagtaggctcatttgctgcaaactatctcactgagcaactcaacatccctaaacatagacttgttcctcttcgctcaccagaagaatatgctgtcgcccttgaaagcggaactgttgcagctgtagtggatgaacgatcctatgtagaacttttcctttcaaaccactgccaattctcaataaggggccaggagttcaccaaaagtggatggggatttgtgagtattttttaaaattacttactggtacttttctcagggtgtggttttttatgtactttgttgcactaactactaatgcagaaagcaaaacatgatgttagaaggtatgatattttataaaatgggaggcaataaatcacaacttcgcttccctttagcttctttgaatgaaacaatgaacactatatatgttgatggtagttgagcacaaattttgctcaagttcagtactactcgatcctagatgattctcaactgcaattcatgtacttgtaaatctttatgttactacttgtctttgattaatttcttaggtgtcacggcaggcattcccgagagactcctcttgcaattgatatgtcaactgcgattctaaccctatctgagaatggagaacttcaaaggatccatgaaaagtggctttcagaaaaggcttgtggttttcacagtactgaggattaacagcttcaattaaagagcttctggggcctgtttctaatctgtggaataacatgtttcctggcgcttcttgtctattttttttatcaatggtacggcaattcaataagaaaacccctcaaaaagttggtatttctaatcattgcagctccgttcagcacgcatccagacatttttagtgacctcactcacctaatgttgaagccaaaacttctgcttgcttctggtgaagatatataagcactcataattaatttagtaatattacagattatttacttgcatctaggttcaagctagtgtgaaacatttatagttaaacgtgttcgtttaatcatgcatatttacacaacttgattttagcggttacatactatagcaatattttttcaatgaataaaagctaaatgatacttttgattatttatgttttaatatttttagttttgttacataaaattttaaaagttttatttttattttttatgtttttgaaatgtttcattttaatcaatttttttttgttttaaatatgttaatcgaaaaatgtgatgtatttgtcaatactaattagaatgataatgtaacatattaattgaatcgataaattgaattattttataataaatggataaaataaatattaaaaaatagataatggtaagagtataattaataaaataataacaattaatatcatcttaagtttttgttttaaaaaaatgggcagataaaaattagtttttgaaagaaaaaaaagtaattggatctatcttatatcattcaaaattaccttaaaattcttattaactgattttagattaaaaaattgattttggttttagaattaatacttatttaaaataatttttaagttgagtaaaaaaaattaaattatgttactaacttaattttaaaataaaaccttcgtcatatttcttaaaaattctaaattaattttagaaagtttcagcaaaactatggactcccaattaaagtaccaacaatttttgttttggttgggcatgggaatgacccaaacaaagacacaaagtaaaaaatgaaattttaaatttaattgaaatacataacttgaatcgtagttggtaggattataatttggaagagacaaacccgcaagagtggagatggcgacgtcgacgacgtgcttcctgtgtccgtctacggcgagtttgaaaggcagggccagattcagaatcagatgctgcagcagcaacgtgtcagtcaatattcgaagggagcccgaacctgtaaccacattggtgaaagcgtttgctcccgccacggtggcgaatctgggtccgggattcgacttcctaggctgcgccgtggacggactcggagacattgtgtcggtgaaggtggacccacaggttcaccctggcgagatatgcatatccgacatcagcggccacgcccccaacaagctcagcaaaaaccctctctggaactgcgccggcatcgccgccattgaagtcatgaaaatgctctccattcgatccgtcggcctctccctctccctggagaagggcctgcctttgggaagcggactgggatccagcgccgccagcgccgctgcggccgccgtggcggtgaacgagctgtttgggaagaaattaggcgtggaggagctggttctggcatcactgaaatcggaagagaaggtgtcggggtatcacgcggacaacgtggcgccgtcgataatggggggttttgtgctgatcggtagctactcgccgctggagttgatgcctttgatgtttccggcggagaaagagctgtatttcgtgctggtgacgcctgagttcgaggccccgacgaagaagatgcgggcagcgctgcctacggagatcgggatgccgcaccacgtgtggaactgcagccaggcaggtgctctggtggcgtcggtgctgcagggcgacgtggttgggttggggaaggcattgtcctctgacaagatcgttgagccaaggcgtgcccccttgattcctggcatggaggctgtcaagagggctgccattcaggccggtgcttttggctgtaccatcagcggcgccggccctaccgccgtcgccgtcattgacgacgagcaaattggacacctcattgccaaacacatgattgacgcttttctccatgaaggcaatttgaaggcttctgcatatgtcaagcagcttgatcgccttggtgctagacgcattccaaattgaaccttctcttctctatctctatggtacgcttcacttctctaccgcttgttttatacttttacttgcttctgttcttcctaatgctatatgattttgcccaattcttcacttttctccaaccgatattcatacgacaaccaaggccttttctaatcttctttattattgctactttttttaactagccttatgatttcacaaggtctaccttataaattcattattacttctttcttctcatctcaacccccattcatttcttttctaagcttcttgaaattgattgtgattttctaattaaatgcatctcacggccttttcttattcgtatatatgtttttaacaaacaacatggttggttgacaattttgtatcagctactgaattctaatttattatgcttgccagagagagacttgtagatttcaagatccggatttcttccaacttgctcgtaacaccctaagtgctgaccgcacacatgtatttgaaatttgatctgatcaatgaagcagcattctagtgtggaggtctgaataaaaagagaaacattaaaaccaagctgggagctctgtttgggtggtggaaatttaaatagatgaataattatgaaaagacctagatcaggtcagtgttatggtgaactcaaaagcatgttttagattttctttgcttttgttttgctacttgagttgacaaagctcaaaaagaagtcatttttagtcttttcttgtttcattatgctagttaatcttagcttttgaatagcatgtattgttccttaatatttctctttatcatgtcactatcaatgttttctaattctttcttggttaatctaagagtttatgtggatggaggctttcatcacggatttcaattcgaaagctcgttcctaggttatatgtatggttgctcaaagaaccattgttttatgatgagctgaagatcgatcattgtttatttgttaccgcgttttccttctgttttctttgaataagtttgaaaaagaatctgtgcactttttcctacccttgtttgtattaaagattttgttgaacttactgtatttgaacattgaaggaagaaaaaggtatatgtaaacattatctaattttacctttgttaaactaggtcatcttctaacgaataggtagtcatcacattaattctcaattcgtttttactaaattagacttttacaaaattataatattattgcttaaaaaaaattactatcaaattacttagaaatttaaaatatcactttattcttttttttcaaatggttaaattaataacaccaaatttagtgattattttaaatttttatgaaatgaatttgacaacaaagaaataaaggattagtatcatgatcttaatacatgttaaattaagatgttttaaagaattttttacatcttggtaaaactttcgaatttattttttctctcaaataaagtgtttccaaatactagaaatcaatttggtaacaaaaatgaaaataaaacatcataatatttgaagggtcgaattctagatgtacagtctaaaacaactatataaacatatacgattttattttaaaaaaatgtaatggctttttccctcatatttaaaactattttatatttatcgtatatgtttacacaactataagcatgtgtaatacagtacaatttaattttgacgttacgtaacatgctttatacattctgcagtcaaattagaaacatgtaactttcaaataattaaatgtaaaaatcaaattttgttattaatataacaataacactataaaaaaaaatattgacaacatatcaaaattaaattataatcagtaatacttttttttgttataatttcattttaaattttattaactattaaatcttttcatcgggtttggtgtcaagtgcgatccgatgcttagtttggctcgatgtttggtgtaagtgtagtccaatacttagtttggctaggtgttcaatattaaatttggtttggtccttagtttggctaggtgtctatttagtctgatgcttagtttgattaggtgctcaatatctagtttgatctggtgcttagtttgacaaggtgtttagtgtcaagtttggctcgatgcttactttagttaaatgttcaatgttaagtttgacttatcctatatttggttagatggaagaaaaataaggaaggaaggaaaattttaaaatttgaattggaaagaaaatgaaaagaagaaaatttttaaattttttattaaaaaataatttttcctttcattttctatctaaacaaacataagaaaatatttcgttagtcgtattttctttcttctcgtttactctcttatcaaacgaatccttaatatttggttggcttggtgtttgatgtcaagtttgatcttgtgcttaattagtttgatatttcatgtcaaaatagattcgatgtttaatttgactaggtgtctaatgcttggttttaattcattaaaataataacatattcaaaacatttataatacttaacacaatttccgattatattactttcgattctctgtatatataaacaaataccaagtttatttatatactagaaataattatccaatttatcaagatcaatataagtagttaaattagataattttaattaatatcaagaattttgaaaaaaaaatactcataaaattaacttatttaagaattagttagatataataacactatttataataaaaaaaagtgatcttcatttcacaatgaatcaaggatataaaagaaaattactcattaatacattttaaagtgattatatgtttttttttataattttgtcaaaaattaaaaatgtttttttataattaaggaaaaaaatactacctttcttataaaaaggatttaacattgactataatttctatggtagacactactcaccttaaaattttccgttcctatttttgttataccaaaaattcctactttccctaacatctctgccgcataaaacaagatttaaaaatgaacgtttatctaatttctatgtataaaccctcgttttacttcctgacattatgtatgtctaaaatttaacttcacaaaactataattttataaaatactatattttaatattttcttcataatattttgcactaacgctaaggactaaaataagtattattaaaaaaagaaaaaaaaaagtaaataacattttataaagtcaataaataagggttatgaaatcaaattcgaatgttatagtagatgcttataattttattgactaacgagtttcctttggactttctcatttctcaaatcccaaatcccagcccacgatgaaggtgcctcaagaggaaacaaaacaagaaatccatagattgaaaataattttatattaaaaaagatccaatgggtcgtatgtaaagtcaggtcttattggcaacttgagcttgctttgccccgacagagaagaactcattgataacttccagtggcatgcccttggtttctggaacttttaagaagacaaacacccaagctatgatgcaaacaaccgcatacataccaaaaacaccaccaaggcccacagaattaagcataactgggagcgtgtaggtgactatgatgtcacatatccaaaatgtaagtgcacatatagccatgcatagaccacgaactcgagtagggaagatctctgaacaaaggatattaggaattggcccaaagcccatgacgaaacaacagaaatagacaataacacttgaagttgagataaaagcttttatagtactgtccaattccacaagactccctattactaatatgagaagtgatactatcaagacggggattgtagtcagcagcaaggttctgaataaataaataaaaatagaaaaatgtcaccaatgagtactgcagattgaatgaacaaaaacaagcaatgaagaaatatacacaacaaggggttaagaaaagcaacaaaaggagaagataactcacaaatatcaaatatttaagttctgaatcttcaaatactttccaaattataaaggttacaatttccagaattatcgcaaatactttcatataggaacttacaaataatagaaaacaaaacaccgtctccaccaggaccaccacaaccaagccatattcactaggtggagtcaatgtatatggatcattcaacaccactgagctaaatcaaaaaccaaaactaaaaaaaagaaatgaaaagcaagctgcttttttttttctaatggcttctcctaatgttttcctaagttttactttgtcttttaattagagcacttcaattcgatcaacttttctcattggatccttcattgatcttcgcacaaactagacgagtttccattatcctatctatagatgctaacttcaacattcccttggatataaaaacattcctaaatcctaatcttgtcctttctttgtcagctcattcacctcagcaatctcatctacaacacacttagtttcagctcatttactgatcatgtagaatcgttgatcttattactgtttgatatcattttcctttagtttgagagcactttgcaatagtagtaatttcaaacccaatttgttattgaataccaccctaaattgcaaaatattctagcaaagaacatacagggaaaatatgcaatggaaacagtatgtccatgagaaaatcatctccaggatacatccacctattgaaacaaatcttaccatttaagtagaagccaacaaaaaatgataagagaaagattcataccttctgccagatatatccatgagcctcatggccacagctatacagggtaacatcaacaaggttgtcacactgctaataagaaaagacgcagaagtagaaccgaggcccaggtttgaaagaagataaccaacacctgcctgctcaagaatttgaggtgtatagtagagcaccccatttataccagagaactgcgatgtttaagaggagttagatgacagtcagacatagctttttactaggtacaatgggctaatgaatagatcacctactgaatgagttttgagatttaaaaaatgttctaatatgtctaaatagttctgacaatttcatcaaagttagattaacagaagtttcaaaaaatgtcattacctgttgaagaatttgaatccccacccccacaatcagtgcatgcttcaccccaggctcaaaaaggtcactccaactcggcccttttgcagctgtttgggatggatgaatcatggctggtccaactggctgctgatgcataagctccttgttgtaaagggctgactgactcactagagcggcagcctggacaatctcaccatctgttagtgtgggcgcatcaccgcctggaagtgaaatgagagacccacgtctagatccaggaccaccttcttggtgtaaatatattctcttgaaaacaccttctgtttcagaccatttccatgctagctgccatccaccaccaatccctgagtttccagcatgttctccttgcaaaagactaccttgcctcatgcttccctgggcaggagcaggcatgtccctttccacacttgttgcttgacgtgagatcaatggactctgcaaattgtcatcagagtcgtccgcggcagcagcatcagatacataatcatcaccctctctggcaatgctttcttcatcccaatcttcattcctaggttgatttcccccaacactaaacatgcttccaaagtgtgggaaaagtgcgcttcctgtttctgggagcttctcatggacactaccaaagagcttcactagagggtccactagagcactttgatttgccatgcttcccttccgagatacaaggccaatggaactttgtccagtgacaggtttggcaatccaggattgaccttctgctgtcccatacaatttgatctgctcagcatcactgaattcattggctggaccaattatgtactcttctatagcggtatcacccccaactccaagaccctcaactagtaaagccatctcacctgatcatatccaagaacaattaccatccaaatcaagggcaagtaaacaagaactgatgaaatcaaatcaaataaatgcataaccaaccagcgacatcttgtctgctgcgaagtcgttgcaaaaccttcttggcctctagcatccggcctttgctgacaagccatcttggagattcaggcaagaagaatagtgtgagtgcaaaataaatgagagagggaattgaaagaacacccaacatgagtctccagtttggggccttggtgagtgatatagcaaagaccatacagtaggaaaagaacattccagcagaaccagtgaactgcggaagagtatttagtaatcccctaatctcaggtggagctgtctcggatatgtaaagaggtaccaaggtgactgccaaaccaatgcctaatccatctaaaagccttgcaaagaggagaatgtaaacatttggagaccatagcatgaccagagaactaacaaaataaaggatagaggagatgatcaacataggacgccggcctagcaagtctgataagggtccagagcatgtcgtaacgacagtggctccaataagtgacatggccacaattagaccttctattgtgggttcactttgtaaattaaactccctctttatgtacaaaatagatcctgcatagcatagaaagccaattagacttggttgaatgttatcttaattggctaaccgaataaaaatatgacctgcaatggtggcattatcccatccttgcagcaagttgccgatagcagcagccacagcaacaagaacagctccgctcatgtttgttactgaaagattgaagatggatcacagttcacagatcggatccagaacgtaaagccatcttcatctctcctaataaaatcagtttgagttggaagtttcaactttcaagaataatatactgcataaaaggacatagaacaaaagtataataataaagttggggccagggcaggagggtgatctttcctttctaaaattattcactgaactgattgatattgggcgtagctagcatagcggcacagtattagtatatactactacaacaagtctacaactacctcgactcggcaaaacaagacaagaaaagaaaaatgatgtaaaacaaaacaagtctacaactacctcgactcaacaaaacaagacaagacaagaaaaatgatgtaagcgatcctattcctatgtgccggctaagctaaaaggtagattataagtgaatgaatgactcccgtggctgtggctccctttttctttaaaatctcatccaaatttgcttacatgtcaaagaatcgccattcacaatgagtgttgttacgaaatgctttttattattctattgattaaatgtcaatttttaaaaacaaaattggcggaattcatgggatatgttctctctcttccattttttggtatttgtttccctaggttattttccttatttctcctctattctctctagctcactatctctttttataccttgcctatacattggccggccacattataattctaacaaagtcttttggatctttatgtgcatgtcctttaagtatggacattagaggtttgtcaaacctatggtagtgctaactttcatgatgtttttttagtataaacacttgagatttataaatcatatcttgttcttaaatgaatgaaattcgtttgagaattcaatggtgatgatggtgctcatgtcctgttggaacgagttatgggttagttttctttcccaatctaatattttttttgaaagagttaaaataagttgttagtctcttaaaatatattgaaatgctaattttagtccttatgagtttttttttatgtttttagtccttgccatttaacaaaaacgtgtttttagtcttcaatgagaaattaaagatacatcagttttaataaatataaatattaaaaacgtataaaatttgtaaagagtgtaaaattaaattttagaatattttgagacattttttcctttataaaatgtaaatgtaaattgtatagttgtgtaaaaatagattccacgattttagaacaatatctaacatagatgactgctgtatctcctaaagtcaacgtgctaactaatcaatatgaaaataagaaacattttccattacttggctgcaataactttaaatatcacgttaaaatatagattgatattttactaaatatattctcaattctggtaaatagaagtgttcaaatttttatttaaaaaatcatcctgcttttaatctctcatttatgcattgaaataaggagtggtgctgtaatctgagaaaaaaattggtgaagaatggttttgaccttttaaaatactcataggtattttttggaaataaaatttagaatttttagatagacggtgtagttagtaaaatagggaatcaaaaggtaagtttcgtctaaagctttgataaagatttggtttcttgttttgggcccctttgatctcggatgcattgaattgaaccaaaaagaaaaaagaaaggaaatgaaaaagaaagccgcgtgatatttaattgaaaattctacagagagagagagagagaagtgggcgtagctggtcagcactaacatccgatgtttctcggcaggagccaatacaaaaattacaataccaccaccaatccaatcatcctaaaattaaccagaaataaaaaatagaaataattttggaaactaattttgtggagatctgtcggagaagaaagaagcgaaagttattcctctttccattcgtcgttcaccttcacttctggtacgcttatttcgtaattctttattgttgtattgcattcttttctgctgggtctgggtgggtgttgaaagattatagattagatgatgtgatgtgaaagaaatgaatgaatagtttttttggattgatttgtttgtgaggtgagcgcaacagagagagagagagagagagagagagagagagagaaagagagagagagagagagagaaagagcagagcagaggggaagaagctgatgagaggagatcgttggatgaatatataatataaattggtttgtttgatgggcaacacatgccgcggatctttgaaagggaaatatattcagggcttcagccagcccgaagaccattccaagcactccaccacccattctgatccctcctcaaccaagcagcaagaaaacaacaacaacaacaacaacaacaacaacagcaatcttcccttcaacgccaagagagaagccatcatgcgccgcggcctcgacaaccaagcctattatgtcttaggccataagactcccaacattcgtgatctatacactcttggtcgtaaattgggacagggccaatttggcaccacttatttatgcaccgagaattctacctccattgaatatgcctgcaaatccatctccaaaaggaagttgatttccaaggaggacctcgaggacgttagaagggaaattcagataatgcaccatttagctggtcacaagaacattgtcaccatcaagggtgcttatgaggatcctctctatgttcatattgtcatggagctttgttccgggggtgagttgtttgatcgcatcatccagaggggccactataccgagaggaaggccgcggagttgaccaaaattattgttggggttgttgaggcttgccattcccttggggtcatgcatagagatctcaagcctgaaaactttctcttggtcaacaaagatgatgatttctctcttaaagcaattgactttggcctctctgttttcttcaaacccggtcggtaacaaacaactctgcttttctctttatatcttcttttaagaacaacattacaatattttattgagatacatttgtattcccattaggattttagggaacaccatttaatactaattagtgttgtttaaatattcatttaacctttgcctcaggtcaagttttcactgatgtagtcggcagtccgtactatgttgctcctgaggttctcctcaagcattatgggcctgaagcagatgtgtggacagctggtgtcatactgtacatattgcttagtggcgtgcccccattttgggcaggtatatcttactgcctacactcttttgatttcctgtccttcatctgtttcatcactgaaagttttgtcctttttggagttcagagacccagcagggtatatttgatgcagtattgaagggacatatagattttgactcagatccttggcctttaatatctgacagtggaaaagatctgattagaaagatgctgtgttctcagccttcagaacggttgactgctcatcaagtgttatgtatgttcttccttttttttttttttttttaacgataattactatgagcaaggaccaccctcatatcaaaagcatagttgttttgcccttttgcactagtagctaagtcgttatggttactcagtggatgttattatagatgtaattgagggactgagcattagaaattggcttttcctgtgctactcatacattcaaagttatcttcattattaaagatgtaataggtgattaaagtctcactggcgttgtggccgttgccacatctatagcagactcacccaggaagaaatagtcctatctaaattaatagttagctggatgttgatgtttcctcaaaagcaagttccagcttaacttccttaaggattaaactttgtaaatattcaaaatattgtgtttcaatgtgttgtctgacaatattacttgtgtcatttgcctgtttaggtcatccttggatatgtgagaatggagttgcccctgacagatcactggatcctgctgttctttctcgtctcaaacagttttctgcaatgaataagctaaagaagatggctctgcgagtaagtgaagctaattaaaaaaaaaaaaaaaaaacattgtatcccattgcccagagactcctcgctatgtgaaggtaagggggagggatattgtaatattatatgcagccttacccttacatatgcaaagagcttgtttctgaattcgaactcatgaccaacaaatcatcaagatctaactttaccgctgtgtcagggctcgttctctaagtgaagctaattgatgaataaatatagattatgtatgaatgtagctcatacgttgttatgaaaaagataatggattccatacatgatatgtaaagtgctattgttgtctttgtggagtcaagcacttcttggatgccaaatgaacctcactttattgggcttccacacttgccctttgttttcacttctccttcatctattatccttttgcttgtctgaaactatgtaaccgtagttataattgcttattatactaattttttaggtgattgctgaaagtctatccgaagaggagattgctggtttgagagaaatgtttcaggctatggatactgataacagtggtgcaatcactttcgatgaactcaaagctggtctaagaagatatgggtctacccttaaggatatagaaatacgtgatcttatggaagcggtaggttgttggttctgcgaaaagtttcttttttgtatttcgtgtttatacttcctattttatttagttattatttttaaatataatattttaaatttccttatatgcgaaagccgggggttgacattaggcatcacattagtgaaaaccagggactattcagtcatcttttacaggcattactccatttttcttttgagccacatcctgtattcgtgttaaataatctttgaacatgtttcattcacagctaaaatgttttgagttgtttcaggctgatgtggacaaaagtggaaccatagattatggggagtttattgctgcaactgttcatctcaacaaactagagcgtgaagaacatcttattgcagcattccaatattttgacaaggatggtagtggctacattacagttgatgaacttcaacaagcttgtgcagaacataacatgactgatgcttttcttgaagatattattagagaagttgatcaagataatgtaagttgtttaacctgtgctaaacattcacataggaaatccttgtaggctgttagaagatcttacagtatagtaatatatatcctcattaaaagactgctcttttagtcttcaatttttctgtaatatgtacttcaataacttaaatggtttttagtttgaaatatagaatgttctttggttaaagaatgcttacatgttttaagctatattaatttgcatttatcctgcattaactggagtttcgtttcaaagctacaagaattatgcattaggaagttaggacctatgtttgatctatccattaaacgttttctgatcacagattgtgaaaaacaattaattaatcaaaactatatcatgccttaaatacactttaaatatcaaatgcctgaattctaataatttgtcaagcatgattctttgtcgcctatcaataatgaattgaatttagttcctggaccatcttcttgtgcagttatgcttcatgattatgtttatatcttttgttttaggatggaaggattgattatggtgaatttgctgccatgatgcaaaaaggcaacgctggaattggtaggaggactatgcgcaacagtctgaatttaagcatgagagatgcaccaagtgctcaatagcttacgattgtgctcattatgtacaggtacttttggctttgggtaaaatagaacttttatcccctgtaagaaatactatttgcccactttataatttatattcttatgaatttttaagatgtagaggtcaaaaggcatcacaaatggtatgtcttgtaatcaccaacatacttctaatattatgtggtaggccatctctagtggttggaatagacatataggcaatagatgttagtttctcactcttggaagttaaagttccaaataattgtacacaagaagtcatcatgaacctaagaacccgaaatgatttgattgaagttcagttatcacttcatgacatttcaagccttatttcccaatttatataggtcccatttgcgtatgtacccaatattttattgggatctgctcacattttagcatcagttattgtaaagcatcctgtgcagatggctgttgaattgaagttgaagtgtcccagattttgttgtgtctgcttgttctttagcagatacttctagacttgattttattcttctaatgatggcccatcaaatctactgaataagttgagttattcattggattcttgctccccagaagagggtaatgacagtttggaatacatgttagagtcgtactatcaacccacaggatattggtggtcctctatggagctgccttgtctatagcatattctttgtaatatgttggtgtatgatttcctgatgaaaaaaaaatcattttgaggttttaggttagcttgagttatggaagtataaactgaagaaggcagcatatctgcatacatttggaggtgtgcgtgagccaactggctgatgaaccttttgcaattttatatacagtagtagtagtagtagtagttatataaaaagatgtaaccccgagaccaaacttagggtgggggtgggactcccgttaagcacatctttgtaaatatatatcgttccaatcatagatcttggttctgcatcttgaataatgcatttagagttgaatctagatttaagcagtaattccaacaaggtgtgtcttgcatgatagtttatatcctgcagtttgccaaaacgagtattagctgaatatctgttgactttttattactctcattgttaacgtcactcttcctgtattctggaatgcaattttggcaggttgtatgcagcaaagccaaaaagagaaaaataaagtaaaaatctttacaaaaaattgttcatacttgctgaccggtcctatctcggaagaacaatcaggattgtgggtgctcacgcatgaggattcatcaaatgttacatttatgtgctgtatgagtggaaaaattgtttctcgctttgtaaaccttagtgttgggtgttacagctacttcgagttggtcttctatttttctgtgctttcatgtaggggcattctgtctatagtttagtagaaggattttgatctttcaagtacttgatttcacggatgtaaagtttcacacgcatgatatgatgtattgggcgtactaagaagcctttgtggagtatgatgcattgtgttaaagtgacattgctgaagcatattatttcccagctggcttttctttccctaaacaaatacgtattattctagctttttttttatagctaaagcttactttaaagaaagttcaaaataaaagcttttaaaatagagtaaaattctttaaaaaattaagcagtttttttttttttataaaagaaaaaggggggaattagcttttaaaaaatgtcaagtgaattagtttttttaaaataagttgtactgcttatttttctcatgaactacttatttttagtctctttcgctttctcatgaactaattaatgtggaaaaagaaatgaatttagtatcaaacaacgtgttagaaaaagttggtccaaacattcttcaataaataaaaaaatagcagttatttaatttaatttgatgttaactgtttgaactattgatcaaatattaccttcggctaaagaaacaaatggttatttttttatattaattataagaaatatataatcaattttaaattattagtggctaattttcttttacatccttaataaatgaggtctattagtaagatatcactcattttcaatgaaatggatgtatttaattagatattaataatataacttattcttactggttgaaaaaaatatgttggattatgagtagtgtaaatatatctaatcatcatttacggatatttttggaatacaatttgaatgtatgttagtattaattaaagataactaatataatcactttttttttatattttattttgatgatttggttatatgttgtttatgtctaggattagaagaggccatgtttcgtttagttctatttataaggttcaaattataagtgatattatattctttttattttaagatttaatttataatgtttattatattaattatttttatttaaaaatagcttgtttttaaggcacaattttaaatagagaaaaaaaatattaatgataatgatagaattgaaaaaaaaaataaaaaaaatatttattattatcaattaaattaattatttttcttaatatcaataaattaattaattaaataaaactagatcaatattgaaatgaacaattatcattatttgtttctattgactaccaatactaaaacttggttatcaaactctagttttaaatggtaaaatcatacgattttgtgagtctacacactcctaacgagttgaatcgcacatagaatcgttttctggtagactcggagtaaactcgctagaatcggatcagacttggtagaattagaccaaactcgatagaattgtacgattttacaattttgtgttttttaatatttgtttttgtttagtttagactttatactttaattaagttatgaacttcaattttttatattatttataggttcatacaaagaggagaaaccgcttgcattaaaagaatatgaatgacttagtttatgtgatgtataacttgaatctgaaaagtagacaaataagaaaaaaatgttgttcttccatttgaagatatggaatgtgatgatgagtggataacataagagggagatatatttttgatgaagacaatgttcaagttgagcaacctctaggtgaaagtcgtagtggaagcaatattgacgtggttggaggaagaagtttaagtgattcaactttagatacatttgatattgacaatttgattttgaatgacaatgttgaagattacttctcaatcgaggaagaacttgaagatgatggagatgaagatgatgatggtggtggtgatattggaaatgacttaattacaagattgatgaacatttgaattatttatgttttttaaatgcttttatttgaagaacttatgttttatgttttgtatgatatgaatttatgtttgattgggtgtgaattatattattttattgaattattgttaaaatttgttattttgatttattttagaattaaaatatttaattatgattttatatataagaatattaatatatatttttatattgagtaaactattattagtttacgaatcgattttattagtcagtttatgaaaccctcccaaaattaagtagaatggtgaattccagtttatgaaaccctcccaaatttaagtagaatggtgaattcgacaatattactaacacagctatttcaacaaactattactcacctatttcaacaaactatccctcgatctctatcaccttctaatcctgcatgcatcctaatgtaccacaatcttcgatgtgaacccgaatttgcgacaaattgatccacagggaagtggaccaaaataatggtctctcatcgtggcagtaagccaataacaaatcgtcccaataagaattctccttcccgtttgttagtggcggatctaggaccctgattagtggggacaatttatttaaaaaataaaaattgataattatcattattatatgggatagttaaattcaaacacgaatataagaggaacaaaatataaagttttaagataaatatttgtattttattaaaataagaggatggatttacttagtcttacatgtaaactggtaaggaggttcaaatacataaaattaaggggttcaaaatataaaattatggggtgcaaaatatgatatttttttcattttattaaaataagatgatatatttacttactcttacatgtaaacttgtaaggagatttgaatacataaaattagagagtgcaaaatataaaattatgggatgtaaaatataatattttaagacaaatactagtaatttattgaaacgaggggatgcatctgcccactctcaattacgtagatccgccggtgctgattgtgtcgccctgttcctacccttctctttctcacctccatgataaaaaaaaaaaaaaaagacattaaaattgtagcacaagccacaaagtgggttgtcacacatggactaccacgacccatcagctgccactattcgatgcagttgagctccacaagttgtccttctataaggatttgtagctttgatatgcatgctcacatcatatcatgttgcttttgcaaatgaagcaacaaaacccccaaatcacaaaatttcttccccaccctatattttacaaaggaccaacctgcaattttcacagaattgagaaacacgactggttcaaatgttccacgggttgccatcattaatttaggtcacacaatactttttagtttaatatctatgtcccattcacctaaacttacattttcaatcaattttaaattattatcgatataatttttaaaataattatcatcaaaattaataaatttaatatattattatatgattagatgataaagtgaaactttttatattctaattttatatactatttactcatacttttattattaaataaaaattatttattgctaaattgttgtaactacatgaaatcttaaccattagcttattttaatatttgaaaattttaaaatataaaatattaaaaaaaatatgtataaatggtgatgagatttgtaaattcggcactttccagttttttctaactggagagatccatgtcggtgactatttaagaagatcatgaacaatcatgtgtggggacattgaggtccaaagtaaaaaatgaatatgataaattttattgatttttataataattattttaaataattatattaatgataattttgtataagctcataatataaaagaaaaattaaagtgaatatttgttgatatttaatctaataatagtatcgatttatttatactttatgaaaactttaaattcaacatataaattgataaaaattattctcgataaaaaaattattgtgtacatttttactaaatttgatacttttgtcatttaatcttatgttttttttaaataatctgttaaacaaaaacgttattttctttctttacactttctaatcaaatatatataaaaaaaattaagcatttctttctattttttttaccatacctacaaaaacaatataaaaatgcactcattttcttacatatttgtttttacgttacttgtttctcaccgatttatcttctctacatgattttcttccttaccgccaactgtcaaacgaagcattgcatgtaggatttagctatatttgttatttagaaagaaaaaacagaaaataaaagaagaaattgtgcaccgacacaaagcaataataatggtgttcggtaacatggtggtggaaccgtggaaggaagttagcttaattatattataaccgcgacgtaaaacggcatcagacgatgtgtaatgaaaaaggagaaaataggaggacgtgggagaggaaacttcaatctcacggcaacaagttcagaattcagcaatcattatttatgaattacttgggcagggcaggggattctgaaacagaaaaatggcaggttctacattcaccatagaatacaactataagataatacagtatgcaacaatcaccctataaataagatgttcaattgtttccattaggcaacaaatttaattataacaatccacaattaatagaatatgcacgtaattaactgagtacaggaaacaaattaacatgaagaatgaattgtacataaaattggcttacgtaatgatttccacggtggatctgaaataaagagtaaattatttgaaggaagcattgagaaatgtggagggaattatgagaagagttgaggggtggaactgtggtaggttttgggaagagtggcgtgatcagaagtagagatgaaccttctgatctcagagcgaagcttatagaaaacatgtctccaagtgcccatgttgtgggagccaaggagctttgtttcctggtcgttaatttcgagatctgtggcaaagatgagcttcctggagaggatccaggcccagctccagtcccaccatgtccttgcatagtcacccatggatgagagggacttggatctgggaaatgaccatgttgggctgtcttggatcttcagagacagcgaagaaagacgtcttcgaaggcctccttcctctgaacgcgacgacactggcagcgatgatgcctttgtacacccaaacattatgctctgctgtttgctcaaagctatgttttcggagaaaatatatcatatcataagagtggtgaaatggaacgtttacagctctaccacagcctgttttattccttctgctgggtcagtcaccattcgccatttctctctctccacccattgccttcggttcggtgatgtgttgctatttaaactggacttgtctgctctctcattgaatccaagacgctttggtgaggtgtttttgtgccaaattcaatagtagatccaaatgcttcattggttgccaatgtaattgtcggctcttctctcacgtgttttttgttgtaataatgctccattcaaatactttctactttttgcttttatatattgcaaaaacattttctaaattttttaagtcatatattcttcattaagaatatgaacgctcagagaattttacctccttaattaagtgagtttatttgacttgattcaaagtaaaaaaatataaaagtttatctcattttttagtggattagagtataaaagaaaaaatagagataaaaaatgatagatgtgatgagtgatataataagaaaacaaaatttaaaaataatttgaaataaaataaagagaaaataaatatatgtttataagtattctactttaattttgtgtaccaagaaaaaagttaaattaatcaaggtctaataatgttgcttctaaatgctaaggtcttaaacataaaaaaaaaaaaaaaaaaacatttggacctaataaaaacaaaattcatcataatattcctatcatgatattcacatttgtctttttattcaccaactatttataaaatatattctttgaatctctgaattttagggggcgcttacttgcagctttgttttctgtttttattttttattttcaccctttatttataaaactgttaatttggttttaatttgttttcaaaggtttgtacagaaaacgttgaaaataatttgttgttttctaagattctaagattatatttcttttaagattgttcccctaatctcctcgtgaacaccaactttaatggatccctagaaatcctatattgtttgttgttacaatgaattcaaaattcaagaaaatataggtattaccctccttgagtattgactaccacttttcaacatcatattttttcaccgcaacttgtattttatcttcctacgtcatgaacaaattaaattcaataaacaattatcttccatttgattttgaacttaagcaatataagactaccttcacatccatgatattcatatccatcttcacatccatgatattcattttcatcattgctgatttatgagatttctgcacatgccaaatactatttattcttattgccaacttccaagtctctcgtgccattaatctctccaatgaagttgactttatacaccatttgaacgagattaagtatattttctaaataacaagtttgttggactccattcataaatatttttttttaaaaataagtaaaaactatatagttgaaaacttaactggcaaaatatggcatcaaatcatgctatgtactataaaattaatataacaatgatttgttcatgacttaactcatgaaagattataatattatgcataaatatgtacaaaaaaccatgattagcgaggaaaaagaaatggataaacaaaatttatatgcaggaaaaaaaatcattataatttgtcaaagcatataagaaaccaacttagacattacaatatgatggtgaacttaagcaatataagataaaaaaaatgtgatagtataattataaataaatttatgggtaaataaccattttcgtccctgaattgtaagataacaaaaattagagttacactgaagttgaattttaccaagtcaactacaatttaccatggtgtgtaaagattaggaagttgttccttgaaacaatttgctattgagttaagtcatgcatttgtaatataatatgcatgtgcaagtctcatctaaaaccaaagggctactatgcctagttgctgatagatgcgtttctgtattttccaaggtagtagtatcaacttgatagtggatcagtaaaagttaccagtttctaatacaaggtttgaggaccactaatggattaattcaaagctcgttaaattgccatggcaaatggatgcctacaattaaatccatgtaggtacgtatcaaaagcaaaatagttgtttcttaatttccacacaattttcattaaagcatttattataactctttaaatgttgatgaatcacgcgtttattgttttaacaaggtcaatgttttatttaaggtgtgaaaaggtcatccaaattttctctttgctaattgctatatagtatttttattttattttctagcatgctgcaaatatttgtgaaagaagttggataaaaatatgcacttgccttatatattagtaatattacctaaaactatgaatgttaatatgtaaagctcagatatattagtaactctatcatccttataccattgccttattaatcacatctttgttcttgataaaaaaaaattatttctaattcaaaatttggtatttattctcaggttattcaatgtgaaaacgtaaaggtttagctttctctcagtgacactagtggctcaaattttggtatttatttttaggttattcccattgacataatctatcaaggaagaagtctctgattattgccttgtaattttcctgttacacaagttgtgaatctctagtttagtaatggaggattatcagatgttttgcctgtgtatgtcattgacaatttacttgttgtacatcctgttcatatgtagtgcaacctactctaaccaaacacgacattgccactgaatcaacgttattttaggcttaacattgttcatcagcattcacttttttttgtaggctattcgtcttatatttgctctttcttcatcttcctttccctcattaagtggtttttggaagttgttgtcttgtctctaaattgagaacaatttttctatattgaggttttacaaacttgatgtttattgttattaacatatggaagcaatgacaatactaattcaatagatttgtgttgtaatttatatttacttagctttctataacaactttaatgctttattatctcttgtgcaacgttattttacttattttttttttttttttacttttttcttttaagatacttttttattatgttatttatttttatcatatatttttcaatcaatgtaaaactctgttgttaggagaacaaaaatgcaagtgcaaggagtgcaagggcactcctattgtgcacaatgctaaccatttaagtatatcacattggttggtctaaaaccaatgttgaatgtgctataccacattggttttgatcgaaaaccgatgttataaaggcacattcaacatcgattttggtcaaaatcgatgtggtttaacacattcaacatcgattttgcaaaaaattgatgttgtatacgattttcaacattgattttttcagaatcgatgtagaaaacacttcaaaatacataattttggcaacatttttacattgatttcagctaaccgatgtagataatgattttcaacgtcgattttaaatttgacattaaaaatgtctactttcaatgacagtttaaatattggttctaaaattgatattgaaattcctctataaccgatattaaaacccttttatgtaatattcaatgtttgtgattttaaatgatagtacaaatattgtggaaaacaagcaaaagttagaaaaatctagtacgtgcaaaattaagatagatgaaatatgtgttgaagtgtatgatgtatataatctattatggcacaaacaatattaagtgttttttgctatgtataaagattatatttttccattttacccttgttattttttttataaaagataaaagaacaaaaaaagaaaagactaattaatcagtaaatgtctccaagaaagaaaaataagccattagcaagcttttaacaattttaccacaaaaacgcaaggaggcctgtgtactaaaagaaatgtcctaactaaatatcaaatatggttgaagattttagagggaaaaaatacatgcgagaaacatggataaataatatatatattaagaaaaaatatgattagcacgaaaaaatccatatcttaccaccgctttactctttgagttgatagccaaagggatattctaaataaataattaagggagggggacctacaacgaaggaagggggatactactaatgcttacttcaatcgctttctttatcttgtggtcaactgcaattgaaagattcgttcctattttaggattggggcggtgtccgcccactaatgtaaaaattggtcgagggagagacaaaagagaatttctttttgattgtgttccaggcttaagagttgaattagtcattgggattggtgtacaaacaagactaattgagatttgtaattagctataataaagaatacgctctttcgacagagaagtgaacgatttcgatctgcatataagaataaggataaatggagtatatacatgcgaatgaagtcaaaacatatatacatacaacaatattaaaagcgaatgaagccaaaacatatatacacacaacaatataaaaaaaaataagaggaaatttgcaaaagcataaatagaagaagaaatgaagcctaaggcacaaatagaatctacaaaaatgaagccaaagcatatatacacacaataatataaatagaagaagaaatttgcaaaaaaaataataataataagaggagttaattgttgtctatttaaaaaagtatttgaatgataatcaccagattgagaagaaatgtgaaggaaaatgaatttttcaaaggcacaaatagctcatagtaggaactagtaagaaagaaatgaaacgggaccatttttacacgttaatggttaacaagatagattaatgtgattttttaatggattaaaaaaaatgctattatgaagtattttttaacatggtcaaacaacataactctagttgtgataaaaaaagttagtttgtaaacattaaataaattagacaatgaattattaaatgaataaagtgaagtgttataaaataaaatagatgaatagtggtataaaaacatggaaaactaaaatgatcaacaattactaaaataagagtaaattatacaaatatttttatacttttataaaattacataaattttccttacttttttttacccttgcagtgatcttttaattgtttaaaaaatatacattgatattcctttatacattacatcattatgtgttgtaagagagttattgtaaatgtttaaagaaaaaaaaaggtaaaaattgtgtaattttatgataccaaagtcattagtgtatgtttggttttattttgtataattgattgagtagatttaattttggataaattttgacatatttgatttcattgaaaaaagttcaaaattaattatgaattaaaacaattttaaataacttttgtattggataaaaagatttatactaaattttactcctcacttaattttataataataatatacaaccataaacataattttaaaattaattttacaaaatcacttccatttaaaatcaattttttcaaaactcatctaattacacaaataatttaaaggcttaattgttatttttacctctaatttttttataatatattgtatatattatcccgaccatttttccattattaagcttaaaagttaaggataaaattaataaaaatataaaaaattaaaaataaaatttataataaaaaatttaataaaatacgtcaaattaatttattaaagataatttttttataaaaaaatataattaagtctaatttaatgtgatagtaaacttttgtttatgcatagcaaagagagatcagaaagagagcgtggccttataatatcataattggtgagcggccgagatctgttgccggtgcatcaaggaaagtaagagtttagagtttgaactctgtttatccaatgcacaaagcgtagatctctgtgatataatggaatacaggaaaatcaaagacgaggtgagtgttttttcgcatatttcttcaattaatagtacgattttgatgcattgttgttgtaggatgaagttagggatgcggacgttgaggacgttggaaaatcatttttgctgtcaggtagtggtatcgctatcgctcctccaggctgaataatggatagttgtgttgttttaatgtaacatccgtttcgtgtctcttccagtcccagataacgatttgacttccgagggagaaaccaaaattgacagccacagggagaaagtaaagtggaagcgcaagtatgacaacaattcacatataataagtgaaatacttacttgttgatttcttaattattatccctgttgcctgttggtataggtcagttgttacacttgcattgactgttcttactagttcgcaagccattctaatcgtttggtccaagagagctggcaagtatgagtatagtgtcactactgctaactttatggtgaggttatatcacatcgtcatatcctatacgctcattctgttatttctgcttttattatctttcataacttcaaacctaaacctgctttattactctttttgttataggtggagactttaaaatgtgctatatccctggtggccttgggaagaatatggaaaaaagacggtgtcaatgaggacaacaggtgatgccattttttgttttgtttagatttcttaaatactactatgtccgcaataatgaagagctgcaagtcagggaatatattaacattttaacagtgcattttatctttatttatggttgtgaacatttttaatccgatctttttgacatttttagaactggactaatttgactgttaattgcatttgtaaactcttgggcttccttattccctgaagaaataacctgtatatggctaattcataggaagaaattagttgtttactttgtgaatctgattgaaaatttaatacttcatcatatacaagtaatcacagttgcacttggtaatcaaaacatttggttatatggtcttacaaggtaactcttaaaaccaaaaactgtcttaatgtgattttgaactgtattccccatgactacaaaaccactattttttgatattttaattttgaaaaacagacaaacattcctttatatggtgtttattttatgtgtgttggggggagtgtctgaacagtgttctttaggtggagaggagttcataaggctagaacctatattgttaatagtgttgagtaggccaatgggttcacttaattttcccggtggtgtttatgtatttgcaacttcatcttttttattgaagctttattttttcccccttgttggtgtttttcttttaatctgggttcgcaacaattcacgcacattgcttaaccaattgagctagaaccccttgttggtgttatatatagaatgagtttaaataacttgataacttgatgtgtattgttccttggacataggttgactacaaccttggatgaagttatagtgtatcctattccagcagcactttaccttgtcaaaaatttgcttcaggttggtgatggatggttgtttgttatggtggcaatgggattgttctacaactttgttattgcaacagatatgttaatgctttctgaatctgattgtatttacttttcaatttacggcagtattacatctttgcatatgtagatgctccaggctatcaaatattaaagaactttaatattatcagtacgggtgtcctatacagaattatacttaagaaaaggtaagtcttttgttctctcttcttcaaatgcaaaaaaaaaaaaaaaattatcaattctcctttcgccatgagaactgtagtggaggatcaatgcaagtcgggtcctctgtatgccaaacttttatgtggacaaaaacgagaaggaaaagctccttccatcgtactttcacttgttttataactcattgtgttatgaaatgttctatgaacataattaattgttattattctttattttggatatttaatcattttaagcttaatgactgagaaatgttatttagttggactcattacataaccaaaattcattgttcgctgtttggcattgtgttcttgttacatttcaggttaagtgagattcagtgggctgcttttgttctactcgctgctgggtgcactacagcccagttgaattcgaagtaagaataatttaaggctgacatgtggccatcacttgtgtatttgtatgttcccatgactgttgtatagattttctctagtaataaacatgttaatgaaatttttatgtatagatgtaacaaacaaatgaaccataaatgataggttagtaatttagcaagtgtgactgctgaaaaatgtgtgtattacagtaacttctccttgcttgtatcatacataaatagtaggaatatacctgcgatctacacacaaaaggtattgcagaagttttacattttattgataattttttttttttttttttatatttatctggaaaaatttgtattgtgttttcagttctgatcatgttcttcaaactccctttcaaggttgggtgatggcaattgtgagttgttaacgtttgtggtgctttcacattaggagtataaagtaatataagctgaatttttggcttgaaactgatcatgatgaactttttgtttttaggtcatggctctcttgagtggttttgcaggagtatatactgaggtaattttagtttggagcagttacattaattcccttgaggtttcatgaaatggcactccactccaatctacagccaaaattattctctgttctgttgactactattgactgatggaatattctgcttaaaaattgttttagattcaaacgctttttgtattaagttgaaattatttatccaatctatctgaatttattaatgcttgagctaaatttgattaatcattggagatgtgccagtctgcttaaaataaggtttatgagctctattactatagcatcgagtaagatgtgttagctatcaattgtggcttagtagatttcttacataatttttggcaggctattataaaaaagcgtccttcacggaacataaatgttcagaacttctggttatatgtctttggcatgtgtttcaatgctgttgcaatgttggttcaagattttgatgcggtgatgaacaagtaattcgatctcttctttcagattttgactttgcagtttgttttgatctttgctcgctattttcttgtgttcatatatgaagaaaatcttttcatcaaatgggataactgataaggcctcaaattaggattattgtatgtaaatcttgaattatttattttatcttttcccatcttaataagtttgatatcagaatcttgatttcagatcagatctttattatattctttgggataattattagttaggattctctttatttttattttatcatttatgatcaattaggataattgttagggatatttttgtagcctatttaaatggcaaacttgattgaaatttaatcaaggagaaatattcagaaaaacttgtgttagtttaggaggggctcagtcaaggacgagtctgcttctttctttcactataggtcgacagaagtcttctatgtctaggcttgtgacttgatcctacgataaggttcataacaataacacataatatatgttgtttgatcatataagtcagtaccaagtattataaacaatcatatttccattgtagttataaagcctaaattgtcacgtcagtaatatatgccttatgtctttattcaggggattcttccatggatattcattcattacagttctcatgattttcaaccatgcactcaggtaaatgacgagctttataaaatttattgagggatggaagtttttccctaattactattcttgtgtatctagttgttggcaggggaatagccaaaaatttaatttaaggggggccaagacccaaaacataacttagtaaaaactaaataaataaattccacatacataacatatgcaggaaatttatatgtataactaatactttttagagtaaaagaaatacataattgggttgagtacaagaggtatacgcgaccatttaaatttaccgttgtttccctctttctctactttgttaaagtttttaaaccaactggtacaatttgtatgtgggttcacaatatgtttcttgattttattcattttgggttttacttgtcttcttgtaatctttccttaaaacttaaaaggatagaagtatggtgttcattttggatgttattcacttcaatgaaaagaaactcaatatgattctaacaaatgattaaattatgggaaataaagaggaatcaagatttgatcaagagtgaagaagaacgggaggaactgaggaaaatccaaattctcaaagaagaaaaccaagtggaggtagagtagggtagcgtgtctgagaagaaatagaacaactaacaggatagataattttttttccttttatggtagatagctaggagggacaaagatttttgtttaacaatataaatacactttaaaagcttgggggtgaccatggcccttgtgggtcaccccctccctccaccactagttgttgggatccagtctattgagatcccacatcgactatagatatggcaaaagtagagcttatacaggcttggacaattcttaggctttagtccaaattcaagacagggaggggaatttgttatgctgatttgacatatcagttgggagtagagtgggaatacaaggagtggctgcaaggcatgctggcgtaattttttttttttttttttttgttgacagaaaatagctttctcccagcagtccattctctggttgcatgcttgtatgagcttaggctcagttcttttgaaatggataagagtcgtgcactggcttctgtttttggtgttctattaatcaaccatttcccctcctttgtttggatgcttcttctgtttcttcctgaaatgaaaggttacttgagatgtggactgtggagtatgagcgacaaaaagatgaaacaacttttgatggttgatgaaactgtgaataagcaaatctcgggaaggttcatgtgccaattgcatgaaacaggctttatttcaactttatctttggtgatttccatattcaactgttgtcatttttaagctattttcctttaactcatcaagtcctctctctttctatgtgtctgtttctatctctttcactacacaaaaaatgtgaatatctcttttcaagcaaatactagtagaagttttcattattttattgttttacagttttgactttcttgttgatgtaatgtgtttacgtggttgtttctttttgcagtggaattgctgtatcaatggtaatgaaatatgctgacaacattgtgaaagtaagacttgggtttatgactgtgttatgatatttctaccatttagttgtattaatagaatttgaaactttcatgagtttaaattaagattatgggttttttttttttttttataattggaattattcatatgattaaacatgctacatctacaataactttttattattggtttgttcatatgatacactttttgttgtatgtctcatggtcacacatactgaatataaatatgaaattatgcaaaaaattgtggggttagagttatgtgcccttgcgggtatctcttgttggctagagtgtgtgatattgttactttgctgtagacccccactattctttacggacaaaacttaagtgatgctcattagatgtttgctctcaggttctacagttaaatgaaaaatatattaaaatttctatcatcactttactctgtccgatattattttatttcttttcttatcatcatacttgaaaagggagaaacgatttctgaattgcatgaggaaatcctgtgtttgagtatatagaatgtgatttacaatctctgaacacattatcatatattgattgtagaatctgagctcgcttaatgaactgcacacaagttttattctgtgcctagtatttagaagtagagctgcattatgatgattgatgaatgctttcatcaaatgtgatctatatgtgtgcttctgtttttcttggtttattcaaacgttatggcacccttacagccttactagctcaagcaaaaaacctttgaagtggaattcaaatttatgattaactttccaattgacacaggtgtattctacttcagttgcgatgcttcttacagcagttgtttctgtgttcctttttggcttccatctctccctcgccttcttcctgggcacagtgtaagttgctgcttattatatcatgattgtgcttgccgtgtcctatgttgtgtttttcttttccatgacccaagtattgcacatacatgaatacatcatactataccagcaactgaaattaaaatgttgatttttttagtacttttatggctttggctcttaatgataacttgtgttaaattttgaaatgcttcattttgatgtgcatgcctcggggcaatagcttttaatgcttcattttgtagtctcacgtaaattgctttatacccattttattttctcttgaataaaagtttgttaaattatgtttacagtgttgtctctgttgcaatttatctgcactctgctgggaagatacaaagataactatgacttctgtcttctgtttttcctatactggattttttttattcattgttgtttagccttgagcaaacgaatacatattagttcactgtaatagtgtgtgtatctcaacattcaacatggatagaaccaggcttacgttcgattgtctacattattcttcttgatgcgtgagatgtaaattccactagaagctcttgttggagttaaggacgttgccctgacctagcaattcaatagccttccctcgccccatcctaaattttgtgagttctaaaaaagtggggaaaacctatagtttgagcgatgtgactttgttgatcgaacctttgcaaatttgggaggttcttgtgcatgtgaactgatttcaaagtgatggccgaggacaatgctttttatgaagtgagtactttgccgcgtcagaaatattatacgagaagtgttttttttttaagataccagaaatgttagtaatatcctttttgatatattcttttgaatacacgctcaattatttactaaatttttggaaataattttttttaagagtcatttgttatttaatgagcattttttatgattttataattttaataaaaattaattaataattatttatcttagaaagttagaaagaatgtgttgttaatactcttaatgttatacttaggagtatttgtggatgagattgtattaaataacatattaaataattattaatttaatttcaaaattattttaaaaatgcatcaattagattctttctggccaattaaactaatgttgttagacgttcaacaccattgtcgttcacgtagtcctcatccatggtaacatgggttgttgtagttatacagtggccaagggaaggttgcacattttttgttcagatacgaagagagtgtgatgtgttttttgttcagatgtaaagggagggtggtgcggtttttgtttagatctgaagggactgttgaggttttgtacagatctgaaggaaaagtgtcgcgtttttgttcaaatctgaagggaggatggtgcggtggtccttcaatgccctcgccacattctctatcgtcacgtctgtctcgcttattctttctgcgtacatcaatgttgttcgttggaaactacgcacacatgtatgttgtgcaggacggattgtgcaacaccacctcctttggttgttccctccgcatcaaatccatcgatgacacatctcaccatcatagactccctcgtcatgccaccgccaacgaattctctaacctccgaatacaataattgtgattgtgcttgtgtattgtgagtttcaaattcaattccaaatttgtgggtttcagatttgatttcagaaaagggaaaaatattttatttttaaaataaaattaaagatagtgacgtcttttattggtaaatcaaacctctagaaatctcatcttaatggtattagttttaatttgatggaaatgactcgattctaagtatttttaaaaattagagaatctgattagagcagttgaaagtttaaaaaccgtgaacaaattggtaattaagccttaaataaataataaaatacatattaaacataaaaaacattaaaaattataatatcttgtttataagtcaatatataattaatagtagtataactctttaaatatgtacaaaaataaatttacacaactagataacttatcaataaatttacttaattagttacaaaaattatctttaattaaatatatatctcataaacaagttacgtgataatattataaatatagaaggaaaaaatatgtaaatgagtgatattataaatataaaaaacaattatttatatatgcataagttcaattttaatttggttagatcgaataattttttgtttgtttgtgaaaaaagagagaagtaatagagaaaaaacaagtaatagatataatgaataatatgataaaaaaaagttaagtgtaaaatttggattttgaaaaaattaagaaattattattatttaataagtaagcattcttcaaaaaaaattcatctattgtttatccgttccagcttttaaaagttattttcaattagagggggaaaaatgagttagtgtggcgtgggaagaagttggaatatcgtgagaaatggttggcttaggatgcatagcaggagtaggagttcaccccagctggcaccatgatcgagttcgaatccttgcttctaaatctgaagaactaacactaacaaggtggtggtcgtggtcgtggtcgttgtttccttctgcttctgcacacgagactcatctgtgtcgaattagggcgaggcgtccgtgttgtgtgcctgataataaagaagctggggctggaaaggaagaggaagaggaagaggaagaagtacaactactagagttagaatggaagctcctcaccagaaggattggcgattccggaataatatcttcatgcttggtcggtctcctcaccggcgtcgctgtcgtgctcttcaattatgctgtaagttgttattattatgctatacatagatagataaatactctctattatcataatatacttatatgtaacttcatgacatgtaataaggttcatgaaattcgtgatttgttctgggatgggattcccaatcgaggcgcctcatggctgagagaagcgcctattcagacaacatgggcacgtgtagtactagttccgacttttggaggcgttattgtgtctctgctaaacctccttcgtcaacgttttgattctgctgtccaagaagatcctttcctccaaactccatctgccaacctcaagtctgcttcccgccctttcttaaaggccatggcagcttctgttactctaggcaccggcaattccttgggtccagagggtcccagtgtcgatattggtacttccatcgccaaaggcctccgtcctttctttgacaatggaaatagttccggcagaatgctctcccttctcgctgctggatctgctgctggcctctctgccggtatctacacttacacgttacttttatcactttcctgggatccgattattttcttctctaatttatatttcttatcaggtttcaatgctgcggtcgctggttgttttttcgctgtcgagtctgtcttgtggccatcatctgcagatgcatctttaccacttacaaataatacttccatggtgatacttagtgctgtcatagcttctgtagtttctgagattggccttggctctcaacctgcctttaaagttcccgagtatgacttccggtcccctggtggtaagtcatcaacacatttttctttgagattatttatgacttgaccgcttcattctcttgctcttgttcattgctttgttcctttcttccctgtcaaatttcagcaaagtatatcaatacatgaagtgtttccatttatgtatgtgttaatatgtgtactgaattggtttaacaacgcacttgactaactgactgtgcctatcttgcaaaaatacaactcagaatggctgtacctggacatttccttacaaacttggttaaatctagtcaagtataataatacatggaagcctctagtaagctagtcccttttctcctacaatgaagatttaagcagccaaatgcaagtaaattatacctttagggtgtcatattggatcattgaactacttgggcataaattccatagtatggccattttacttatatctttctgcttcaatacataacggttcatcatcaacgtggtctctgactatgctcatcttgtcactatggtcatcattattgacaattcttctgctaggcaagccaatactaatgctttttcacaattactcctttttgactgctgaaaactttcctttattaccaacattgctgcggcaactgctgctgtttttgttctaattgatttgcgaattgtctgtactgctggcattcaaaatctttgactgcttctaaatctacaagagtcacaggtgcacagcatcactcctcatgaatctcctggtttgaccatcagaacttcagaagtagagcaataaattaatggcattatcatacttttgcaagattttaaacttcaaatgaaaaaaaaaaaaaaaaaaaaacttctgttgtagtttaatatgatttcatttgtaaaatactgcttacagaatttcaggtttgatattgtatattctctattgttttttagtctctatgaaacagaaactggtgggtaatatattgtattgaactgctgattttgaaattcaagaaaacaaaagctgaattctttctgaacatattttgctattctcaatctgatgggtaagttttaaagtgagagtattcaacttgatttcagagctcccgctgtatctattgctgggtattttatgtggtctggtgtcattggccctatctagatgtacatcatatatgttgactattgttgacaatctgcacaaggccactggcattccacgatcttcattccctgtattgggaggcttatcagttgggttgatagcattgatatatcctgaaatcctctactggggttttgagaatattgacattttattagaatctcggccatttgttaaaggcctttccactgacctattgcttcagctaatagctgtcaagatagttgcaacttctctgtgcagggcttctggattagtgggagggtattatgccccgtctctctttattggtggtgcaactgggatggcttatggaaaattaattagtttggctgttgctgagtctaatcccacgattaacctctctgtgttggaagtggcatcaccacaagcttatggcctggtactattctttccattttggctattatatggtttttaccatttcgtattttatgattggcatcgtcagtttttcttctctttgacatgggggatcaattatatctttccaagatgactaccatgggtctacaaagagccatttccaagaggaactctctttcctgtgtgtacctaatatgagtttttaatatttcagaattttgattctagatagggaccataaggtttgctaactagtttgatgttaaagtcctgtctcttcagttcttgcttgttatcttaggagaatctcttggacatctgtcctgtaatctattctctgtaagtaaaattcttttgttaaatatctgattaaaagaaggatgccatgggtacaataaatgtcaaatgcataagttggcattttaggttatcaatgtattaagctgatggatgatgcccttttttcttgctggatatggctccttttcattcttgggctaggaatataagggtcgggttttgtattcagggggggattgctctataggttacttttgtgaaggggtatctagacaaatccagatctatggatgcctaattcttgcaatacagcttgtattagggctccataggtctacacatagtagggcaacagtgtaaatataatagtaccacttgtacttaccttattattataatacatattactttttgctgaaagtaaaatgaaagaaggaagagaaatgaaaggtatttctcttgcttgggagttttttcagtaaataaaagataagtagtctacctctaacaatttttcgattccttgagagtggaggataggtccattgcttgtgtttcaataatgttactttgtaaacatccaatcaagtgaaaggaaagtaatttttgaatctttttttttcttttgctaattttcgttgcttttttttttttttttttaatacatttcaagggtgtttggtttatgctctgttttattttcacttgatatgttttcactaacaatttcaaagacgctaccttcttttcatttggtttcctattttcaagattttgtgaggaaatggtgtaatagaaaacaaaccatacagcctctaaatttccaaacaaagcatttactctttggtgaaatcataaaacttattttgtgttcaagtagctggaatgaatttacataagcttcaattcatgcttacaaatagcattatccattgcatttccaactatcaatagtcatggtatataatgatatgttttcagtttgttggtttcagaactgtcacctattaacgttgttgagatctcacattgactagagatatgcccaatatattccttaaaagctttggacaatcctccatgtagaagctggttttgtggggttgattagaagtcttgagccaaaattcttaagataatatcagagtctatcctagatctgttactgggcttcttgtatctgtgtatgatctagatgtctattcctaggcatgaggaggtggtattattgggccacctgcattatctatgctccaaatgtctagtcctaggcttgacgaggtgtgatgagatcccacatcgactaaagatataatcaatgtagtccttataagtcttgggcagtcttctccttacaagttggttttgtggcgtttagttaggtcctattgtcctaagctcaaactctaaaacaaaatgaaagcaataactagcaatttgaaattctgaagcactgtatagtgtaagaaaatgattccttttatgagacaatgaagatatgcttttggataattgaagggatgagaactgctatagcccaaaaatgagcttgaccttgcaattacgctttgcttcttgcttctccatgtagccaagtttccacccaagaacatacaatatcttgaagtggaccttctatctataatggaccttgcattagtgtataactccatagtgagtctctctctcctttaacagaccagagcagccttcttgggattcctttcagatactgaagaatttattcactgcctacaaatgtctcatgttgataatgcataaatttgtgaactacgcttagtgcatagatgaccatattgaagttccttttgcaggttgggatggcagcgactcttgcaggagtttgtcaagtaccacttactgcagttttgcttctgttcgaattgacacaggactatcggattgttctaccacttcttggagctgtaggcttgtcgtcatggatttcatctgtacagacaaaaagaggagatgacagaggggcaaaaaaaatggagttagaaaactcaaattctgctttactttcagaaatatcttctcgtagttcaattgagtcatctgctggtaatacctttgctgaagatgtgtcatatttgagtaatttgtgtcaagtggaaagttcactttgtgtagaggatgataatgttgaaacaacatattttgtaaggagaacatttgtttcggaagccatgaagacaagatatgtgacggtttcaatgtgcacaccacttatagaagtaatagatctcatgcttgcagagaaacaatcttgtgccgtaattgttgataccgatgatactttaatcggttttttgacgcttagagacattcaagagtatggtaaatttgcaaaagcaagaagcacaaaacataaggtacaagaatccaagtttagtattaattggatgtgaatctataaatcctaagataataggtgatgggtatgctattgaaattgtatcttaattatgagcttgcaattttataccatgaattggagttggtagacacttatcataatacataatcggtgatacaacacatttaaccaatcattgtttgaaaaccagcagtcattacacaaatgtaggttctctatatttgtaatgtaacctgggatgcacaagtccgagtttaaaaagtgccttgtagatgaattggttgaagatattgtaagccccccctccccccttttctattaattgtgtttcatttgtagatatttggtatcaactgctgaactaaactactttgttgttgcttcacaaatctgattatttggttcttcttcttacaggagcttttagtttctgaattttgccttttaaatggagaaatatgcagcgtgccatggacagctacacctgatatggaacttcgttatgctcaaatgattatgaaggagcgcagattcaatcatgttcctgttgtgaggaatatctatgaaagaacatatccagttggcattatagacccagagagtatcagtctaacatgcaggttttattcctttttttccaatgacttatttgtatccctttttaataaattgttttgtcttccaggagcacaaatcttttttcaaatatacaatttgtattttaattcatatttatttcttattttgaaaggattgaattaaaacagtacaggaaagataatatgctaatacgcatggacatatacaccttgttatttatatcagggttttgtttaaacatgaagtgtcagtggaatatgtagaatagttagatgcttacaaagatgtcagttgccacaagacaggaagattcaactagattttttataggctcaaaagagctactactctactcctatcaatctaccattaaaactatagaaagttacagagctaataaaataaagactcaaatatttcttcattgatactcagccaaatgagggataaaatttataacctaaaatggttgtcaataacaaccgcacaagtatcctcatctaattttagagaatttaaaataaaactgaataatattaaaaagataatatttgaatcatttaatatttaagtcacctattttggactctctaggcctattctatcaattttcctcataggtttgatgattacgagtgcatttggaatttgtgatttgaattttgaatatcttgggaggttgaagggtaaatttcattgcatttgctgaactttgcttcatggcattgacattgaatgttaagcaaatgtacgacagacagaatagtcctaaaatgtggcatgcagactggaaaatcacgaattcagatgtggaatgcagagatgcaaattccttaataataaaaaatcagatatactaaaatgagtggatctaaaaggaaaatctaggatggccagggatgaaacttaaaggacggaataggaataggaatcattcttcatttcaatcattttggggttaaaaaggatattacttaattctcttccatgtttgtatgtatgttatgcctttacgtaattatttatttttgttaagtacagtgctttggccaccagacagtccctcagctaatattccacactgacttaatcaccgttaggaggctgaagactctttcttggcactataatatctgcctttaacacgccaagttaaatcctgtcacgtcgttggttccgtggttgtacgtaaaaaaaggttcggtggagttcatgtgtatagttatgttcgatgaaagtaaatgtagttcccccaagagagaacccttgtaatttgatatagccatatgtattgtccgatatttaatttgcagggatcaatttggtactgcaatattatagtaccaccactatgactttgcaattttcaatataaaaaaaaataaaattctgtgacttttcaaccgaaatctagtagcatttcattcaagtgtatcttttccgagtagtgtagtaatagaagaaaaaatagttggaattaggaagtgcaacaagttgtccaggcatacgaagttagaaatattaatttctcattgtttgacatatattacaaaaaacatttacaggaaatatcgtttgagtttgatgaatatacatggtcagtgtaagattttatatgatcaatcaattaaaaataaattttggtgtgatttttagggtgattattatcgaagtaaaaaaattattatatataataatttgtcatctgatgagagacaacttaaaaaagcgcatatccttttttatcattgtttcttaggaatatttttttattcatgtttatcataaaattgttctcataaggtatgtaggaatctaataaataattttttaaaatattttcttatgtgataaataattaaatttaagaataaaaatactaataaatgtacttagtatacgtattataatttttaaaatgtttttttattaatacattgtcttaattttttaatacattaaatattatacttttaaaaaacttttttatttttttaattatttaaaaatagttaggacattaattaacaaatcatttcagaatattattgttgcaacatttcaagaaatattttaatagaattgtaaaaaaaactatttttgaaatagataaaatatatttttatccctaggtcaaaatttgattttactccatataaaaatttaatgttttttgtacttatatttttaaaaaagcacgtgtgtctattcctgatgaggaaataaatgttagtatctgtataatttttttacacatgtaaatgatttagactgaacaagtaatactaaaattcaaaaaatttacataagaaataaaaataaaaattatgaaaactttatgacaacatttttttttcttttttttttttttttaaatagaatctcggtgcttcaggttttaaaaaaatcacattaatcctttaaagtttctctattatacaatataggttcatatgttagtttatcacacatgacaaaaataaaaaatatcacatcaatcaaatttaacatcattagtaccaaaaactatcacaaggatcaatttggtctaagaaagacattaaaaaagatcagagtaaaactttttaaatttaacaacctcatcaattgatctacattgggtaaaaaatttaaatcatataaaataattgaattattatcttaggattcttgattttaggaattatgattttgggtataaaaaaatatcctttaccaaataccctctcggttaaagttacacctcactagtattttatcatgtgtattacaaaaaataaatgctttttggatataattaaaatttataataaataaatacttttaattatataatttatattataattaaaatttataataaataaatattttgaaacatttaaaatatattttagatttatgattaataatttatattgtgatagtaattattgatagtttttttaacaaaaatatatatattgaaagaaaagcaggtaaacacatcctcattgaagaatgacaattaaaaatactctcaagatatgagtagagtttttataagaaattacaaccatgataccataccacaatagtataaaagaaaaggtacattgtagaatattgagcctacaatgttattgattttggtaaatgaatatttgaggcaatttctcaatttctcttaggacactcactaaacatggaaaacaccatctaattggctatgtgattataaatttgaatttaaacttgatttttgtaatttgaatatcagaaattcatcaaagtcaaaagcagactaaacctcaagattcagtcaacgttgatagagatacttacatattatttatcaacaaaattcttacatggacaaaaaaattgaatctatgtctttatgagttataaattcattctataccaactagatcaatttttattgactaaatacacccaatctatgatgattaatggaaaagaatattctaaattctcttgcaaaatctttctattaatcttcttactaggtaaaaaaaagtattaaatgcattttaatttctaaaacattaaatatgtttatttttcatttaatattttcttcatatggtattaaaaaattgtaaatagttgttgaaacacttggactttatgcaaatcaaatagttcattttctgcgggttaaaaattatgtaagcaattccttaaaaaagaaaaaactatgtaagcaattattaaactcagaaaaatattaatacgatgacgtataagtgctacattattattttcttaaagcaaacttggactataaaagttgacatcaatataataaatacagtactgaacaaaaaaataatacactgcaaaccaactttatacataataagaggtctacaagacaattgtggggcggcgggttgtcatgggatcattattgatgcgcgactggattgccaaaatagaatttgttttcctatctgtttcaattttaattctccatagtctttagatgccatctttcatgcttatcttgatgttttccaccttaactgacaactctaacttgtgatcctcaacagctttcaaaactgaaagcaggttggagcgataaatttcacacttccgatttgcacactcaagctcattcataagttttctaatattcttatccaaatcatcctgcaggacataaagcaatgaaactaaaataaacaaaagcatacttaagcatgaatgattatatatttaaaaccaatgatataaaatctgttacacaataaatgttttctttcttcagaaagaatataatatttgaaagaaataagagaaagtacatctaggggaagaataataaatccccctaaatttaagaaaatgaaacagtaacgaagtttctatatatctttcaacatcattaatatttgtatataaaatccctcctgattctaatctgttcagattatttcattgttaggtttagctgtttccaatttagactcctaaattagtgtacagtcttcattattactttgacctgtaattcatatttgaatcaaggaatggaaacagagctttatttaaaataccacaaatgattatatatatatatatatatatatatatatatatatgtatctggacttaaatacagtaaatctacaaaagcactcataataactaaaggttattgaaggattaagagtaaaaagtaactagccttaccttgagagctaaaaagggtgtgccaacaatcaactttctcaaaatcttatgcggttagatgaaggttcaagactagttatatatctctaaccccctcacaccaattccttagggcttgagacaaggccattgcacaggttttctctatcttgtgacagaattaaactttatttataagaatgaaagtggcagggatcaaactcctaactacttggtcatagcagctctggtacgatttcaagattggttttaggtgaagccgtcaaggtttatatcataatgccttaagctattaggtgaaggttcgggattggtttcatataacggtggatgaaagagtaaatgcactcaaacagatatcataaaagagattaaaaacatttttcaaatggaaatcagaccttagacatatgctggctcaagctttcttcctggcacccacttgtgtaattagcatgaatttcctcgttcagcacatgactccttacctttccattactgataggaatttttccctcattttgcattccctgagaaactctttttgcagcttcttgtaaagcatccattgcaacatcataagtttcaacagaccgcgcgccttcatcaacaaatttaaaagcctcatgccggagggtgttatatctaactgtatgagattccaaatagtaagtatatatatcacaagcatgttcttctaatattacattgcttttggcatttcttgtccaacgtttcagtatataatgagatgggagagtaagcacattggtaactctaaagactgccaaaacgtgcctacaaagaaggcctgaaaactcaaacatttggcaactgcaagtcgctttcatctccagaacattgaatttaacacaataccctttatggtcctctccaaatttagctacatgatatgtaatgacctccccatcatcatcagctttggatgccattaatgtaagtgtcccaactaactcctcctggaacctcatgaaaatttttctcgtgtaaagttcagatgcttgcttctccattggagatggggttctcaataccggcaaagtattcattgtgtcataatccgctctcacttctttctcattgcgactttcaagtgctttctcatagagcttaaagaactgacttaaattggttgaagcatttatatacccatcaaagtaagagttcatgctatcacttcgctgagtgatggacatttctgcaaagaatgtgtctcgcaaatatacaggtacccactgcctacaagaagaatatattgcttgaagccattcatggtccctgagatcatatttatctacaagtgttgaccagcaagactcaaattcctcagtcgactcagtcaagttaacacatttgtgaaattctgcttcaaaatttggatattggaggaaaatatgagataacttctcctggcattttttaaagatgtgccacttgcagaaacggtggcgggtctcggggaagacttgtattatggctgaccgaattacagaatcatgatcagttgttattgacactggcggatgtccagacatggccataagccatgtcttgaaaagccacacaaatgatgcttcagattcgttaattaggaaagcacaaccaaagagaacaggttgcccatgatggtttacaccagtaaagggagcaaatggtaaccgatacctattagatcggtatgtggtgtcaaaggttacagtatcaccaaaaaatgtataattcatcctagccttgggatcagcccagaaaacattggttatggactgatcctcatctccttgcacagcatagaagaaattagggttttcggcatgcatctgtctcaaataatcaagaacaagttgaatgtcaccttctaaacttctcagcctattattcctcatgtaattcctacagtccacctctgtgaagccgactttgctaatcccaccatactctttaataagtgcagacataattctacgagggcccatcccagcagcctgtaaagtatcgataagcgtcttggcagatcctgaaatttgcctgtgagagcgaaggcaatgcacctggtctggtggaacgagttcgtgattatgttctctaacaaagccagagacgatccacttgccagagtcttgcattttgacagaaagagaggctttacaaccgactcgggtaattgtacgtgggcgcttgatctctctatcctttgtgcgtttctcattcaagttgcggaaaccctcctttgcgcaaacaaattgcctctgtataatagctccatcgcgcctggaacgacgggatgagctgacgcgagtactaaacccaacacgacgggcataggaattgtagaaggccttggcagcctcttcagactcgaattccatgccctcgcaaggttcaagatctaagaggtccccctcaggaagatatatttccccacctccagtggctacagccaattcctcctcatcaattcctcctccgtcgtcatcgtcatattctccctcgcctcctcccagcccaatatcaaattctagcacctccacctcgttatccatcactaattaatttatttatatcccaattactaatactatttctgcgatcaggattcaggatatacactactacgaaacgaaagcaaagccacgagatatggaaaagaaaacaactgaccgtcgtcgaggtcgaggtcgaggtcgaggtcgagtgacagtaagaagtccgcgccggacaacaaagagattatacaactccaaccaaactgcagaatgaggaaatgccgatatttttctctctcaccataaacttattgctctcctctcaaaacaaaacataaagatatttaaccaattttatttttttatataaaaaaccatatcattcaaatattgataagtgataatggaatttaaatgctagattccctcctctttaaaattgtatcaacggagtcaaaatatttttaaaaatgggaaacacaattgtatttaaagttttttatttatacttacggttgcttgatagttatgtattttactattttttattctttattcacataattttaaatatttgatattacttattattataataattgattttttttaatactttgaaatcgaaaaaagaatttaatacctgtgactataaaaaaattacacaaattataattgtaaaatgaaatcagggccggtcctgaaaattctttggtccagggcgaactgaaaaaaatgggtccctaacacacaatttttttgaaatacaaataatactaaaattaagggatgaaaaaaatgggcccttaacacacaaattttttgaaatacaaataatattaaaactaagggatagaaaaaataggtctctaacacacaaaatggacccctaataaagattttatttttattttttttttaatttttttttttttttacttaagctatccatgcaaaaatatgtgggccctgggcgggcgccctgctggccctgccccagggctagccctgaatgaaataagaatgtgactagttaaatgaagaattttgatcgatcacgctttcctcctttatgtttatgaatgaatccattttgatcattaagatactaacatgggtaggattttaaattttaaaataactaatttaaaaatgatattcactaaaattgccacaattttttattaaaattttaaaagttataaactcaatcactcgcgattagtataagagtcatcaaagtattaacgcaaataaaattcattatgtaagaatttttagtgatttttacccctaaaacattttaaatcaccaacgtaaaaaaaaaaaaaaacattttaaatcaccataatgcacataaatacaacagtcattaccaacaatatattagttcaggaatttttaaatcattaaaacgaccaaatatacatgtttatactcaaaaccattcggccaatacacaagaaaaagaaaggtaagtttccttaggataacaaacttggaagccttttggtaccaagagatacacttctaaataaaaatatatatatatatatatataaaaaaattgattttttaatcattgcctgaaggtaacagttaagcaaataacaataataacaataatatattcgaatagactctatttaatttaaaagaattttaaattacttaaatattatcctttttgacaaatactaccctttttcaagtgtcaattttattaagaatttttttttgttcatttttatctcattttaaaagttcaaaactttccttactcttttattaattatatccttatatttatctatattttaaaattatcttacccatttatcatggaattaaacagatcaataaaaaataaattgtagaaaattaatcaataagataaataaataatataataagaaatcatgtaacaatcttaaaaaaagaatattaattatatatcttaattcttatgtcacaaccttaaacaacatctgaaaaggaacaagactacttttttggttccttaagagaaactatctccttccactatgactcaatctccattgttgaaaaggaacaagtcaggttaagttgtagactgccagcggctgcctaagtctcttcgctatctatctgtggtacttccatattctgcttgaaataaatttatcatttacattaatggcacatacaatcacaaaaaaccaagagtaacactacacaacaatggtgagtaaatcaagatatgaccatgtaatggctcgttctttagcttataaggaaaatgctgattgatattcagcaacgtccaaaaacaaagtatgccaaaactaaaactcagtccattataatttggccaacagatgaacggaacatattactcagggcatgttgaacttctccagaggtgtgttcactcctcacgagatctaccagtaagtgaaagaaccgtggaatatacctcctgaatgaatcctttttcagaccagccaatccttgcaatgctgagatgactaaagatgtcctagcagctatctcttccttctttgctgagctcagagggagttttccatgaggcgctggcatggtatcagacttgtgaaaagtggaaatggaaccagcacaatttaggtatatgtccaatacggtttcacacacagcaactaactcttgttctagctctatctcatcatgcacaaaattatcatgaagatgtatattttgtagaaagttgaggtgattctggaaggactcattttcaaaatgaaccatgggagggccagatatttccaggacagagcaagctttctgcaacttcctcagtagaattgactctctgttcatctcacgagcatgtaaagcaatagatgaatataattcaataaggactttgatgctggctgcagataaggattgctggtgctttttgtacagatcagttgtaacctgccaatagaacacagaaagatatcatcaagatgaactcattcagaggtgaaatttatatcaagctgcactacacgtctttaaatctgttttcatgaaaaaactaataaaacaaaatcagtggattacgatttaaattcagtggatgcatataaattgaatactaggaaatttagtgcttatgttttaattgttaacttatgcacatacaaaacgagcaagaaataaacctgtacaataagtagctgcatagcaatatggttcttcgttcttgacacaacatatgtggccgtttgcagattgtcatcatcaaattcatcattgttcaagtcatgatcagaagaactttctaagtcagcagaagaatgtgaaatgtgaggcacctcaatattattcatggttctcaagaccttcatgaatcctggcactgttgacatagctgcatctttcaaacatagaaaaatctctttccattcttctgctgaaagcctgttaccaaggtcacctgtgagacgcactaatccagcaactccagtactagctggaccctgaacaggacttctaatgaaccctgtcagtactgacaccaagccaggtagctgagacctcaccacatcaaagaaggtgacaaataaatctattaaacattctgctgctactgaataagtctcagaatcccatgtgcttccttcagtatacacagatactgaagaaggggaacaatgggcctcttgtagattcatctctctatttccagataccgagttatatacagggaaaataacagaacagaaaatgctattccaaaatgtgtgggagaatagatgaccatgatccttcaaaatgttaaaaagcacctccaaagaactctttctgatagctgatcttggatcagaagttagttttgataaccctgcaatgaaaatataaaaatattaacttaaagcagaaagaacagacaagagttatggaatttatgttatctcactgctgcacaaaatgtggttaaatcactattacgtttgcttttttgacactaactaggagctaaaggtaccacttatttgctacatctaacaagagaagtgcaagcaaatctgttgacaaaatgcaacaatcattgctcaagattttaacgcaaaaacttaatacaaagcttaacatactgtatataaaaggcagcttcaacaggaatgtgagcaatagacatttgagatttatgcaatcaatcaattaaacagaatacatacatttattggagaagattcacaagaataagttttttggtccaccgttatggtacgttggccactgtaccaaatatcttagggcatatcatctaaatgcatattacctgatagcaaaggattccaaaaggagacatgatcaccgttatcagtatgagattgtaaatctgaaataccatttgctacaacaattgatgggccatcaacactgctcttcttattgcaaacaagtcctccatcagcaagtctgaatgcacagaaacgaagaaacgcaattgcattgaggctaacgtcactgttgaatcggctatttgtaaatgtcaaaaggcatcggacacaatcggtgaaggtcattgtctctgtctcagtaatataaggaaaaaattcacgcactattttctccatggtctcaaatgctagtaatacaatattcttccgctcatcagctgcagcagctgtaaaaacctgagtcaaaaacactgcattataagtcaagattgttccattgtctcaattcacaaatgctaacaaatgagatgtgcattttcttcttgcttaggaaggaagcggggacattaatgaagcccatagctgaacatggtggtaaatgtcattatattaacaatttgctggtacactaaacttgtgtattgcatttagattgttgaaaaccatcaatagtttgactagatatgtatccttgatgtcccttttcttttctttttatttgtatttatttcctttttaacaagccgttttagaggtattaaaatttgaccatgaatattcattcctgaaagattgtttagactatctaaattgccaacaaatgtgtgtatgcaagtaataaaatgtaattttttcttgaaaagaatagtaaacaatcacaaatgtgccttctcaatttgttttgctttcttcaataaaaacaattgggcaacatttgacagtttcaatttttgttgtttatcaaatggtctcaaggagggagggagggagggaggaggggggggggggggatcaagccaacttcaacattaccataaaaacacttttccagccagatttcacattactgacacggctaaggaccatctgtgaaatacaacgaactattaattctctaatttctgtggtgttgcttttctgcataacaatcacaaatggtctcagaaattcattctggaagttataattagccagctcctcacgctccaaaaatttcattgcaagttgtcgcagcgagtccattgcaaagattgcaactgacaagttttctgacaatccaaccgacacaaagaaatctgagagaacattccatatgcgagaccatactaatctgatgcggttcatattataatgcctgcaaatgcaaccatgttctagtcttaagtagattgaatgatcattagaattttaatcataaatgtgcatgagaagagaataacttggaatcaccaattactagctacaaagaacatgaccaagagaaaatcacaatccctttcttaaggtctaataaaatcaacaaaggatcccctttcaggcaagtaacatttccctcattctaaaagatataacaattaacataaatatgttagagttagagacataaaaccattcttgatccaccatgtaacattttaagctttttggacagttgttccttgacatgatattagagcttccaggaccaatcagttaggagttcaatccttgtaagctcccatttataaataaagttgaatttcagcaaaaggaaaaattggcttgtgcattttttgtgctttaacctcaaatgattcttgggaaatgttggatgtataaaaccattctcaagatgtagtatatgtttttcaaaattaaaagatgattttatctaaattgattccttaccagttctataatagatacattcttagaaagtggattatgggcctaactcaaccctacaaaaccggcttgtaaggtgaggattgctccctacttatatactatatctcaacactatctctagccagtatggaacttcaacacacccctctttgcccatggctaccaaccaccacaactaaggtgggctaggggtgaccccaactaaggtggctttccaacatacatgatatcttaacatatctcataaatatccaagatattctaacactcccctccagccggtgtctatatatcatatgtgccaagcttgttccatatgtatctgccaaagtcctaaaacaccctaccttgctagtccttaagagctttgcctgccaagtagctcatagtcacaagaaattcctttcttttgaatgaccattttgtgatttaaaatataacagcataagaagatcacaacactcaaacacgggaccgaggagattgaacataccaaaaacctaaaccttcaatctgccaggttacttggcatccaagttacatccatataattccttatgagttatgataatagttgagcttatcaatagttgaacttatcttaaaattcttactttttccatctataacagccactttcttaagataaatatcaaaagcaataggttttatgtagcagggcaaggcattactttatttcgtgcttggccacaacattgggctaaatgcctaaaacatatgacaatgtcaacaccatattcaatatgaggaagagaaaaaattgctggggtcatgtattcataatttcatatactaggatatttcatattcataccaaaacacactaggaaaagtacaaataaggaatataaaacaaaatgggcaatgtctgagtgtaaattgcatggtttatattcattgtgcaagctccatatgtcaagaaaattattatttaagaaatctgaatgaattgcacaaagagaacatctatcataaaaaggacaaagaaacttacgcaatttctactattttagtgaggccaaatacacgggggtctgttggagactgtaactctgaaatggaaactttacaaagtgctttaacaaatgctactattgcttctccattcaaccgttgactatgagcaaacacatggttcagttcaaagtttccaatctggtccagtagattcaagtttgaaatgaaattatttatctgttctgttgttaatattgcagaagcattgaccccaatacttgtactgtcatatgaactaccacggacaacagccaccatggctggattctggagtgttcctttcttaaaagaagagaaacttaatgttttcagtgctttctcctccatttcaaaattagctgaagtgaagaaggttgcatcacttggggcaccctcacctaacagttgcaaatgctcaattcgggagaggcaagttaatatgtgttcccatgcttcatacagatgatctccatcttcaatcgcaattgatattattgcctgcacaaaaataagatttaaaagatactaaaatgacatatacatgaaatcaagtggttcattcacatgataaacacaaaaaaatgtaccaatcacattctattttcatgcgaaggattaagcaaataaaatcaaagtgaacccattcatcactgctttcttgatataagtacaatatggctaaaatgacattaatatatggtgtgcaataagcagttatcattataaatgcaaaaggagaataaaggtgtgagtgatttgatttgagtaatgtcaatggcatccaaattaagattcacttaccttgacagcatcaacatttttctgtttcatatctccagcacagtgcagataagtaaatttggcaacagatgtaacaaaagcatccctttgagtctgcagacccatcactgcagtaacatgcacagcatgtcgaaatccttgtaagcattgagaagtagctaccctgtcatcactctgatcaagtgttacactgaatgcagccagcataggcccccaacaaacttccaccataaacctcagtatagccacatctgtgacaacatgatacgcagatctgcaataaccggtaaataaaatgtctaaactctaaactatgaaacgcattgaaagattaacatcccttatgtaatctataatccagcagatagctaagccttaaaggaaaagaaaaatgcacatatggaaaggatgtaagatgcagagccagtacacaatcataaatatataaacaataaacaacaatagttgtagccttttcccaccgggtggggccagctctcatgaatcaaaaggtaaaatcctctcatatatcatatcaatatacaaactatttaaatctaaatctttcttaacggttttccctaagacttttcttagtttttctctacctctaactattgggacttatataggtcttctctacaaatgctcaaaccacctaaagcaagaatctaccatattttattttcaacaataggtgctaccccaatgttctctagaatgcattcattcacaaacttgtctgtatgtcatcgtaacattctcatctctacaatattgagcttttctccttgttggatttcattgcccaacatcacaagtcttatagttatgtagtaagattttcccttaagcttgagtggtactttcctatcacaaataacacctaaagcactccttgatttcatccatcccacttgaattctatggtttacatttccccatcatttgtatgatgaccaagaaacttgaactatagaacctatgacttgtggtatgttatagtctccaaatttcatgtccatactagaattagtgcgcctctagctaaactaacattttatatacttcatttcccttctacttaaacaaaagtcaagcttccaaagtttgtctcctcctctattgcttctcatttatttcttctctcaactatccaaccagggcatatcatctgcaaaatgcatgcattatgccatctgcctcatggatatgttcagtaagaaataagaacatccaagaccaagttaaaaagatagaggtttgaagctcactcttggtgcagtccaatagttataagaaagtcctttgtgcgcctcaccttatgttcacactctaatttgaaaccatcttacatatctttggttgcccgactacaagcaggacaaactcctttcatttcctaagcgaaggacaatacctctcttcgtaccccaccatatggtttttccaaattgatgaattgtccttttaattcctctaatgtctctccattaattcctccaatgtttttccattaatctttgaaggaagtatatttgctttcgtgggtaacctccccgacataaaacaaaattcattttctataatgactgcttaattaccctatcttgtagtttcataatatggctcatgagcttaatatttctataactagaccagttttagaagtcactcttgttctcatactcatatataggggctatttggggtcacagaaatagtattattttccaaagcggggggtttgatagccataggctgtttgatgatgccctcttcttttgctggtggtggtgtaaaaatttggataaaggcttttacttgccgtttcatgtatggtcatctaatactagggatatgtttcgtgtatagggaaggttattatcatacttgtatggggggctttgtccatcctcgctatgatattctaattcaggccttctatgtattaggctaccatagctatggtttttgctagcatggacttgtttttgtttttatacttgtatcttttgccctaatattaatattatactttatctttgccgatcaaaaaaaaaaaaaaaaaaaatatagagaataaggcacttctctactcatttagtattatctccaatctcataatcttgttaaacaactcaatgagccattttatgctcctacacccttttcatacctcatggtatataatttgaccgatgtcctccaaaaaccctccctcacttctttcaaaactccttttttcccttcaattgctaccattttatccttgaaatcctatcttaaccatttctatttactctcctcttgagttatatatccataaccaagatcctatgctggataaacaagtattctccaagtatgactttgcaatccatgcaaaagtttctatctgatttcctaattagagggaaaaaaaaacaattttggaagcatgtcaccttactttagtatgtgatatgatgttcttcccattacctaaaacaagtgttagctaaagcaaaatctagaaatgttttaccctctactatactctagacaatcattcatgtgaccaatcattcatgtgaccaactagatcatctcctaggaaaatcttaaaaaaaaaaaacaaaaaactacgtaccccattgcccagagctcctcgctatgcgaaggtaagggggagggatattgtacgcagccttacccttgcatctgcaaagaggctatttccggattcgaatccatgaccaacaagtcactaaggtacaactttactgttgtgttagggctcaccctcctaggaaaatctttactcatttcaaaattcctttaactaaaccttctgaatcctctcaaaaatgttagataaaaaaaatccattgaaagatatcaagtagcagagccagccaaatcaaagcctatatacaaaaaattgtggaaaagacagagcttagcaggtctagttttgcaaccaaatacatttccaaaaaaaattaatgataaaaaaataatgcttaaatatttttttggttcctcaaatttgagccaaatttcttgtccttttggtttcccaaattaaaaatgattatttttgttccctactttgaaaatagccctcttttggcccttaaggttattttttgcaatcattttagtctccgtgataaggaccaaaagtgggctatttccaaattaggggaatgaaaaaaacacttttaaatttgggtaaccaaaaggaaattaggcctaaatttaagatacccaaattatatttaagcctaaaataaaaatccaaacattgagaaatgtcttggcttactctgattttcgcgaattagttttaaattgctcctgaatgtgctgaatgagaagcccatttgcacccactgctttttcctcattctgcttccagttcacaagattgagtataccttctaatctcagcaatctattgaagctattagcttgtttattctgaggtgcagaagaatcagcgttcattttaatttcatttttaacaatttggtcataaagtgccccgagatattcctctggtaaatcctttccatcatctattccacggttgtttcgaacaaaatcagcctttgtcatctggaaatccattaacatagaatatacaccacaagttcaggtcaaacctatattcagcattgtaagatattctgaacttacaatctcaattttgtaaaacaatagaacaaatataagcaatcaaatgatatccaagtcatttacaaaatgatattacatgttgatgttatagctcatggtgttcactgtgtttccctgacacaaagctatgatttaccataactaccaccacctacataagaagataaaagaaatggaaagagaaaataattgatattttcaaagctgtattcagaataaatacgcataaatcaaattgcctttataggataattttctatgattaaaattatcatattcaaatttcatcagtaaaatatgatgtaccaactattaaaaaaatcaattaagcctaatagaaacgaaaccacacctagattggacatcaagtaatgtcacaaagctggtactctaactgttgagcctaagacataatataaaagattcagcaaggtcaaaccttatctttcaccatattattatgagcatctgtattaagcattatcacagagtaagcaagaacgtaggcagtatctgcactgctaaaagaactagggttgcatttacagtagcgctcagcaaacttctccatgatgcgatcaattttttgtgcctcaccaggcaacctgaagccctgaagaaaaaatcgaatagcttcaccaaaatccatccctttgaagttaaaggaatctacataagcatgcataacttttagagaaaactcctccctttctcccaaatagtcaccaatcttggtttcatcaaggccagcagtgttcttcaggaacagtgccacttgttctggagaacaaccaatttttttgttgcttatcaaaaattcaataccttttggaggttttcgattaaaaagtgatatgcctttctgcatttaacccagaaaaaaaaaaaaaaaaaaaaaaaaaaagcatcagcatagaatatgaaaatttgcagctcaggaagacaaaattatgtataaatgcaattcatgggagcagaaggagagatacagaagagaattgtacaaacacaatataggtttttgggtaggtaaaatcaaacaattagaactcaatgttatgctagtataagaggatagtttaacattagggtaaattatgattttggttcctctaaaattttaagagtttggttttagtccctctaaatttttttgtctgtttttggtccttctaattttgaaatgcaccacttttggtcctccaagtggtttagatgacactttacagagagatgaaaagtgatgtagatagcacttggaggaccaaaagtggtgcatttcaaaattagaggcaccaaatacggacaaaaaaaatttagagggacttaaaccgaactttcaaaaatttagagggaccaaaaacatattttaccgttaacattgtgacaatataacaatttgtcgtcctcggagccaagtaatacatacctgaagttcgattttatatgcccgacgttgctcaaacgtggcagcatccgaaaattcagaatttacatcagaatgtagctcgtgatcagaagcatttccttcttctacatttagtattagatgattctctgctgcattactgctttcagggctctttgctgggcctaaatctcctaaccttatctgctggtccatccatgctcccattgacttaataatgctgaccaagcatttcacagattcatgtcggaaagtaatatcctgtgctggagacaaagcagtggtcgaccctgtaggtggtcccaaagcggttttcagaagaccattgacaatcctgcaaatatctgatagaattataagtgtttaaatactaaaacaagatgcaaaatcaaacaaacataagtaaataaaaaatctgtcactagatttgtactgcagaccttgaataagctttaacttttggaagcagacagtgctccaagtacaccatataagaaaacgaatcaataaagaagcaaggaaacaattatgatcctaaaacccaaggtatggcctccaacatgacgatctactccaaataactaaattttttatcagaacttgttacaaactaacaattccaaaatcttaagctgttaaggtttagacaaatgaatagttttatattactcctctaagacaccaccttgcacaaaagccttttaaagctttagatcatgttttactcacagtttttcttatctcatttctagtattttgataccttgcccaattttctgcattattgcactcatgtaaggtttttaaagcaaactcttttgtttcttacctagtcttgaaaactttcattccaccaccaacattctttatcttggtccaaaaccttttaattcactcaggactcctcaggcaagcttccaaatcttcttagacgtctcattccaaattaatagagttgagtgaatatgagagaagagaagagaatgagattgagattgagaaatctaatgttattcaacccaagtcataactgattacagttacagattatatagatgatctaacaactaacaacctaacagtcaactaacctaagttagttgatacagctgtcactagcggttacacactaatgacctctaatcacaaactaactactaacaatggtagttagactaacagcttactgaaataaagaaaaaaatacatttgagtaaatgtaatactcttatacccccctgcaagctcacgagggattggaagaaattctttcaactactatgagcttggatctgaatggaacaaatgaagcaggagagagggccttggtcagaatatcagcaagttgatctgctgcaggcacatgaataacatcaatctgtttggtgatgaccttcttcccaacaaagaacagatcaagctccaaatgtttagttcgagaatgaagaacagggttgtgagcaagagagacagtgctggtattatcacagagaatgagaggagcggtatgagcaacttggagttcagaagcagagactgaatccaagttacctctgctgtaataagagccatgctcctgtattctgcctcagtgctcgatctagctacaactgattgcttcttagaccaccaggaaatgagattaggttcaagtaaaaatagctgctccaagttgaccttctgtcatcaggatcagatgcccaatctgcagcacaataggcatgaagagagaaaggaagcctaggagaaccagcttgaaattttaatccccaagacatagtcccttttagatacctcagaattcttttcacagccatccagtgctgctcagaaggcttggacatgaacgggcaaaccttgttaacagaaaatccaatctaatttctggtctggtaatagtggcatactgcaaagccccatcaatagatctatacaaagttcagaaccaaacttggttaacctctgtttatgtataatcaaacctacataaacattcaaacacacgattttcactcaactgtccctttgttttctcctatttcaaaatggtatccagagcctaacaggggtatcacgaaaacaatgcctcaccggggacaatgggtccctggtggacccttctacttgccgcacctttttcgagcgatctttctaacctccggttgccgtcactttttcgacagccactgttcattgaccattttttcgacaagttttttgtcggccagtacatcctcggggtgcactttccccagatctgtttgcctgcaccaaacacatccccaaagatgcacagacgcgtacgttctttgcgcacctaacagcaactaaggtcagcgcatctggccaccttccggacgtcgtttgcaacactaggctctctaaaataaggcgcacaagacccaatccttttcggtttgttccatgagtgtttcctcgacattcctttttttcctatattcaaatgcactggccttgtctttatcctagatgtattggcccttgtctttgtcccagatacaccgatcctgcctatgtcccagatgcactgatcccgcctatgtcccaaatgcacttgtcccaacgactttgccccagatgcatctatctcgccttcagtttaaataattagggtctccaacctttttggtttgaagcttttaaatgtggtttcaagaagaaggaaccttgctttgcttgccacgaattttctcactgatggtcattccttccagcttatctagcaaagatttttttttctagcaattatctcgatcttctcaacatccctgagttgcttttcaaactattgttcttaggtggagcttaattttgtgtattttattgatttattgggaataatttattttcttgtaacatgatgagagcttagtaagcttcagcttgagggcgagtgttgaaaatcagaatataatatacatttattattagtaggaaagtaggatttgtaggaaactagaatttggttttgaggaaacaaaatatcctcacattgttagtatttattgtaatgaccactatagaatagagcattggttgtgtactctaacacatggttttcaatcaattttcctttgtttctcctattttaacatgagtgttgaaaatcagaatataatattgtgactctataaataatactgatttataggcacataatctttgatttagaggaaacaacatgtcctctatttatgtaaaatcaatgtattaaacctaaataaacaagcctccgctatgtattcaaacacacagttttcactcaactatccctttgttttctcttatttcaacagtgacattgaacctccactcttataagtgattagatgttcctctagcttcttgaaacaagttttcataatctaaaatcataagtcgtaaagaaatcaaaaatagtttgtccttcctcatttagtcctccaaaacccaaaccaatatgagctcctgaaaattgacttgcctcacgaccacacatatccacttagatccttgcctaagaaaatcttttcctcatatccacttagatccttgcctaagaaaatattttcctcttatggaacgccttgtaccaacccctccatatcttcccaagacttttcttccataagtgcctccaatcctacttgtggtgtataagcactaatgatattgatgatctcctatgccacaactaattttaaggataagattttgtccccaattctttttaaatccaccacgctatctttcaaatccttgcctacaataatagcctaccatttattcctctaacttttcccatgtattagtttaaatcctgtggtatctagctccttagcttttttctctaacccacttgatctcttgtaggtacataatgttaatcctcctccaaatcatggtatccaatatccacctccatagacttacaatttccaagtagcaaacctaatcaagcacctctaaactagcttcttcacacacatccatccaggaaaatgtgaggactcttactcatttaacactacattcagacatcaatgcaacgactatagctcatttgacactgtactcgagtcatacagtgcgatatttccaactaacgacttagcattagctaaaatcttatgtgagtgatccatgttttatgttagttgtcgagggcctagcacaagtgcacaaccctcctcctttatactttattactaacagaactaattttaatcttccaaatccttaataaagtatttcaacaatcctaatttgacaccaaccacacccacccaaaacctccgccacaaaagccaaatctaaatctacatttcatacaattccaggacactccctaggcttaaagttagtcaaccactatccaccaccctagaaggcatcctttttttctatcaataaatgaaaaaaaaagaatccaatgattttgcattaacaaggttattcatcatttttttttggcaaacaaaattatttatcacctttgctttttaaaatattagcccatgtttgttcttgaaaactgaccactaccaaggtataagagcaacaaaatattacaaaagcaagatacctttcaaatatgtttgaagcatccacatcacaatcatagttgacaaaaatgtcaataataatctgaggatcttgagatattttgtccaataaattaaggatggtcattttttgcagaaaactaggctgaagaacattctcgagaactcgaaggataagcatgggaaagaacatgccaatttcttttttcaagcctgatctgaattttgataacaagttcatgaaaatggaacactgaagttgaaaaatggccatcactgacagggcactgttcttcaataatgacaagcaaagatattgcttgatggcattgagaaacctgcaccgtgtaaaagcaatataggtgtcatgataaattattaacaataaaatggaaaataaagatcttagggaaagaacctttatacatatgtgtaagtcaatgtcattgaacgcaaagagagaagtatattctataacctactatttttacactccacctcaagttagatcatataaaccatatgaaccaagctattacaaaatgtagcaaatccaaagaccctcaagagaattaacaaacacatctattacttattttgtgagaaaatgagaaaggaaaattttctgaatgtgcttgaggttgagtcttttctccggccaacagaatggacttatttatattcaagaaaagttaattaatgccaaaacaatttacaagagaatattaaagtaccactacagcacgactttctaagatgcaatgaacctagctataccaagtatctaggctacttggaaaaataaacaataaagaagctcttatctcctaatatactcctatttccaacatgtttattcaaatttccaaggctagtagtgccataaaactagacaaaatcttgcatgaagtggaagcccatctttatgtgctttgttgcttcatgtaaaactgtattcgaggaaatttaaaggttgtttgacttcacatattagtcacattgcatatgctttatttctccaaaacttaattcttgaaacaattatttcaaccatatgagtgcaaagctaaccaatgtcatggctcaatattatgcttctggacttaaccaggggaaacatcctgcttgtcacagtattacatcaggaaaatgaagaaagagggtcggcaaaatgggattttagcccatcgttagtgtgatggactaatggttgatacgacaacaaagcatgcttgatcttatctggaattgtcactccatgaaaacactgacaggctagccataattatcagctcccatgatgctatgcatcaacatgatagcatgattatatcacactatcaacaactatatgtagagaaaaaagatggtttgacaattgtccatgagcgaagaaaaccaataaaaggcctactaagaagagttgatcagatggaggatagcaagtagaggaaggcaaagtaaaaaaagcaaaacaactagaaagaacttggatctaaatgacctctctaaaggctaggattttgagaaaatacaatggtgttgtttggtccatgtagcagaacctagtggttaaagcctttttatagttgtttattctgatgtattgtgtggttaatgaaatgcctttgttttaagaccatatacaatcatccatcttatgtttatacattttttttttggccagcaaaaattatatatatatatagataagaaaagtctgcattacaaggagtattgcaaaacgaaacctagaaaaacaaaccagaacgaaggaagcttaaaacatggaaacatgatgaaagccacctgagttctgacttagactaggtcatcatacaaaaattcaaatttctaccctcccctgattacaaaagccaaccccatattagtagaccaaaagtggaaagggaaagtaaagccctcctctaaatttctaagccacaaccagcataggaataatgcatcctccatcaaattgtgtctattaaagctgattccttgaaaaatgattttgttcctgtggtgccaaatagtccatgtcagatcttttttatgtataaaaagggatatcaattgaaaacattgatgggtcataaatttgagaattctctaactccgataactagtatacaaccccaccaaaaaatcaaaggatcgtctatttatttcttgaaataaaaagagcagataaacaaagaagcaatatgaagaacatgatatacaagaaatattctttaaaacaccacacgtagcaaagaggccatcatatagagatttaaaaaagaagtagctgaaacaagttacatccaaaacttcttcaacttaaattgaaccaacaaataataaaaaaaagttatgggcaggctagtaggtagatttatgtgtattatcacattatatgtttaataaacttgtcacctccttataataaaaaaatgttgcatattagctacttaactcctaaaaacagtacataattatttttttattgaaaaagcaattttatttgagagaaaaaagagaatataactagggtaggataagataccccctgaaaagaaagttcttgatacaaaaaaaaataatttacataccccattgctgagagactcctcgatatgcaaaaataagagggagggatatagtacacagtcttacccttgcatatgcaaaaaagctgtttcctgatttgatctcatgaccaacaagtcaccaaggcacaactttaccgttgtgtcagggctcgcactcaaaaccacgtacctcattgcccaaaggctcctcgctatgtgaaggtaagggggagggatattgtacacagccttacccttacatatgcaaagaggctgtttccggattcgaacccatgaccaataagtcaccaaggctcaactttaccgttgtatcagggctcgccttctaaactgcgtaccccattgcgcaagggctcctcgctatgcgcaggtaagggggagcgatattgtacgcagccttacccttgcatatgcaaagaggttgtttccagattcgaacccatgaccaacaagttatcaaggcacaactttaccattgtgtcagggctcgccctcaaaaccacgtacaccattacctagaggctcctcgctatgtgaaggtaagggggaggaacattgtgtgcagccttacccttgcatatgcaaagaggttgttccggattcgaacccatgaccaacaagtcaccaaagttcaactttaccggtatgtcagggctcgccctcaaaactacctacctcattgcacaaaggctcctcgctatgcgaagataaaggggagggatattgtatgtagacttactcttacatatgcaaagaggctgtttccgaattcgaacccatgaccaacaagtcaccaaggcacaactttaccgctcaacaagataaaaaaaaaataataataaaaaaaaactgtagcaaggctgagctgtttctctttacataagaaattgcagttctcttgaagcagatatgagtaaacaaaaaccataaatataagcccatcatcttacaagttcaagggcaaagagatttcctaagagatatgagcattccactacaaccaaacacaccaaaggactatctaaatgacatcctcaaccaaactttaaggtctcgttttaatttaccaaatttgttccaaagtagaggacacaccaaacattctccaagaagctcagaaacactgtttcaaagaaaaaaatagtgaccttacagtttaagggctgcaaatttgcaccaaattgtttgccttgatcctgttaactaaagaagggaatggtggacacataaataactgtttgacttttaaacgggtttgagtggaagcatctacaacaaaacaaaccaggagttcaaagttcaaaactcaacgaaaaatgcaagtaattgaaattcactagtttctctacaaaattgaaagtctcacttcaaaaagcccttgaatagaataaaagttcataatgcgtgaattattacattacattctacaaatagtggttgtacaggaatagtaagtattatactacttgcctctcattcccgcgccatattgaaccaccagtatccatgactaccttaaggagctccaaggacaaaattttccctctcaagaggatacgatcgtcagggtgctgttgagatgagaatttcatagacagtttgcacaaattcttaaaaagtagaaacccatcctcccttattttacttccatcagctccagcttcattatcgaacttgtcggtacctgtttcatccgctgctttgggcgaaggtgtgtggacattctgcacttccagaggaggtgatatagacgatggtttgagaggaaaaccctcactggcctccattatctcgttgataaaattttggcaaaagtgtatggaattgccctcgttcaaattcttatcggtgaattccaaaagttcactaacagaaacccgtttaacaaagacatccatggagtcttcctcgactctggtgaagacaatggtcatgatctgagcaagaaccgatttagcacagatctgattagtgccgttgacccccccgaggtacacattgtaacaagttctcacaatttgaatgagacaatctgcccggatcaaaatgcagggggatcttacagctgagaggaagactctgagcacgcccagctcaatcgcctcctccccaaggccacccgacttacagatagcatcaatcatattgaagacaacgccggactgtgaagcactcgagttatcagggcgattgatctccccgcagacaaggccaagagagaacaatttaaaggtacattcaagagcaggctcaacaaccttggggtaggcagagtcaagcgcaagaaagagaggttgaaggacacagtcggcatctgaggaggaaagacctggaataggggattgggtgtcgcctggagacgtttcggaggactcagagagggattcaagcttgtcaagggtggatttacaggtggagacaaggtgagagtgcttacgccaggcggcgttcttgattatcttgtccagtgatggaccgacaactctgccgcagcgggaaggacctccaagagattgcgatgcggacattttcgtctcggcgatgaaggaaaaaaaaaaaaaaaaagatcatagaatttgctcacataataataccactgatcgaggaaaataactgaaatctcgtcccagtccgttcacagattcattatcctatcggctggagatttgggaattagcgtggatgaagcgctatataagcataactccgtcatttgctggttgagagcctctgcctcctgaacctacgtttgcgtaataaggaattgtaagctaaccaggcaacatgtaccacatggtaaacgcacgggtacccggatgtatggtttaggtcctttagatccgacccaacctagacaaccggattggatttgaaattttgttttttataatgtgtttgtctaatcctttattttattaaaataagcatttttttaataaataaatttaaacaaataaactcataatagttttgtttaaaataaataaagaaactttaaaaaaatactagtaatacatataaactccacatattcacagctaatgtaatgtcaaataataatcaaattgtccataatgttttacatggtcatacaaaaaaaggatcggagttaagcgttttgagacattctagtgggagtggtcattgttccaattttctcccaaattgaatttgaaaaatagttcttaataactgaactgaagaaaaatagttcagttcttaataacaacttagttaacaattttaatttaaaatattgaactgaaatatttgatttaatagctttgaaaaatgcaacattagttctaagcaatctctaattctctatcaacaatattcaagtttttgtacatcctatttctcttgtcgctctcattctttcacccccatcattttaattattttgttccaatttttcagcaacaaaatgcaaacctatatgctgtgaaataaagcatctaatattcagtttcaatttttataactatcataacctcaattgcataataaaaactaagagaaattttgaataagtgagcaattgcaggtaaaataccttacaagttacaacagcattgaatctgaaaggtatcatccaagctagaccaaatacattaagactggatgtcaaaaataactgacatgcatccattgaaataatagatattgtttcaaaggcttgaagcaaaacctagacactatgtacatgctagcattgcatattccatacaatctagaacaatgatctgttacgtttctgcaaattcaatgggtgtctctcctgacttcaaattttatgattccaagtaataaacatcataaactacaacgtcgttttctaattcttttataatatcaaaagttcaaaacagttcaacgtggtgtgaattgacctgttctctacatagttcagtttataaaaccgaacctaccaaatagttcagtttgagttttatataattaagtttcagtttaatttcaattcagttcagttcaattcatactagttattttacacaggccattcgattgtttgatggaatgccaaggtgctaatcgatcaagcccttacaattcgttgaagtcacttcttttaagatcaaggcctaagaaatgttgttgatcctgaattgactggatgcattcccatgcatctcttatacacgggtacactttaggaggatgatttgtacttaaaaagttatatatatttttaattcccccacaatagtcacattgaagcttataaataaagaataaggcacaacatataagacttttgaatttgtgaaaaatcaagctttgtctttgctttgttacaagtctttggatggtcatacacaagtgtttaatgtgcaatcctttttttttaaatttttttggaatatgttcttaattgtatatcctctatgtaacaattgatttgaattatatttcatcaaactattgtttgaaaagtcaaaaatgatttaatgatcaaatacttgggtgtttatcaatcttatggaaaagattttagggtgttccaaataatagtgtcaatgatgatgatggtggcaatagaaaaagtcattgtcaaatgcaaagaaggtgtattttttttttaactaaaaatcaaattcacaaaaaaaaaaaatcttgattttcaaaatgaatgtaaaagtgttttgaaaatgagttaaaaattatttcaactttatttttgttaaacacgttttgtattgaaaaatccatttgaaaatcaaaaatcaagaacatccaaccacccgaaagaaggctaaaaaatgtcattatatttaaatttaatataatcaatttacatataatgacaatttttggccgccacatgctcttttattaatattttaaaatttatcttcctcatcaaaagctacttaacgttcactggtcccatcttcttccccaaaccttccatccacatctaacaatacccattttttgaaagaaaaaaagacaaaaaaaaaaaaacaccaaaccaacactttcttttttggctcatgttccgcatggcatacccaacccatttcaattggttggttgtcaacattgtaaccttaaccaaatcctacaccttttctctctatttggggtttctttttggaattgttaaaacgattttgcattgtgaagatgacggtgaagaagggtgttgaaatgatgtcatagagtgttttggaaaggaatttgatttagctagtgatttttgcttaaggtttgcaaagagaatttgtggagggaggttggtggttctaaaacaagagggatattttgattcttggaacttgaggatttcacttttgatggcgtgagaattggaagttagggactatgttgtggatttgttatacgattttctacaatcgaagatatgtcgttgacaatttggtgtgaaaagaagttggtggtgacacacaagctcttcccatgagatcatgatgaggtttaagtcacaggattagcttgtgtccacgacaaataggggtggaaacaggtcagacaagaccagacttggttaggcctgatttaaaaacataaagcttggcctaacctatttacctgtcataggattttttttaagcttggtctgacctatttaaaagcctaatttgacctacaagcctattaaaaagcctatttttaataagaaaattaattttataaaacactttaaatcaatttaggaaagttaaataaacaattttcaaatagaaaatgtctcaacatcttacttatattttcaaataagtaatgatcattttatgggattttcaaggtgatttttgaagtgattgatcatccaccttcataataaggaaatttatatttttagaaaaataaatatattatttttaagttttaatatatatatatatatatattaattaggtcaacctgatagacctaatagatttttttaaaagcttaagcatgacctttttatgtaaacagacttttcaaaaagtcttaacctgaactttataataaacaagtcaggtcaggtcaggtcaaaggtccttataggtggtcgacctattttcatcccaacgataaaggagagagaacatcttaaaataatctttattttttttaacttaatgtcaaattaatattaaaaaatataacttaatattaaattggtgttttaaaactattgcttaatgacaaaaatggtctcataagtcataaaactaaaaatgaggtgtaattatcacacattaactaaatttaaattttgatttttcataaattaaattatcacaaatttacaaattcaacatcataatgtttatttacccttcttaataaatttgacaatataaaaaacctttgtttaaataatatgtatccccttcatcttttcataccctaatttataattattataaatgaaataattatatttgatgtcatctttttttggatgtttttattctcaatttattatcataatattttattttaactttcaacgataataattacattttttttaaataagttacattcaaactatatatataagtgactttcaagtgggagtcgagtgtctttgtttcattaataatcataatcaaaattgctcaaataagatcaaatcaaataaaacacatcctttacctttcccggacctcacggttgtcaactcagttcagccgcacgacctcctcccaagtcccaactctccctctccccctccctcacgccttgctctctcagccaccgggcggtcagccgttaagaaagaaagctatcgcgagcacatccagcagacgcccacgacgccaccgcagtcagtcacttggtcgggacgctacctcttgtcacccatttgcgagcttgcaccgtcgcgactccacccccaacagccgctgtgaccgtaatttttaaataataatttctgggctgtttacttgttcttgtttagttgctccaattattggttcttcgcgtacagaagaaatatttcagaaaattatttatgttgttgattatttagtatattagagttttcgtgttcatagaaaggggttgtaagctgcatctgtatatcacatgttgtagattttaactataatttttttctttaaaaaaaaatgaggcccagcttatattgaacctatatatgtctggctaattgtgttatctatgtgagttctatgtaagttgataatctgctttatagtaatatcattgcattagtcattaaaaatatagtattgttcttcacattcgtctctaacgtaatgggattagttagacatagcagggtcacagaatctttgccatttcattatgacttatgagtttgaagttctcaattgattaccttttcagcattaatttatggattttgtttaaaaaatttaggtaggttgactctgtaacatgtcaacccaccatatttggtataatcctgatcataattcccctcgtcccttacagcacaaatgagtatcactagacagcgtacccttggtggtgggggtcatcatgtattggactacttgaagcgcatgcaggcagataatcctgctttcttttatgcagtccaggatgacaataatctcgcgtgtgggaatatattttgggctgatgcaacatctagaacaaactactcttattttggagatgctgttatattggacacaacctacaagactaaccgatgccgggttccatttacctctttcactgggttgaatcatcatgggcaacctgtgttatttggttgcgcattgattttcaatgaatctgaattgtcatttatatggctattcaggacttggcttcatgccatgtctggcggccaccctgtctctattacaacagatttggaccctttcatacaagttgctgttgcccaagttctcccttcaactcgccatcggttttgtaaatggagcatattcagagaaacccgaggcaaactggctcatttatgtcagtcacatcctgcttttgaaactgaattcaagaaatgcgttcaagaaagtgagactattgatgagtttgagtcttattggcactcactcttggaaagattctacgtcatggacaatgaatggcttcagtcaatgtacagcgcacgacaacattgggttcatgtgtacttgcgggagactttctttggagagatatctttgaatgaggaaaatgaatatttgaattctttctttgatggatatgtgaattcatccaccactctacaggtattggttagacaatacgagaaagctgtgtcaagttggcatgaaagagaattaaaagcagattatgacactactaatagtagtccagttttaaaaacaccatctcctatggaaaaacaagctgcgagtctttacacgagaaagatattcatgaaattccaagaggagttagtagagactcttgcaaatcctgctacaaaaattgatgattcagaaacaatcactacatatcgagttgccaaatttggggaaaaccaaaaatctcatgttgtgacttttaattcttttgagacgaaagctagttgcagttgtcagatgtttgaatattcaggaattatttgtaggcatatactgtcagtcttcagagctaaaaatgttcttactcttccatctcagtatgtattgacacgctggacaaggaatgctaaaaccggtacattgttagatgaacatgcatctgaattgccaagtacttctcgtgagtctgtaacagtttgttataacaatttacgccaagaagcaatcaaatatgttgaagaaggtgcaaaatcaatccaaatctatcatgttgccatgagagctctgcaagaagctgctaagaaggtttgcgcaataaaaaatcagagttctggaacagcagagggagctatagtaaccaatggaagcaggggtgaattgcttgtagcagatgaagatgttccaagcaatcaatctgtggttagtttctttgaacttaagatcttttccttagatgataaagccattaggttctcactagaacaattatgtacacaaagtctttccctggcaaattctacaatgagctgcatccaaggaactatatactattactgtacatgtttttgtgttgaagcaaaaaaaaataatgtacaaaaggaaggggcaattccccccgcgtacaacctccaagctggcacttggaaatcatgcttgttgttttctaggtaatgcttttcaatgtggtaagtaaataacatttatgtttgatcttcttcaaattgctaccaccaactttaaacttgtctcaattaatccttaaactttacataatataccaatgaggaatactagcaatgtattctccttgggtttttgtgggctgcaatgttaacgctatgataattgaatgagacatttaatgttggggaatcttatagatgggtatttattgctgatcgttgggatgggaagggataatatcttgtgcaatttgattggctttttgtttggccctgttatgcaaatttgtatatgggttagggtaccccttgtaccttttttttaatataatttctttttattggctgtaaaaaaaaaaaaaaaaaactagcaatagattctctaatactttcttcttaagactctctcatattagttgaactgcatgtgagttctactagtttggggatgtgaccaacatatttagtgggaccaacatgaattctaccttataaagagtttgttggaaagaaaatgttagtgtgttgctagtatttctcatatgccagtaaatccttttgttttttatagcatcctttaactcattacagaggtgtgcttaccatgtgaacacttgatgacatgtcaaaagactatccatccatgatcgccaaatcctcacaatccatttttttctgctttatttgtttatttaataaatgttcataaattagaaaaacacaattatctttttacacaaaaacccaagtaaattgtgaaatctaatatatttgtcaaaaactgggaagattgaattaggaagaggtaaatatcactttgatgatcaaatctctagaattagtgggtttgcacattttggttggggagctatgctttggtgtgcatgcagttgtagacaggttgcatcttgattttaacctatgttctggctggtgacagtgggtggtggtgatggtgagtgatggtttaggattaatgcattatagatttctctgtctctgtctcatttatttttgtgcaagatttttgtggtacatggttactgtttgagtgatgttgtggcatggtggttggactcgatgccacttactattttttaaattgatgattatttaaaaacctcgtaaattatattttaaaacaaagagatttttcataaaatgaatgaattagatgtcacgtagctcttcccttgttgagttaaatggtagctaaacagaagggtctattgtaatattttttaaagttaatagattgggacaaatttaacgttggtggtgccattttgcaaaaggttcaaagtttaagaggctgattgtaattttccttgaaaaatatgtgctatttatactattttatgtgaagaatctgattgcttatgttgtggttataacgtgcttgtttgtctatgatggacttctgcaacttctatgaccatggtgatctttttttctcatcttctccagtaatttaagaaattgaatttgcttagcctgtaagtttaaattgaacctcttaaaattgaggctgttttcatggattatatttgtgctcatcttgctaagtttttaacattatgctatatataaagtttccttttcactaattattttatagaattatggcacaaaatttatgtgtatttggattttcctaagcgtacacattagagtgagaactgacaacatcttcctatatgtgttgaatatagaatttgaatttgaattattgtttctcttagataggaacaggttgttaaaatagtctagataagaataagtttaaattattgtttcctaatattgtgctcaggatgttaacattacttgtataaatattcctcatttaagaggtgatggatgagtgaatgaatggatgaatgagtgagtgaatgaataagaaattattatttcaatttatccgtatctgatttttaacaatatgtggcctgtatttttgttaatacacgtggtattataaacaaattccctttggatcctatgcaacaggccgagaagcaaaagaaaatccgagagttgactgctgagttagaggtcacaaatcaacgatgtgaagtttatagagcaaacttgctggctttgctaaaggatatggaagaacagaagttaaagctatcagtaaaggttcaaaatgcaagatttagtttaaaagagtgactgccctgattgcaaagggttttaatgtatgcctatctgtccattttgattcctcttagggtatgttaataacctttgtgtagtttatcgtggtccatgtttaaatataatgtttgtgcttctgtgttttctaatcctgtaatctgattgaatatttcaatttctcgataagttattaattgtactattaacttctcgggcctgttaacgaatagaagaaaaaatcaggggtcttcagatgaatttgttggttttcttctattctcgagttacaatatattttggtgggtctcacatctcattaatgattcattctcctgatttagatgtgagtagaggtggaaataggttaggtcagactttggtcaggctttgacaggtctgagcctgatttacatcataattactaagtttgagcctgatttatttacttattacatgtatttttttaagtcttaacttgacctgtttaaaagtctgatctgatatgaaagtctgcttctatataagggtctataaacaagtcaatagacctataggcttaaacaagccaatgagcccaaataggccaatgaattttgttcattacctaaattattcaatgtttcctaaagactaataataataaagaaaagaagaaaattttagcaagcataagtcattatattaaaaaatgaacctgtgatcctctcccaaaattaaataattcaaatttacttttcttcttctataaatgtataattattaatagtcaaatccaagcacaaaatgggcaaggattgttgcataaaacttaattacaagtagcatcataccaaaacctattaatataaaacaaaatattggtgaaaagacaagaactagcagcaaatacttaccctaaacatgatcattactaaaaacataatgtttttgtctcttaagatacccaaaaacatatccaaaataaattttgcagagtaggagaattcttgatggactttgctatttccatccccattgtttgctatttccatcctccattgctatttaaactcccctggaaagtcgttatttttagtgataaaaatgccccttaaaacaaaaacaagtttctattgtatatgtctatcacttaccattgaaaactttttcctgttcaatgggtaatattaactacttattagaatcattggagggaataataataataaaggatggattaagtttatctaagagtaactcttttgaaattaatccacactctcacaatttattttcttaaatcttatagtttgaatgttggagagtccaaccaagaaagacgaaaaatttgaaaagaaaaagccttcctcaaagcacacatgaacaagtttaagagctcatcgagtggatcaataaatgataatgtaagaacttttttgagtttgatagtagtagttcatcttaatctttatcaaatgatgaggaaatggcttatgatgttcttcaaaacacacatgtgatttttgtggaatataagtataaagaaagtacaagttgtttgtgaaaatatttctctaaagaaatcaactatgatttttgagaaaaaggttaagactttagaagaaactcttgaaagagctaaagtaattgataagactgattatttatttgaagtcttaaaactgaaaggggaaataacatgtcttactatagacttaataagatttttggatggatcaaacatgctaaaaatgcttttaaaaaagtcataaggatccattggacaaatataggcttagactatgatcaagaaaaggacaagacatcctcttcgccatcttctcagtcttacagaactctggaaattttgggagaaatctagatatgtggagtttgaatgtattcataaaaggatataaatagttaataaatctaagaatactaacgtgaaaaagacttaaaaagatttgtataccaaaattttaaattattgttattacagatattcttaggcaatcccttttactaaataatttgtatgaaattatgtggttggaattacagtgtattgtgagttattagaaattaactatacaatttgatatccaatttgccaagagagatccaagcacattgacatagacagtcatttcattaagaaaacatgttcaatctgacttcaataattgattcatgttgctttaccttggaagatgttgctctacaagtgagtttatgcattgatggtagaccaattactgacccctgctaatcacattttccctatattgcaaaagatcaaactacaccatgtaaaaattgtgccctacatccaccacttcaaaattgtctgtcaatttgcatattgttttcaacctaccatgcatcatgaagaaactaaggctttatatgatctccctcttcaaactcaattatgaatatgttatttactatcaaattcacttcttccctccttggaaggtccacttgatgccctctcattttatctttaaatatgacattgtttttaccacctctatcccgcccatttggtggtttttgaggcaaaacaacactttttttgcaccaaaacatctctggagaaattcattggacatgatatattgtgaattaccccctatggtctaaataaggccctttggagataatcacacaaatcaataaaaaaatttatgtagttcattttattgacttttaaaataaatactactaatgtatcaattttatccttattaataatcattaacttgttatgagtgatgcggaaatattaaagtctacgagtcgtgaatcaccatcaataacaagtacaaatactctctcgactctcgagtcttgattataagaagaaaaagacatgtttcacacttatttaggaaattagtgaacttcattaaattatgtcattctaaataaaaaatagaaaaatattaggaacactttctctaacacactacttcaaacactctctctaattgatgaaaatttattgaaaattataaaatcaagataatcattatatgtgatgtgagacctatcagattttttcattttcaataaattccagccaatgaataagaatgtgtgtgaatgagtgtgttcctatcatttctctaaaaaataatcttttttcctaagctatcttttattgaaatttgatattaaacataaaaaggttaactatattaaataaaggatattctaagtataatctcattaaataatactttataagttaagatttgtttatatttcaaataaaaaaataagaaatttgtgttgtttatatttaagacatgaaaaaatatttaaaatgtttaaaatatttaaaatatttaaaatatttaataataacaattaataaaaattaaatattacataagaattgtgaaatgccttataaaaaattcatcaattcattttaaatttgtcttataataagaatcacataagagtattttcatgttattttattattttattttaagtttatttaacttgtgatgataatacccctatttaaaaaaataatagttgtgataaaataatataataacgaaatatttttgtgactatgatattatgtttaaattatttatttatttaatgaatgactgaatttacgagatatttattttttccaaaaaaaaagaatgattaatcaatttaactcaatttacaacccaccagattagattaaggtcagttgaatttagttaaccgatttggagagaggaatggataggtaactattggcaagcaatcaaattagattaatgttatctttgccagcgcaattttagatcgcataggaggttgtggctaacgtacgccaatgctgacctccacacaattcggtttaaataaagcatattctctctctttccaattccaaagcgtcgttttcataatcgtactagtgtctttcttcatcctcttcgtgatcgtcttctgttgttgctccacttactatctttatttttctaaaattatttttccaattctatccttctcgcttcttagcttagccgttcgtcatcgatccagaaacgataaaggcagtaaaaaagtgacaatggatctgtttgctgttcatgcaaagaaccttttccacacaaattcgttttgccacagacccattcccttcaatttgggaaggagcaaagtgtttcagatcactgttttgaggagaaacccttactctaaagggtatcgcccattagttgtcagcgcctcggggaagaacaatcatgacaacaactcctcttcttccggtctgttatttcctttcatttcctttaaataatctataactgcttgttggccttatttgtctctctgtgattacaattacattaaagacacgctacatgacatgcatgtgatttgcattaggttttctttgggtcttagggtttcgaggggaaggaaaggttggccaaatttaacaaatgaaagaattgatccaagaaaaatagttattgttgcctgtttgttgagttccttcatgacattgaattcaattttctttcaagaacttgcttctttccatgtgaaacaaagctctatcttgaattgatgaaaatgaggaatggtcatcggtcatccctttttttaaattatgatcagttttaaaatttccaactcgagtgctatattatgcttttataatatatacaacaagtgaagagttttgcaattgtgtcacttaaatcttgtgttatttcttacaaacttcatacatatttgtaatgtgagaaaatatttcataataactagattaaaataatcagtgactttgaaagttgttagcgtgtggactcctgtggttgttgtaagtatagtttcattgtttgtttacctccttccccttctttaaatattttaatcataaaaggaggatatgttgtttctttttaatctatctttctcaatggggaagaatgtctgacaagaggtccttaaagtttggtatatagtggcagggttgttaatatagtctgttatgcatgcatttcatagcttttttggatttagctttatttgcattcaataaaagtttgcagcaaaaatatcttgtttgagcagtttaaaaatgacatcttcaggagtttgaaaatattagacggggtttcactagcggagactcttggaacagctggagtaagaagtccccaagtaagcgtattatatcttcaggagttgctgaacttagtattgaaggttgtatttcactggtttagtagttaataaatagtataaaagcttttaggtgatggaaaaaccttcaatttaactgttttgtaaaattgcttccccctcccatttttgagtgttttgatggctgtttctgatttgttaattcccattctttcagatttatcttctagatatttatgtgttttacacacttgtatcggctgtctacggattcttactgggggcaagagatcgactgggagaggtaagtacctttttgataatatgctgttattattaatatcttttacctattgctagtcttgtcctgtatatttcagaatttaagattagttggcataactttttttgtggttgtatgtggtcaccagattaggtcattggaagcactgtacaaactttttgagcagtttcctggagcttttatggacacacttcatgttcctctacccaacaggtgctgcttgtgaaatgtgctttttcttgttttatgatcttcattctgtatttttggaagatagttgtatatgtatgtgtcctatctttgttgtagctctctgagaatatatcctctcttctttcagattttccccttaattactactttttttgtataagcttatatagtttttctcaatattttatattttcaggagttcctatcagtcgtctgttcaggtcagccttttgctatagataaaggaaaacataatttggtctaaattcatgtttatttgcttgatacttgtgtactaacactaaaataagaaactttttatgttgatgggaaggttacagtacactggtctcatgtttgctgaacatttgttttgaacttgagtaaatattacttattcaattactcttcatccaaaggttggaaagaataacaaggttgatgctgctcggtttgcccccttttggaatgagatcataagaaatctaagggaggaggattatgtaaccaacttgttagtcatggaagcggctatacattttcttggctttatttatctttcttctttccttcttaattaatacctgaatggtcatgttttccttgctcacagcgaaatggagttgcttttaatgcctaggaattctggggatcttcctctggttcaatggccactttttttctacttgcaagcaaggtatttcagttattataatcattgttgtgtttcaaaggtctttttttgagtgtttaatcaaatactctgtaattgttcaaattttatgtttatgctagaatgtttggtcctcgtgtatatctgaatatctttattcgtatgatttctaagtagtttttttctagattttataatatttctttatgattaatactattagctagtactatcactaatggggtttaatgttctgtttttttttttgttgaatcataatatgccacaacaatttggtatcctcttattctgagtctcttttctcctttcttacctgaacactaatcattttctagttgtttcagtactcaattttaataacttgatatggatactgttcaatatacttaaatgcttgctgctacaatttcttactatatccttataagtgacaaacattgaaagaatttttgtttctagaaaactcaatcttcataaaatttggctcaaaatgagggatgccaccatataagaaaatcaattaaatatctttgctgttgtcgtcacctcaacaaagtttgtgaaaatatgtggatttctcatttgggtcaatacaggaccctaactaatgtgggctttatctggatgatgcactagtagaatcctcaatcttgtctagccacaatttgtgtcttcccagatttgtattgatgacatgaattgatgtttttgagaatataattaaattgtacaatatgaataaaaaacttacatttctgataactttggttcaaatttctagattttatgctgctctgtttgctttatttgaaaattgaggcttatccaactagaaaaaaaatatgcttccatctaatgatattgaaaaaatgtgcatatgtgaattttagtcattggttatatatagggaagtgtacaatgttttgtgaactgtaacacaatagtgactacatcttatcccagatgcttaacgtatgtatttatgccatattggtttttctcatttactgactttttgctcttattttttctttttgttaagattcatttatttgttcttttgcatgattgtgtagatatttttggctagggatactgctgttgagagtaaagataatagttgtgctttgggataggatttcccgagatatgattatatgatgtatatgctgtttaggagtgttactatactactaattcattttgacaaagacatcagatgatgtgggaaggacgtggtaagtataatttgtaacaattagtgtatcgagctgtgtttcctctatatgataaacctgaattatgatatttgatatgtttggggtttggggttttggggttttgggggtatgggatttgggggtttggcatttttagggttagggtttttggtttttttttttgggtttggggtgtggggtgtagggtttagtgtatctcatacccactaatatgtacaagacatcaatacacttggtcataaaatgcactggacattctcctcaggaaaatctcaacatatgttctgtatccctattctgtttcagtactcttcaatctttattattcgttttccaagtggtacaaccacatatcactcaagactcctgatccaaaaattgaaacaaaacccttcccatcatctggccaccaaaagttcagtaatttaagaataataatacttttcctaatcagcttaaaagttagtttaggcaataaacaaatttgaatagatctgtaagacaccagatcaataatatctgtgtaggttcaaaaggccatgcatcagattcaacataatgtaatttttaccaacaaaaaacaaggaagaagaaattggaaataaaatggaactataattatagaacataagaacaatataaattgaaatatttattgtttgtttcagattaataaatttggtttaattgaaaattttaactttaaaaaaaataattttttgtatagaatatataataaaaattattttaatgtatgtagttagaataaaatattgataacaaatataaatataccattaaatattaatttccatttttttattgaaatttgattgatatattaaatatttgattgttttaatcaaaggcttgtactagtgcactctataagaacctgttctagacattgagtatactatatatatttgatagatttggattgttgttcttaaaggatgtaaccctacatgatctggctgccaatgcacgacctaaagggggacaagatattgtatctcttatgggtcggatgatgaaacccaggaaaacagaaatcactgacaagttgagacaagtattttcttaacttttaatacaagtttgtagtttcttttttaaatagttagggggaaaattagggtttcggggattcggggttcggggtttcaatgttcggggtttcggggtttcggggtttcgggggtcggggttcgggggtgggggttcggggtttcgggggtcggggttcgggggtggggggttcggggttcggggtttaggggttgggggttcggggtttggggttggggtttaggggttcggggttgggggttcggggtttgggggtttggggttcggggtttcgggggtcggggttcgggggtgggggttcggggtttgggggtcggggttcgggggtgggggttcggggtttggggtttaggggttgggggttcggggtttgggggtttggggttgggggttcggggtttgggggtttcggggttgggggttcggggtttgggggttcggggtttgggggtttcggggttgggggttcggggtttgggggttcggggtttggggtttcggggggttcggggttcgggggttcgggggtttgggggttcgggggttcgggggttcggggttgttcggggttcggggttcgggttgggttcgggttgggggttcgggggttcgggggttcgggggttcggggttcggggtggggttcgggggttggggttcgggggttcggggttcggggttcgggggttcggggttcttcgggggttcggggggttcgggttcgggttcgggcgggttcggggttcggggttcggggttcggggttcgggttcggggttcggggggttcggggttcggggttc
